(12) United States Patent
Fotin-Mleczek et al.

(10) Patent No.: US 10,988,754 B2
(45) Date of Patent: Apr. 27, 2021

(54) NUCLEIC ACID MOLECULES

(71) Applicant: CureVac AG, Tübingen (DE)

(72) Inventors: Mariola Fotin-Mleczek, Sindelfingen (DE); Katja Fiedler, Bad Urach (DE); Aleksandra Kowalczyk, Stuttgart (DE); Regina Heidenreich, Tübingen (DE)

(73) Assignee: Cure Vac AG, Tübingen (DE)

( * ) Notice: Subject to any disclaimer, the term of this patent is extended or adjusted under 35 U.S.C. 154(b) by 0 days.

(21) Appl. No.: 16/026,729

(22) Filed: Jul. 3, 2018

(65) Prior Publication Data
US 2019/0040378 A1   Feb. 7, 2019

Related U.S. Application Data

(63) Continuation of application No. PCT/EP2017/066676, filed on Jul. 4, 2017.

(51) Int. Cl.
| | | |
|---|---|---|
| *A61K 48/00* | (2006.01) | |
| *A61K 39/00* | (2006.01) | |
| *C12N 9/90* | (2006.01) | |
| *C07K 14/705* | (2006.01) | |
| *A61K 39/39* | (2006.01) | |
| *A61K 39/385* | (2006.01) | |
| *A61K 38/00* | (2006.01) | |

(52) U.S. Cl.
CPC ............. *C12N 9/90* (2013.01); *A61K 39/00* (2013.01); *A61K 39/0011* (2013.01); *A61K 39/385* (2013.01); *A61K 39/39* (2013.01); *C07K 14/70521* (2013.01); *C12Y 503/03012* (2013.01); *A61K 38/00* (2013.01); *A61K 2039/53* (2013.01); *A61K 2039/605* (2013.01); *A61K 2039/6031* (2013.01); *C07K 2319/02* (2013.01); *C07K 2319/03* (2013.01)

(58) Field of Classification Search
CPC combination set(s) only.
See application file for complete search history.

(56) References Cited

U.S. PATENT DOCUMENTS

| | | | | |
|---|---|---|---|---|
| 7,423,023 | B2 * | 9/2008 | Boyle ............... | A61K 39/008 514/44 R |
| 2003/0091590 | A1 | 5/2003 | Pomerantz | |
| 2005/0032730 | A1 | 2/2005 | von der Mülbe et al. | |
| 2005/0059624 | A1 | 3/2005 | Hoerr et al. | |
| 2005/0250723 | A1 | 11/2005 | Hoerr et al. | |
| 2006/0188490 | A1 | 8/2006 | Hoerr et al. | |
| 2007/0048301 | A1 * | 3/2007 | Bodary-Winter ...... | C07K 14/47 424/143.1 |
| 2007/0224208 | A1 * | 9/2007 | Guo ................... | A61K 39/0011 424/184.1 |
| 2008/0025944 | A1 | 1/2008 | Hoerr et al. | |
| 2008/0267873 | A1 | 10/2008 | Hoerr et al. | |
| 2009/0324584 | A1 | 12/2009 | Hoerr et al. | |
| 2010/0048883 | A1 | 2/2010 | Ketterer et al. | |
| 2010/0111993 | A1 * | 5/2010 | Tureci ................. | A61P 35/00 424/192.1 |
| 2010/0189729 | A1 | 7/2010 | Hoerr et al. | |
| 2010/0203076 | A1 | 8/2010 | Fotin-Mleczek et al. | |
| 2010/0291156 | A1 | 11/2010 | Barner et al. | |
| 2010/0305196 | A1 | 12/2010 | Probst et al. | |
| 2011/0053829 | A1 | 3/2011 | Baumhof et al. | |
| 2011/0250225 | A1 | 10/2011 | Fotin-Mleczek et al. | |
| 2012/0021043 | A1 | 1/2012 | Kramps et al. | |
| 2012/0258046 | A1 | 10/2012 | Mutzke | |
| 2013/0129754 | A1 | 5/2013 | Thess et al. | |
| 2013/0142818 | A1 | 6/2013 | Baumhof et al. | |
| 2013/0259879 | A1 | 10/2013 | Baumhof et al. | |
| 2013/0280283 | A1 | 10/2013 | Lorenz et al. | |
| 2013/0282083 | A1 | 10/2013 | Vertikov | |
| 2013/0295043 | A1 | 11/2013 | Kallen et al. | |
| 2013/0336998 | A1 | 12/2013 | Kallen et al. | |
| 2015/0037326 | A1 | 2/2015 | Butler-Ransohoff et al. | |
| 2015/0050302 | A1 | 2/2015 | Thess | |
| 2015/0057340 | A1 | 2/2015 | Thess et al. | |
| 2015/0093413 | A1 | 4/2015 | Thess et al. | |
| 2015/0118183 | A1 | 4/2015 | Baumhof | |
| 2015/0118264 | A1 | 4/2015 | Baumhof et al. | |
| 2015/0165006 | A1 | 6/2015 | Thess et al. | |

(Continued)

FOREIGN PATENT DOCUMENTS

| | | | | |
|---|---|---|---|---|
| WO | WO-9958658 | A2 * | 11/1999 | ............ C07K 14/445 |
| WO | WO 2002/085933 | | 10/2002 | |

(Continued)

OTHER PUBLICATIONS

Weng et al., DNA vaccine elicits an efficient antitumor response by targeting the mutant Kras in a transgenic mouse lung cancer model. Gene Therapy (2014) 21, 888-896 (Year: 2014).*
Huang et al., Enhanced antitumor immunity by fusion of CTLA-4 to a self tumor antigen. Blood. 2000;96: 3663-3670 (Year: 2000).*
Bonifacino et al., "Signals for Sorting of Transmembrane Proteins to Endosomes and Lysosomes," *Annu. Rev. Biochem.*, 72(1):395-447, 2003.
Boyle et al., "Enhanced responses to a DNA vaccine encoding a fusion antigen that is directed to sites of immune induction," *Nature*, 392:408-411, 1998.
Deliyannis et al., "A fusion DNA vaccine that targets antigen-presenting cells increases protection from viral challenge," *Proc. Natl. Acad. Sci. USA*, 97(12):6676-6680, 2000.

(Continued)

*Primary Examiner* — Arthur S Leonard
(74) *Attorney, Agent, or Firm* — Parker Highlander PLLC

(57) ABSTRACT

The present invention provides novel artificial nucleic acid molecules encoding at least one antigenic peptide or protein and at least one additional sequence preferably targeting the antigenic peptides or proteins to cellular compartments of interest. Further, the invention provides (pharmaceutical) compositions or vaccines and kits comprising said nucleic acid molecules. The nucleic acid molecules, (pharmaceutical) compositions or vaccines and kits are useful for treating a variety of diseases such as cancer, infectious diseases, autoimmune diseases, allergies or graft-versus host disease.

21 Claims, 7 Drawing Sheets

Specification includes a Sequence Listing.

(56) References Cited

U.S. PATENT DOCUMENTS

| | | |
|---|---|---|
| 2015/0184195 A1 | 7/2015 | Thess |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake |
| 2016/0304883 A1 | 10/2016 | Grund |
| 2016/0304938 A1 | 10/2016 | Wochner |
| 2016/0326575 A1 | 11/2016 | von der Mülbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek |
| 2017/0326225 A1 | 11/2017 | Rauch |
| 2018/0044687 A1 | 2/2018 | Thess et al. |
| 2018/0125952 A1 | 5/2018 | Fotin-Mleczek |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237789 A1 | 8/2018 | Schlake |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer |
| 2019/0010485 A1 | 1/2019 | Yazdan Panah et al. |
| 2019/0017100 A1 | 1/2019 | Wochner |
| 2019/0024096 A1 | 1/2019 | Schmid et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0241925 A1* | 8/2019 | Hishiya ............... C07K 14/705 |

FOREIGN PATENT DOCUMENTS

| | | | |
|---|---|---|---|
| WO | WO-2007024708 A2 * | 3/2007 | ........... A61K 38/177 |
| WO | WO 2012/031043 | 3/2012 | |
| WO | WO 2013/033563 | 3/2013 | |
| WO | WO 2014/100385 | 6/2014 | |
| WO | WO 2015/024666 | 2/2015 | |
| WO | WO 2015/082922 | 6/2015 | |
| WO | WO 2015/100219 | 7/2015 | |
| WO | WO 2015/101415 | 7/2015 | |
| WO | WO 2016/170176 | 10/2016 | |
| WO | WO 2017/021546 | 2/2017 | |
| WO | WO 2017/025447 | 2/2017 | |
| WO | WO 2017/064146 | 4/2017 | |
| WO | WO 2017/081110 | 5/2017 | |
| WO | WO 2017/137095 | 8/2017 | |
| WO | WO 2017/140905 | 8/2017 | |
| WO | WO 2017/162297 | 9/2017 | |
| WO | WO 2017/182634 | 10/2017 | |
| WO | WO 2017/186928 | 11/2017 | |
| WO | WO 2017/191258 | 11/2017 | |
| WO | WO 2017/191274 | 11/2017 | |
| WO | WO 2017/203008 | 11/2017 | |
| WO | WO 2017/212006 | 12/2017 | |
| WO | WO 2017/212007 | 12/2017 | |
| WO | WO 2017/212008 | 12/2017 | |
| WO | WO 2017/212009 | 12/2017 | |
| WO | WO 2018/033254 | 2/2018 | |
| WO | WO 2018/078053 | 5/2018 | |

OTHER PUBLICATIONS

Fiedler et al, "mRNA Cancer Vaccines," In: *Current Strategies in Cancer Gene Therapy*, Springer International Publishing AG, pp. 61-85, 2016.

International Search Report and Written Opinion issued in corresponding PCT Application No. PCT/EP2018/068015, dated Oct. 22, 2018.

Kallen et al., "A novel, disruptive vaccination technology: self-adjuvanced RNActive® vaccines," *Human Vaccin. Immunother.*, 9(10):2263-2276, 2013.

Kübler et al., "Self-adjuvanted mRNA vaccination in advanced prostate cancer patients: a first-in-man phase I/IIa study," *J. Immunother. Cancer*, 3(26): , 2015.

Xu et al., "Analysis of the molecular mechanisms of targeted anti-caries DNA plasmid enhancing antibody responses by gene arrays," *J. Gene Med.*, 11(4):354-360, 2009.

* cited by examiner

NUCLEIC ACID MOLECULES

Unlike conventional protein-based vaccines, nucleic acid vaccines are based on nucleic acid molecules-either DNA or RNA-encoding vaccine antigens. DNA vaccines typically consist of antigen-encoding gene(s) inserted into a bacterial plasmid under the control of a eukaryotic promoter, whereas RNA vaccines may usually employ messenger RNAs (mRNA) or other antigen-encoding RNA molecules. Like protein vaccines, nucleic acid vaccines can be delivered through a variety of different routes, including intramuscular, subcutaneous, mucosal, or transdermal delivery. However, unlike protein antigens, the nucleic acid vaccine to be effective must gain entry to the cytoplasm of cells at the injection site in order to induce antigen expression in vivo, thereby enabling antigen presentation on major histocompatability molecules (MHC) and T-cell recognition (Li and Petrovsky Expert Rev Vaccines. 2016; 15(3): 313-329, McNamara et al. J Immunol Res. 2015; 2015: 794528).

DNA vaccines are administered to the host and internalized by host cells, where the antigen-encoding DNA plasmid is transcribed in the nucleus and translated in the cytoplasm by host cellular machinery. Unlike DNA vaccines, antigen-encoding mRNAs only needs to gain entry into the cytoplasm, where translation occurs, in order to transfect a cell. Either way, the resulting proteins are processed into peptides, which are ultimately presented on the surface of host cells in the context of major histocompatibility complex (MHC) molecules. The peptide-MHC complex is recognized by antigen-specific T cells, resulting in a cellular host immune response (McNamara et al. J Immunol Res. 2015; 2015: 794528).

There are two branches of MHC receptor presentation. MHC class I molecules-abundantly expressed in all nucleated cells and also in platelets-bind endogenously produced peptides including viral peptides and tumor antigens in the endoplasmatic reticulum (ER). Specifically, MHC class I molecules present peptides that result from proteolytic cleavage of endogenous proteins. Cleaved peptide fragments bind to an antigen peptide transporter (TAP) of the endoplasmic reticulum (ER), where they undergo further trimming of N-terminal residues and then bind to MHC class I complexes (Murphy K (2011) Janeways Immunobiology. New York: Garland Science).

In contrast, MHC class II molecules are predominantly expressed by professional antigen-presenting cells (APCs) such as macrophages, B cells, and especially dendritic cells (DCs). MHC class II molecules acquire their peptides from endocytosed antigens in endocytic vesicles. Specifically, the class II molecules primarily present peptides of exogenous or plasma membrane proteins that are taken up by APCs during the course of endocytosis. The antigen is processed through a series of endosomal compartments with denaturing environment and a set of proteolytic and denaturing enzymes (Bryant et al. Adv. Immunol. 2002; 80:71-114). As the major proportion of MHC class II epitopes is generated by cleavage and processing of peptides by endosomal and lysosomal proteases, MHC class II epitopes are mainly derived from endocytosed proteins and antigens, which reside in or travel through the endocytic pathway. Proteins without direct access to the endocytic pathway (e.g., antigens naturally located in the cytoplasm, in nonendocytic organelles, or in the nucleus) are in general poorly presented in a MHC class II context.

Antigen/MI-IC complexes are recognized by T-lymphocytes bearing the antigen-specific TORs (T-cell receptors). Antigenic peptides presented in a MHC class I context are recognized by $CD8^+$ cytotoxic T-lymphocytes (CTLs), whereas complexes of antigenic peptides and MHC class II molecules are recognized by $CD4^+$-T helper-cells. While $CD8^+$ CTLs mediate important cell-mediated effector functions including cytotoxic activity directed against cancerous or virus-infected cells, $CD4^+$ T helper cells play a key role in orchestrating CTL effector functions and antibody production. Nucleic acid vaccines have many advantages over traditional peptide/protein vaccines with vaccine design being straightforward, thereby reducing cost and production time. Moreover nucleic acid vaccines allow easy delivery of multiple antigens with one immunization and can induce both humoral and cellular immune responses, which makes tumor/pathogen escape less likely. Additionally, unlike peptide-based vaccines, nucleic acid-based vaccines are not restricted by the patient's HLA type. Furthermore, the in vivo expression of an antigen and endogenous post-translational modification results in native protein structures ensuring appropriate processing and immune presentation. From a safety aspect, cloning or synthesis of nucleic acids rather than having to purify proteins from pathogens avoids the need for use of pathogenic microorganisms in vaccine manufacture, rendering nucleic acid vaccines generally safe and tolerable (Li and Petrovsky Expert Rev Vaccines. 2016; 15(3): 313-329, McNamara et al. J Immunol Res. 2015; 2015: 794528).

Despite their promising characteristics, DNA vaccines were found to elicit less of an immune response than other types of vaccines, including peptide vaccines, cellular vaccines, viral vector vaccines, and RNA vaccines. The relatively poor immunogenicity of DNA vaccines combined with concerns about their potential for oncogenesis via integration into the host genome renders RNA-based vaccines particularly appealing. However, antigens encoded by RNA vaccines are typically translated in the cytoplasm and degraded by proteasomes, resulting predominantly in MHC class I-mediated presentation to $CD8^+$ T cells. In order to foster CTL-mediated immune responses, or even induce antibody production, an additional stimulation of a productive T helper cell response via the MHC class II pathway would be highly desirable (McNamara et al. J Immunol Res. 2015; 2015: 794528).

Different strategies were tested in preclinical models to exploit the therapeutic potential of nucleic acid vaccines, including novel plasmid vectors and codon optimization to enhance antigen expression, new gene transfection systems or electroporation to increase delivery efficiency, protein or live virus vector boosting regimens to maximise immune stimulation, and formulation of nucleic acid vaccines with traditional or molecular adjuvants (Li and Petrovsky Expert Rev Vaccines. 2016; 15(3): 313-329). Several studies have demonstrated that addition of a lysosomal targeting signal to the antigen-encoding sequence can result in a productive T helper cell response. Additionally, tumor antigen mRNAs fused to a signal peptide and an HLA class II sorting can result in HLA class I and II presentation (WO200212281; Marks et al. 1995 J Cell Biol. 1995; 131:351-369; Kreiter et al. 2007 J Immunol. 2008 Jan. 1; 180(1):309-18.). Diebold et al. (Gene Ther. 2001 March; 8(6):487-93) demonstrated that dendritic cells expressing cDNA as transferrin receptor (TfR) or invariant chain fusions were capable of generating MHC class II specific immune responses in addition to MHC class I responses. Kreiter et al. (J Immunol. 2008 Jan. 1; 180(1):309-18) reported that combining an N-terminal leader peptide with an MHC class I trafficking signal (MITD) attached to the C terminus of an RNA-encoded antigen strongly improves the presentation of MHC class I and class II epitopes in human and murine dendritic cells (DCs).

In the two decades since their initial discovery, nucleic acid vaccines technologies have come a long way. However, effective strategies for boosting both CD8$^+$ and CD4$^+$ T cell responses and thereby increasing the therapeutic or prophylactic efficacy of nucleic acid based vaccines are still missing.

Boyle et al. (Nature. 1998 Mar. 26; 392(6674):408-11), Deliyannis et al. (Proc Natl Acad Sci USA. 2000 Jun. 6; 97(12):6676-80) and Xu et al. (J Gene Med. 2009 April; 11(4):354-60) all describe DNA vaccines encoding fusion proteins with extracellular domains of CTLA4. These extracellular domains specifically target the fused antigens to professional antigen-presenting cells expressing the CTLA4 ligand B7.

It is an object of the present invention to comply with the needs in the art and to provide improved therapeutic approaches for the treatment of the diseases specified herein. The object underlying the present invention is solved by the claimed subject matter, inter alia by providing nucleic acids encoding fusion proteins with functional transmembrane domains for improved antigen "loading" of MHC-I and MHC-II in the respective cellular compartments.

Although the present invention is described in detail below, it is to be understood that this invention is not limited to the particular methodologies, protocols and reagents described herein as these may vary. It is also to be understood that the terminology used herein is not intended to limit the scope of the present invention which will be limited only by the appended claims. Unless defined otherwise, all technical and scientific terms used herein have the same meanings as commonly understood by one of ordinary skill in the art.

In the following, the elements of the present invention will be described. These elements are listed with specific embodiments, however, it should be understood that they may be combined in any manner and in any number to create additional embodiments. The variously described examples and preferred embodiments should not be construed to limit the present invention to only the explicitly described embodiments. This description should be understood to support and encompass embodiments which combine the explicitly described embodiments with any number of the disclosed and/or preferred elements. Furthermore, any permutations and combinations of all described elements in this application should be considered disclosed by the description of the present application unless the context indicates otherwise.

Throughout this specification and the claims which follow, unless the context requires otherwise, the term "comprise", and variations such as "comprises" and "comprising", will be understood to imply the inclusion of a stated member, integer or step but not the exclusion of any other non-stated member, integer or step. The term "consist of" is a particular embodiment of the term "comprise", wherein any other non-stated member, integer or step is excluded. In the context of the present invention, the term "comprise" encompasses the term "consist of". The term "comprising" thus encompasses "including" as well as "consisting" e.g., a composition "comprising" X may consist exclusively of X or may include something additional e.g., X+Y.

The terms "a" and "an" and "the" and similar reference used in the context of describing the invention (especially in the context of the claims) are to be construed to cover both the singular and the plural, unless otherwise indicated herein or clearly contradicted by context. Recitation of ranges of values herein is merely intended to serve as a shorthand method of referring individually to each separate value falling within the range. Unless otherwise indicated herein, each individual value is incorporated into the specification as if it were individually recited herein. No language in the specification should be construed as indicating any non-claimed element essential to the practice of the invention.

The word "substantially" does not exclude "completely" e.g., a composition which is "substantially free" from Y may be completely free from Y. Where necessary, the word "substantially" may be omitted from the definition of the invention.

The term "about" in relation to a numerical value x means x±10%.

In the present invention, if not otherwise indicated, different features of alternatives and embodiments may be combined with each other.

For the sake of clarity and readability the following definitions are provided. Any technical feature mentioned for these definitions may be read on each and every embodiment of the invention. Additional definitions and explanations may be specifically provided in the context of these embodiments.

Definitions

Artificial nucleic acid molecule: An artificial nucleic acid molecule may typically be understood to be a nucleic acid molecule, e.g. a DNA or an RNA, that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides, which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

DNA: DNA is the usual abbreviation for deoxy-ribo-nucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are-by themselves-composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by A/T-base-pairing and G/C-base-pairing.

Heterologous sequence: Two sequences are typically understood to be 'heterologous' if they are not derivable from the same gene. I.e., although heterologous sequences may be derivable from the same organism, they naturally (in nature) do not occur in the same nucleic acid molecule, such as in the same mRNA.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Nucleic acid molecule: A nucleic acid molecule is a molecule comprising, preferably consisting of nucleic acid components. The term nucleic acid molecule preferably refers to DNA or RNA molecules. It is preferably used synonymous with the term "polynucleotide". Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Open reading frame: An open reading frame (ORF) in the context of the invention may typically be a sequence of several nucleotide triplets, which may be translated into a peptide or protein. An open reading frame preferably contains a start codon, i.e. a combination of three subsequent nucleotides coding usually for the amino acid methionine (ATG), at its 5'-end and a subsequent region, which usually exhibits a length which is a multiple of 3 nucleotides. An ORF is preferably terminated by a stop-codon (e.g., TAA, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The open reading frame may be isolated or it may be incorporated in a longer nucleic acid sequence, for example in a vector or an mRNA. An open reading frame may also be termed "(protein) coding sequence" or, preferably, "coding sequence".

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and 600 monomeric units.

Polyvalent/multivalent composition: The terms "polyvalent composition" or "multivalent composition" will be recognized and understood by the person of ordinary skill in the art, and are e.g. intended to refer to a composition or a vaccine comprising different antigens or epitopes of different antigens, or comprising different epitopes of the same antigen, or any combination thereof. The terms describe that said vaccine or composition has more than one valence. In the context of the invention, a polyvalent cancer vaccine would comprise at least one artificial nucleic acid molecule e.g.

RNA encoding antigenic peptides or proteins derived from several different antigens or encoding different epitopes from the same antigen, or a combination thereof.

Protein: A protein typically comprises one or more peptides or polypeptides. A protein is typically folded into 3-dimensional form, which may be required for the protein to exert its biological function.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribonucleic acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, an open reading frame, a 3'-UTR and a poly(A) sequence.

The artificial RNA, preferably the mRNA of the invention may be prepared using any method known in the art, including chemical synthesis such as e.g. solid phase RNA synthesis, as well as in vitro methods, such as RNA in vitro transcription reactions.

RNA in vitro transcription/in vitro transcription: The terms "RNA in vitro transcription" or "in vitro transcription" relate to a process wherein RNA is synthesized in a cell-free system (in vitro). DNA, particularly plasmid DNA (or PCR product), is typically used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase. Particular examples of DNA-dependent RNA polymerases are the T7, T3, and SP6 RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, for example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Reagents used in RNA in vitro transcription typically include: a DNA template (linearized plasmid DNA or PCR product) with a promoter sequence that has a high binding affinity for its respective RNA polymerase such as bacteriophage-encoded RNA polymerases (T7, T3, SP6, or Syn5); ribonucleotide triphosphates (NTPs) for the four bases (adenine, cytosine, guanine and uracil); optionally, a cap analogue as defined herein (e.g. m7G(5')ppp(5')G (m7G)); optionally, further modified nucleotides as defined herein; a DNA-dependent RNA polymerase capable of binding to the promoter sequence within the DNA template (e.g. T7, T3, SP6, or Syn5 RNA polymerase); optionally, a ribonuclease (RNase) inhibitor to inactivate any contaminating RNase; optionally, a pyrophosphatase to degrade pyrophosphate, which may inhibit transcription; MgCl2, which supplies Mg2+ ions as a co-factor for the polymerase; a buffer (TRIS or HEPES) to maintain a suitable pH value, which can also contain antioxidants (e.g. DTT), and/or polyamines such as spermidine at optimal concentrations, or a buffer system as disclosed in WO2017/109161.

In the context of nucleic acid vaccine production, it may be required to provide GMP-grade RNA. GMP-grade RNA may be suitably produced using a manufacturing process approved by regulatory authorities. Accordingly, in a particularly preferred embodiment, RNA production is performed under current good manufacturing practice (GMP), implementing various quality control steps on DNA and RNA level, according to WO2016/180430. Accordingly, the RNA of the invention is a GMP-grade RNA, particularly a GMP-grade RNA mRNA.

The obtained RNA products are preferably purified using PureMessenger® (CureVac, Tibingen, Germany; RP-HPLC according to WO2008/077592) and/or tangential flow filtration (as described in WO2016/193206). Where nucleic acid sequences are reported in the context of the present invention, these sequences generally comprise both, the specific RNA or DNA sequence as well as its corresponding DNA or RNA counterpart, respectively. For example, where a DNA sequence is provided, the skilled person knows that the corresponding RNA sequence is obtained by exchange of thymine by uracil residues and vice versa.

Sequence of a nucleic acid molecule: The sequence of a nucleic acid molecule is typically understood to be the particular and individual order, i.e. the succession of its nucleotides. The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent to which two sequences are identical, i.e. it typically describes the percentage of nucleotides that correspond in their sequence position with identical nucleotides of a reference-sequence. For determination of the degree of identity ("% identity), the sequences to be compared are typically considered to exhibit the same length, i.e. the length of the longest sequence of the sequences to be compared. This means that a first sequence consisting of 8 nucleotides is 80% identical to a second sequence consisting of 10 nucleotides comprising the first sequence. In other words, in the context of the present invention, identity of sequences preferably relates to the percentage of nucleotides or amino acids of a sequence which have the same position in two or more sequences having the same length. Specifically, the "% identity" of two amino acid sequences or two nucleic acid sequences may be determined by aligning the sequences for optimal comparison purposes (e.g., gaps can be introduced in either sequences for best alignment with the other sequence) and comparing the amino acids or nucleotides at corresponding positions. Gaps are usually regarded as non-identical positions, irrespective of their actual position in an alignment. The "best alignment" is typically an alignment of two sequences that results in the highest percent identity. The percent identity is determined by the number of identical nucleotides in the sequences being compared (i.e., % identity=# of identical positions/total # of positions×100). The determination of percent identity between two sequences can be accomplished using a mathematical algorithm known to those of skill in the art.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection:

The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding sequence and the 3'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication.

Vehicle: A vehicle is typically understood to be a material that is suitable for storing, transporting, and/or administering a compound, such as a pharmaceutically active compound. For example, it may be a physiologically acceptable liquid, which is suitable for storing, transporting, and/or administering a pharmaceutically active compound.

The present application is filed together with a sequence listing in electronic format, which is part of the description of the present application (WIPO standard ST.25). The information contained in the electronic format of the sequence listing filed together with this application is incorporated herein by reference in its entirety. Where reference is made herein to a "SEQ ID NO:" the corresponding nucleic acid sequence or amino acid (aa) sequence in the sequence listing having the respective identifier is referred to. For many sequences, the sequence listing also provides additional detailed information, e.g. regarding certain structural features, sequence optimizations, GenBank identifiers, or regarding its coding capacity. In particular, such information is provided under numeric identifier <223> in the WIPO standard ST.25 sequence listing. Accordingly, information provided under said numeric identifier <223> is explicitly included herein in its entirety and has to be understood as integral part of the description of the underlying invention.

The present invention is based, in part, on the surprising finding that antigen fusion to suitable "targeting" sequences derived from a group of signal transduction proteins involved in immune responses advantageously routes these antigens to MHC class I and MHC class II processing compartments. These "targeting" sequences preferably comprise or consist of transmembrane domains. Proteins (e.g. CTLA4) containing the employed "targeting" sequences are expressed on the external side of plasma membranes, and are typically "fast recycling" proteins that are readily and recurrently internalized to enter the endosomal pathways, which preferably intersect MHC class I and in particular also MHC class II pathways. The "targeting" approach of the present invention is therefore different from other prior art approaches in that it preferably targets antigens to desired intracellular pathways, rather than certain cell types.

For effective delivery of antigenic sequences to MHC class I and MHC class II processing compartments, nucleic acid molecules can be engineered to encode antigens/ epitopes that are fused to suitable amino acid sequences derived from fast-recycling proteins residing in the plasma membrane. Targeting can be achieved by using the full-length amino acid sequence of a protein, or preferably its transmembrane (and optionally cytoplasmic) domains, preferably together with a suitable signal peptide. Fusing these sequences to the antigenic peptide or protein of interest preferably facilitates the localization of the antigens/ epitopes to the plasma membrane, and its recycling to cellular compartments where the MHC class I and II processing and loading take place, like the endoplasmic reticulum, endosomes or the lysosome. The unprecedented targeting strategy presented herein exploits the fast-recycling characteristics conferred by amino acid sequences (in particular transmembrane domains) derived from the group of immune-response activating signal transduction (IRST$_{epm}$) proteins residing in the plasma membrane of immune cells. By effectively routing antigenic peptides or proteins to the plasma membrane and effecting their anchorage therein and subsequent recycling to cellular compartments intersecting with the MHC processing and loading pathways via the fused IRST$_{epm}$-derived protein domains, the presentation of encoded antigens/epitopes by MHC class I and MHC class II in recipient cells and therefore the induction of antigen-specific immune responses against the immunogenic epitopes or whole antigens by nucleic acid-based vaccines is preferably increased. The targeting approach presented herein therefore exploits the common pathways of fast-recycling of membrane-bound IRST$_{epm}$-proteins, instead of using state-of-the-art approaches of directing the translated antigenic proteins or peptides directly to endosomal/lysosomal compartments via the fusion of different trafficking sequences.

To that end, the present inventors generated nucleic acid molecules encoding such antigenic fusion proteins and investigated their therapeutic potential in a tumor model. Therefore, antigenic proteins, peptides or epitopes of interest were joined to selected domains or full-length proteins derived from several fast-recycling immune-response activating signal transduction proteins. Typically, nucleic acid constructs were designed by removing the extracellular domain of the protein and replace it by the antigen/epitope. Signal peptides and transmembrane domains can be included to optimize transport to and anchorage on the external site of the plasma membrane. Additionally, suitable linkers were introduced to allow the correct presentation of immunogenic peptides by the MHC class I and class II molecules. T helper cell epitopes may be included to increase the induction of antigen-specific immune responses against the encoded epitopes. The design strategy permitted the targeting of specific epitopes or whole antigens to MHC class I- and class II-enriched cellular compartments.

Surprisingly, the antigenic fusion proteins were capable of effectively inducing antigen-specific T cell responses, and and was shown to efficiently reduce tumor growth in a mouse model.

The novel targeting approach presented herein provides a convenient and effective means to preferably ensure antigen entry into MHC processing pathways. Thereby, said targeting strategy preferably enhances the induction of antigen-specific immune responses against antigenic peptides or proteins or epitopes and opens up new possibilities for the increased therapeutic efficacy of nucleic acid vaccines.

In a first aspect, the present invention relates to an artificial nucleic acid molecule comprising at least one coding region encoding a. at least one antigenic peptide or protein, and b. at least one additional amino acid sequence derived from at least one immune response signal transduction protein located in the external plasma membrane, as defined below.

Preferably, said at least one additional amino acid sequence comprises or consists of at least one transmembrane domain of said protein. Without wishing to be bound by specific theory, it is envisaged that the at least one additional amino acid sequence derived from the at least one immune response signal transduction protein located in the external plasma membrane (also referred to as "IRST$_{epm}$ herein) provides for an improved MHC class I and II presentation efficiency, preferably resulting in simultaneous stimulation and expansion of CD8⁺ and CD4⁺ T cell subsets.

The artificial nucleic acid molecule of the invention-which may preferably be an RNA as described below-thus encodes at least one $IRST_{epm}$ derived amino acid sequence (which is preferably selected based on its capability of routing fused amino acid sequences into desired compartments of MHC processing and loading) and at least one antigenic peptide or protein (which is preferably selected based on the particular disease or condition to be treated or prevented). Both are typically expressed as a fusion protein, which is also referred to as "antigenic fusion protein herein". As described below, the artificial nucleic acid molecules, preferably RNAs, of the invention may encode antigenic polypeptide constructs comprising several (identical or different) $IRST_{epm}$ derived amino acid sequences, several (identical or different) antigenic peptides or proteins, and optionally further (poly-)peptides, proteins or protein domains (such as signal peptides, peptide linkers, and T helper epitopes) in any combination disclosed herein. However, the artificial nucleic acid molecule, preferably RNA, of the invention is envisaged to encode an "antigenic polypeptide construct" comprising at least one antigenic peptide or protein, and at least one $IRST_{epm}$-derived additional amino acid sequence.

Coding Region $IRST_{epm}$-Derived Amino Acid Sequences

The present inventors surprisingly discovered that fusing antigenic peptides or proteins to appropriate targeting sequences derived from immune response-activating signal transduction proteins located in the external plasma membrane ("$IRST_{epm}$") effectively mediates MHC presentation, preferably resulting in increased T cell responses. Without wishing to be bound by specific theory, $IRST_{epm}$-derived amino acid sequences may preferably comprise targeting sequences, which mediate translocation into defined subcellular compartments of MHC processing and loading, resulting in enhanced MHC class I and class II presentation of antigenic peptides and proteins fused thereto. The term "immune-response-activating signal transduction" refers to the cascade of processes by which a signal interacts with a receptor, causing a change in the level or activity of a second messenger or other downstream target, and ultimately leading to activation or perpetuation of an immune response. The term "$IRST_{epm}$ protein" thus refers proteins located in the external plasma membrane, i.e. the leaflet of the plasma membrane that faces away from the cytoplasm, which are involved in such signaling cascades. $IRST_{epm}$ proteins are therefore preferably expressed on the plasma membrane of immune cells, more preferably of antigen-presenting cells (APCs). It will be acknowledged that due to the complexicty of intracellular signaling pathways, the term $IRST_{epm}$ protein may include proteins having dual roles in the regulation of immune responses and have inhibitory and activating effects in different settings. Preferred $IRST_{epm}$ proteins are indicated in Table 1 below. Preferably, "$IRST_{epm}$ proteins" are quickly recycled at the cellular surface.

As explained above, the inventive artificial nucleic acid molecules comprise at least one amino acid sequence "derived from" at least one $IRST_{epm}$ protein as defined herein.

The term "derived from" as used herein generally indicates that a sequence may be isolated from, related to, based on or homologous to a reference sequence. Sequences that are "derived from" a reference sequences thus include sequences that are identical to said reference sequence (i.e. full-length sequences exhibiting 100% sequence identity to said reference sequence), as well as variants, fragments and derivatives of said reference sequences. The definition is applicable to both amino acid sequences and nucleic acid sequences, mutatis mutandis.

Artificial nucleic acid molecules, preferably RNAs, of the invention preferably encode, in their at least one coding region, at least one amino acid sequence derived from an $IRST_{epm}$ protein as described herein, or a fragment, variant or derivative of any of said proteins.

As used herein, the term "(protein/amino acid sequence) variant" in general refers to "sequence variants", i.e. proteins or (poly-)peptides comprising an amino acid sequence that differs in at least one amino acid residue from a reference (or "parent") amino acid sequence of a reference (or "parent") protein or (poly-)peptide.

"Variant" proteins/(poly-)peptides may thus preferably comprise, in their amino acid sequence, at least one amino acid mutation, substitution, insertion or deletion as compared to their respective reference sequence. Substitutions may be selected from conservative or non-conservative substitutions. Protein/(poly-)peptide "variants" may comprise at least one conservative amino acid substitution, wherein amino acids, originating from the same class, are exchanged for one another. In particular, these are amino acids having aliphatic side chains, positively or negatively charged side chains, aromatic groups in the side chains or amino acids, the side chains of which can form hydrogen bridges, e.g. side chains which have a hydroxyl function. By conservative constitution, e.g. an amino acid having a polar side chain may be replaced by another amino acid having a corresponding polar side chain, or, for example, an amino acid characterized by a hydrophobic side chain may be substituted by another amino acid having a corresponding hydrophobic side chain (e.g. serine (threonine) by threonine (serine) or leucine (isoleucine) by isoleucine (leucine)). However, non-conservative amino acid substitutions are also envisaged herein.

Preferably, the term "variant" as used herein includes naturally occurring variants, e.g. preproteins, proproteins, and proteins/(poly-)peptides that have been subjected to post-translational proteolytic processing (this may involve removal of the N-terminal methionine, signal peptide, and/or the conversion of an inactive or non-functional protein to an active or functional one), and naturally occurring mutant proteins/(poly-)peptides. The term "variant" further encompasses engineered variants of proteins/(poly-)peptides, which may be (sequence-)modified to introduce or abolish a certain biological property and/or functionality. The terms "transcript variants" or "splice variants" in the context of proteins/(poly-)peptides refer to variants produced from messenger RNAs that are initially transcribed from the same gene, but are subsequently subjected to alternative (or differential) splicing, where particular exons of a gene may be included within or excluded from the final, processed messenger RNA (mRNA). It will be noted that the term "variant" may essentially be defined by way of a minimum degree of sequence identity (and preferably also a desired biological function/properties) as compared to a reference protein/(poly-)peptides. Thus, fragments or certain derivatives (which also differ in terms of their amino acid sequence from the reference protein/(poly-)peptide) could be classified as "variants" as well. Therefore, a "variant" as defined herein can be derived from, isolated from, related to or based on the reference protein/(poly-)peptide or a fragment or derivative thereof.

The term "(protein/amino acid sequence) variant" as used herein preferably refers to (poly-)peptides having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of the respective naturally occurring (wild-type) protein/(poly-)peptide, or a fragment or derivative thereof.

As used herein, the term "(protein/amino acid sequence) fragment" in general refers to a protein/(poly-)peptide that consists of a continuous subsequence of the full-length amino acid sequence of a reference (or "parent") protein/(poly-)peptide, which is, with regard to its amino acid sequence, N-terminally, C-terminally and/or intrasequentially truncated compared to the amino acid sequence of said reference protein/(poly-)peptide. Such truncation may occur either on the amino acid level or on the nucleic acid level, respectively. In other words, a "fragment" may typically be a shorter portion of a full-length sequence of an amino acid sequence. Accordingly, a fragment, typically, consists of a sequence that is identical to the corresponding stretch within the full-length amino acid sequence. The term includes naturally occurring fragments (such as fragments resulting from naturally occurring in vivo protease activity) as well as engineered fragments.

The term "(protein/amino acid sequence) fragment" as used herein may refer to a protein/(poly-)peptide comprising an amino acid sequence of at least 5 contiguous amino acid residues, at least 10 contiguous amino acid residues, at least 15 contiguous amino acid residues, at least 20 contiguous amino acid residues, at least 25 contiguous amino acid residues, at least 40 contiguous amino acid residues, at least 50 contiguous amino acid residues, at least 60 contiguous amino residues, at least 70 contiguous amino acid residues, at least contiguous 80 amino acid residues, at least contiguous 90 amino acid residues, at least contiguous 100 amino acid residues, at least contiguous 125 amino acid residues, at least 150 contiguous amino acid residues, at least contiguous 175 amino acid residues, at least contiguous 200 amino acid residues, or at least contiguous 250 amino acid residues of the amino acid sequence of a reference protein/(poly-)peptide, or a variant or derivative thereof.

A preferred fragment of a sequence in the context of the present invention, consists of a continuous stretch of amino acids corresponding to a continuous stretch of entities in the reference protein/(poly-)peptide, which represents at least 20%, preferably at least 30%, more preferably at least 40%, more preferably at least 50%, even more preferably at least 60%, even more preferably at least 70%, and most preferably at least 80% of the total (i.e. full-length) reference protein/(poly-)peptide, or a variant or derivative thereof, from which the fragment is derived.

A sequence identity indicated with respect to such a fragment preferably refers to the entire amino acid sequence of the reference protein/(poly-)peptide. Preferably, a "fragment" may typically comprise or consist of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably at least 90% and most preferably of at least 95% or even 97%, with the amino acid sequence of to a reference protein/(poly-)peptide, or a variant or derivative derivative thereof.

As used herein, the term "(protein/amino acid sequence) derivative", is generally to be understood as a protein/(poly-)peptide that has been modified with respect to a reference (or "parent") protein/(poly-)peptide to include a new or additional property or functionality. Derivatives may be modified to comprise desired biological functionalities (e.g. by introducing or removing moieties or domains that confer, enhance, reduce or abolish target binding affinity or specificity or enzymatic activities), manufacturing properties (e.g. by introducing moieties which confer an increased solubility or enhanced excretion, or allow for purification) or pharmacokinetic/pharmacodynamics properties for medical use (e.g. by introducing moieties which confer increased stability, bioavailability, absorption; distribution and/or reduced clearance). Derivatives may be prepared by introducing or removing a moiety or domain that confers a biological property or functionality of interest. Such moieties or domains may be introduced into the amino acid sequence (e.g. at the amino and/or carboxyl terminal residues) post-translationally or at the nucleic acid sequence level using standard genetic engineering techniques (cf. Sambrook J et al., 2012 (4th ed.), Molecular cloning: a laboratory manual. Cold Spring Harbor Laboratory, Cold Spring Harbor, New York). A "derivative" may be derived from (and thus optionally include) the naturally occurring (wild-type) protein/(poly-)peptide amino acid sequence, or a variant or fragment thereof. It will be understood that "(protein/amino acid sequence) derivatives" may differ (e.g. by way of introduction or removal of (poly-)peptide moieties and/or protein domains) in their amino acid sequence from the reference protein/(poly-)peptide that they are derived from, and thus may qualify as "variants" as well. However, whereas "(protein/amino acid sequence) variants" are primarily defined in terms of their sequence identity to a reference amino acid sequence, derivatives are preferably characterized by the presence or absence of a specific biological property or functionality as compared to the reference protein. Nevertheless, "(protein/amino acid sequence) derivatives" may preferably comprise or consist of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with the amino acid sequence of to a reference protein/(poly-)peptide, or a variant or fragment thereof.

According to preferred embodiments of the invention, the artificial nucleic acid molecule, preferably RNA, of the invention, encodes in its at least one coding region at least one additional amino acid sequence derived from any one of the proteins indicated in Table 1 below, or a (preferably functional) fragment, variant or derivative of any one of said proteins.

Preferably, in the context of the present invention, "functional" fragments, variants or derivatives substantially exhibit the same or comparable biological functionalities as their respective "parent" or "reference" sequence. The definition is applicable to "functional" protein/peptide/amino acid sequence fragments, variants or derivatives as well as "functional" nucleic acid sequence/polynucleotide fragments, variants or derivatives. The desired biological functionality is preferably indicated in the context of the respective sequence. In general, "functional" protein/peptide/amino acid sequence fragments, variants or derivatives may preferably exhibit the same or comparable binding characteristics, targeting characteristics, immune response-inducing characteristics . . . and so an as their "parent" or "reference" sequence. "Functional" nucleic acid sequence/polynucleotide fragments, variants or derivatives may preferably exhibit the same or a comparable capability as to encode and be expressed (i.e. optionally transcribed, and translated) to yield a desired protein/peptide/amino acid sequence as their respective "parent" or "reference" sequence.

"Functional" IRST$_{epm}$ protein fragments, variants and derivatives are preferably capable of directing antigenic proteins or peptides (preferably fused thereto) into MHC class I and preferably MHC class II processing compartments. The use of "functional" IRST$_{epm}$ protein fragments, variants and derivatives therefore preferably enhances CD4$^+$ T helper cell responses, and, accordingly, increased CD8$^+$ CTL and/or antibody-mediated immunity.

TABLE 1

IRST$_{epm}$ proteins

| # | UniProt Identifier | Protein Name | Short Name | SEQ ID NO: wt amino acid sequence | SEQ ID NO: wt nucleic acid sequence | SEQ ID NO: optimized nucleic acid sequence |
|---|---|---|---|---|---|---|
| 1 | P16410 | Cytotoxic T-lymphocyte protein 4 | CTLA4 | SEQ ID NO: 169 | 377 | 585, 793, 1001, 1209, 1417, 1625, 1833, 2041, 2249, 2457, 2665, 2873 |
| 2 | P32248 | C-C chemokine receptor type 7 | CCR7 | SEQ ID NO: 173 | 381 | 589, 797, 1005, 1213, 1421, 1629, 1837, 2045, 2253, 2461, 2669, 2877 |
| 3 | A0A5B9 | T-cell receptor beta-2 chain C region | TRBC2 | SEQ ID NO: 157 | 365 | 573, 781, 989, 1197, 1405, 1613, 1821, 2029, 2237, 2445, 2653, 2861 |
| 4 | B7Z8K6 | T-cell receptor delta TRDC chain C region | | SEQ ID NO: 158 | 366 | 574, 782, 990, 1198, 1406, 1614, 1822, 2030, 2238, 2446, 2654, 2862 |
| 5 | B9A064 | Immunoglobulin lambda-like polypeptide 5 | IGLL5 | SEQ ID NO: 159 | 367 | 575, 783, 991, 1199, 1407, 1615, 1823, 2031, 2239, 2447, 2655, 2863 |
| 6 | O00206 | Toll-like receptor 4 | TLR4 | SEQ ID NO: 160 | 368 | 576, 784, 992, 1200, 1408, 1616, 1824, 2032, 2240, 2448, 2656, 2864 |
| 7 | P01730 | T-cell surface glycoprotein CD4 | CD4 | SEQ ID NO: 161 | 369 | 577, 785, 993, 1201, 1409, 1617, 1825, 2033, 2241, 2449, 2657, 2865 |
| 8 | P01850 | T-cell receptor beta-1 chain C region | TRBC1 | SEQ ID NO: 162 | 370 | 578, 786, 994, 1202, 1410, 1618, 1826, 2034, 2242, 2450, 2658, 2866 |
| 9 | P07766 | T-cell surface glycoprotein CD3 epsilon chain | CD3E | SEQ ID NO: 163 | 371 | 579, 787, 995, 1203, 1411, 1619, 1827, 2035, 2243, 2451, 2659, 2867 |
| 10 | P08575 | Receptor-type tyrosine-protein phosphatase C | PTPRC | SEQ ID NO: 164 | 372 | 580, 788, 996, 1204, 1412, 1620, 1828, 2036, 2244, 2452, 2660, 2868 |

TABLE 1-continued

IRST$_{epm}$ proteins

| # | UniProt Identifier | Protein Name | Short Name | SEQ ID NO: wt amino acid sequence | SEQ ID NO: wt nucleic acid sequence | SEQ ID NO: optimized nucleic acid sequence |
|---|---|---|---|---|---|---|
| 11 | P08637 | Low affinity immunoglobulin gamma Fc region receptor III-A | FCG3A | SEQ ID NO: 165 | 373 | 581, 789, 997, 1205, 1413, 1621, 1829, 2037, 2245, 2453, 2661, 2869 |
| 12 | P10747 | T-cell-specific surface glycoprotein CD28 | CD28 | SEQ ID NO: 166 | 374 | 582, 790, 998, 1206, 1414, 1622, 1830, 2038, 2246, 2454, 2662, 2870 |
| 13 | P11912 | B-cell antigen receptor complex-associated protein alpha chain | CD79A | SEQ ID NO: 167 | 375 | 583, 791, 999, 1207, 1415, 1623, 1831, 2039, 2247, 2455, 2663, 2871 |
| 14 | P15391 | B-lymphocyte antigen CD19 | CD19 | SEQ ID NO: 168 | 376 | 792, 1000, 1208, 1416, 1624, 1832, 2040, 2248, 2456, 2664, 2872, 584 |
| 15 | P16671 | Platelet glycoprotein 4 | CD36 | SEQ ID NO: 170 | 378 | 586, 794, 1002, 1210, 1418, 1626, 1834, 2042, 2250, 2458, 2666, 2874 |
| 16 | P26718 | NKG2-D type II integral membrane protein | NKG2D | SEQ ID NO: 171 | 379 | 587, 795, 1003, 1211, 1419, 1627, 1835, 2043, 2251, 2459, 2667, 2875 |
| 17 | P30273 | High affinity immunoglobulin epsilon receptor subunit gamma | FCERG | SEQ ID NO: 172 | 380 | 588, 796, 1004, 1212, 1420, 1628, 1836, 2044, 2252, 2460, 2668, 2876 |
| 18 | P40259 | B-cell antigen receptor complex-associated protein beta chain, | CD79B | SEQ ID NO: 174 | 382 | 590, 798, 1006, 1214, 1422, 1630, 1838, 2046, 2254, 2462, 2670, 2878 |
| 19 | P42081 | T-lymphocyte activation antigen CD86 | CD86 | SEQ ID NO: 175 | 383 | 591, 799, 1007, 1215, 1423, 1631, 1839, 2047, 2255, 2463, 2671, 2879 |
| 20 | Q15762 | CD226 antigen | CD226 | SEQ ID NO: 176 | 384 | 592, 800, 1008, 1216, 1424, 1632, 1840, 2048, 2256, 2464, 2672, 2880 |
| 21 | Q685J3 | Mucin-17 | MUC17 | SEQ ID NO: 177 | 385 | 593, 801, 1009, 1217, 1425, 1633, 1841, 2049, 2257, 2465, 2673, 2881 |
| 22 | Q9NNX6 | CD209 | CD209 antigen | SEQ ID NO: 178 | 386 | 594, 802, 1010, 1218, 1426, 1634, 1842, 2050, 2258, 2466, 2674, 2882 |

TABLE 1-continued

IRST$_{epm}$ proteins

| # | UniProt Identifier | Protein Name | Short Name | SEQ ID NO: wt amino acid sequence | SEQ ID NO: wt nucleic acid sequence | SEQ ID NO: optimized nucleic acid sequence |
|---|---|---|---|---|---|---|
| 23 | Q9NR97 | TLR8 | Toll-like receptor 8 | SEQ ID NO: 179 | 387 | 803, 1011, 1219, 1427, 1635, 1843, 2051, 2259, 2467, 2675, 2883, 595 |

According to preferred embodiments, the artificial nucleic acid molecule, preferably RNA, according to the invention may encode in its at least one encoding region at least one IRST$_{epm}$-derived additional amino acid sequence comprising or consisting of an amino acid sequence according to any one of SEQ ID NOs: 157-179, or a (preferably functional) fragment, variant or derivative of any one of said sequences, preferably comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

Accordingly, the coding region of the artificial nucleic acid molecule, preferably RNA, according to the invention may preferably comprise a nucleic acid sequence according to any one of SEQ ID NOs: 365-387, or a (preferably functional) fragment, variant or derivative of any one of said sequences, preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

The term "(nucleic acid sequence/polynucleotide/gene) variant" refers to nucleic acid sequence variants, i.e. nucleic acid sequences or genes comprising a nucleic acid sequence that differs in at least one nucleic acid from a reference (or "parent") nucleic acid sequence of a reference (or "parent") nucleic acid or gene. Variant nucleic acids or genes may thus preferably comprise, in their nucleic acid sequence, at least one mutation, substitution, insertion or deletion as compared to their respective reference sequence. Preferably, the term "variant" as used herein includes naturally occurring variants, and engineered variants of nucleic acid sequences or genes. Therefore, a "variant" as defined herein can be derived from, isolated from, related to, based on or homologous to the reference nucleic acid sequence. "Variants" may preferably have a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, to a nucleic acid sequence of the respective naturally occurring (wild-type) nucleic acid sequence or gene, or a homolog, fragment or derivative thereof.

The term "(nucleic acid sequence/polynucleotide/gene) fragment" refers to a continuous subsequence of the full-length reference (or "parent") nucleic acid sequence or gene. In other words, a "fragment" may typically be a shorter portion of a full-length nucleic acid sequence or gene. Accordingly, a fragment, typically, consists of a sequence that is identical to the corresponding stretch within the full-length nucleic acid sequence or gene. The term includes naturally occurring fragments as well as engineered fragments. A preferred fragment of a sequence in the context of the present invention, consists of a continuous stretch of nucleic acids corresponding to a continuous stretch of entities in the nucleic acid or gene the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) nucleic acid sequence or gene from which the fragment is derived.

A sequence identity indicated with respect to such a fragment preferably refers to the entire nucleic acid sequence or gene. Preferably, a "fragment" may comprise a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, to a reference nucleic acid sequence or gene that it is derived from.

The term "(nucleic acid sequence/polynucleotide/gene) derivative", is generally to be understood as a nucleic acid sequence/polynucleotide/gene that has been modified with respect to a reference (or "parent") nucleic acid sequence/polynucleotide/gene to include a new or additional property or functionality. Derivatives may be modified to comprise desired biological functionalities (e.g. resistance to enzymatic degradation, translation efficacy), manufacturing properties, or pharmacokinetic/pharmacodynamics properties for medical use (e.g. by introducing moieties which confer increased stability, bioavailability, absorption; distribution and/or reduced clearance). Derivatives may be prepared by introducing or removing a nucleic acid sequence or additional moiety that confers a biological property or functionality of interest. Such nucleic acid sequences or additional moieties may be introduced using standard genetic engineering techniques (cf. Sambrook J et al., 2012 (4th ed.), Molecular cloning: a laboratory manual. Cold Spring Harbor Laboratory, Cold Spring Harbor, New York).

A "derivative" may be derived from (and thus optionally include) the naturally occurring (wild-type) nucleic acid sequence/polynucleotide/gene, or a variant or fragment thereof. It will be understood that "(nucleic acid sequence/ polynucleotide/gene) derivatives" may differ (e.g. by way of introduction or removal of (poly-)nucleotides) in their nucleotide sequence from the reference nucleic acid sequence/polynucleotide/gene that they are derived from, and thus may qualify as "variants" as well. However, whereas "(nucleic acid sequence/polynucleotide/gene) variants" are primarily defined in terms of their % sequence identity to a reference nucleotide sequence, "derivatives" are preferably characterized by the presence or absence of a specific biological property or functionality as compared to the reference nucleic acid sequence/polynucleotide/gene. Nevertheless, "(nucleic acid sequence/polynucleotide/gene) derivatives" may preferably comprise or consist of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with the nucleic acid sequence of a reference nucleic acid sequence/polynucleotide/gene, or a variant or fragment thereof.

In the context of the present invention, "(nucleic acid sequence/polynucleotide) derivatives" may particularly include nucleic acid sequence/polynucleotide sequences which have been modified or stabilized as compared to the "parent" or "reference" nucleic acid sequences that they are derived from. It will however be understood that such modified/stabilized nucleic acid sequences/polynucleotides may be defined as "variants" as well.

A "functional" fragment, variant or derivative of said nucleic acid sequences preferably encodes (and thus allows expression of) an $IRST_{epm}$-derived additional amino acid sequence as defined herein.

According to preferred embodiments, the coding region of the artificial nucleic acid molecule, preferably RNA, according to the invention may preferably comprise a nucleic acid sequence according to any one of SEQ ID NOs: 365-387, 573-595, 781-803, 989-1011, 1197-1219, 1613-1635, 1821-1843, 2029-2051, 2237-2259, 2445-2467, 2653-2675, 2861-2883 or a (preferably functional) fragment, variant or derivative of any one of said sequences, preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

It will be understood that the artificial nucleic acid molecule, preferably RNA, according to the invention may encode at least one, or a plurality of at least two (identical or different) $IRST_{epm}$-derived amino acid sequences (cf. "Monocistronic, bi- and multicistronic RNAs").

In general, "identical" sequences (or molecules characterized by said sequences, such as (poly-)peptides or nucleic acid molecules) share 100% sequence identity, whereas "different" sequences (or molecules characterized by said sequences, such as (poly-)peptides or nucleic acid molecules) share a sequence identity of less than 100%, such as 99% or less, 90% or less, 80% or less, 70% or less, 60% or less, 50% or less, 40% or less, 30% or less, 20% or less, 10% or less, 5% or less, or 2% or less.

A particularly preferred $IRST_{epm}$ protein may be CTLA4. The additional amino acid sequence(s) encoded by the at least one coding region of the inventive artificial nucleic acid molecule, preferably RNA, of the invention may be derived from CTLA4.

Accordingly, in preferred embodiments, the artificial nucleic acid molecule, preferably RNA, of the invention may encode in its at least one coding region a CTLA4-derived additional amino acid sequence comprising or consisting of an amino acid sequence according to SEQ ID NO: 169, or a (preferably functional) fragment, variant or derivative thereof, preferably comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to SEQ ID NO: 169.

Preferably, the artificial nucleic acid molecule, preferably RNA, of the invention may thus comprise in its at least one coding region a nucleic acid sequence comprising or consisting of a nucleic acid sequence according to any one of SEQ ID Nos: 377, 585, 793, 1001, 1209, 1417, 1625, 1833, 2041, 2249, 2457, 2665 or 2873, or a (preferably functional) fragment, variant or derivative of any one of said sequences, preferably preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of said sequences.

Transmembrane domain (TMD)

According to preferred embodiments, the at least one $IRST_{epm}$-derived additional amino acid sequence encoded in the at least one coding region of the artificial nucleic acid molecule, preferably RNA, according to the invention, may comprise or consist of an $IRST_{epm}$-derived transmembrane domain. Accordingly, in the artificial nucleic acid molecule, preferably RNA, of the invention, said at least one additional $IRST_{epm}$-derived amino acid sequence may preferably comprise or consist of b. at least one transmembrane domain.

"Transmembrane domains" are membrane-spanning, typically short (less than 50 amino acid) helical or beta-stranded domain protein domains. Transmembrane domains may be determined by experimentally, e.g. by X-ray diffraction, or may be predicted based on sequence similarities or using known prediction tools, such as MHMM, Memsat, Phobius and the hydrophobic moment plot method. Without wishing to be bound by specific theory, it is envisaged that "fast-recycling" $IRST_{epm}$-derived transmembrane domains are advantageously capable of anchoring fused antigenic peptides or proteins to the plasma membrane, where they are recycled and guided to the cellular compartments of MHC I and in particular MHC II processing.

According to preferred embodiments of the invention, the artificial nucleic acid molecule, preferably RNA, of the invention, encodes in its at least one coding region at least one transmembrane domain as indicated in Table 2 below, or a (preferably functional) fragment, variant or derivative of any of said transmembrane domains.

TABLE 2

| | | | | TM domain amino acid position | SEQ ID NO: wt amino acid sequence | SEQ ID NO: wt nucleic acid sequence | SEQ ID NO: optimized nucleic acid sequence |
|---|---|---|---|---|---|---|---|
| # | UniProt Identifier | Short name | Protein names | | | | |

IRST_spm-derived transmembrane domains

| # | UniProt Identifier | Short name | Protein names | TM domain amino acid position | SEQ ID NO: wt amino acid sequence | SEQ ID NO: wt nucleic acid sequence | SEQ ID NO: optimized nucleic acid sequence |
|---|---|---|---|---|---|---|---|
| 24 | P16671 | CD36 | Platelet glycoprotein 4 (Fatty acid translocase) (FAT) (Glycoprotein IIIb) (GPIIIB) (Leukocyte differentiation antigen CD36) (PAS IV) (PAS-4) (Platelet collagen receptor) (Platelet glycoprotein IV) (GPIV) (Thrombospondin receptor) (CD antigen CD36) | 8-29 | SEQ ID NO: 180 | SEQ ID NO: 388 | 596, 804, 1012, 1220, 1428, 1636, 1844, 2052, 2260, 2468, 2676, 2884 |
| 25 | P16671 | CD36 | See #24 | 440-461 | SEQ ID NO: 182 | SEQ ID NO: 390 | 598, 806, 1014, 1222, 1430, 1638, 1846, 2054, 2262, 2470, 2678, 2886 |
| 26 | P32248 | CCR7 | C-C chemokine receptor type 7 (C-C CKR-7) (CC-CKR-7) (CCR-7) (BLR2) (CDw197) (Epstein-Barr virus-induced G-protein coupled receptor 1) (EBI1) (EBV-induced G-protein coupled receptor 1) (MIP-3 beta receptor) (CD antigen CD197) | 60-86 | SEQ ID NO: 181 | SEQ ID NO: 389 | 597, 805, 1013, 1221, 1429, 1637, 1845, 2053, 2261, 2469, 2677, 2885 |
| 27 | P32248 | CCR7 | See #26 | 96-116 | SEQ ID NO: 183 | SEQ ID NO: 391 | 599, 807, 1015, 1223, 1431, 1639, 1847, 2055, 2263, 2471, 2679, 2887 |
| 28 | P32248 | CCR7 | See #26 | 131-152 | SEQ ID NO: 184 | SEQ ID NO: 392 | 600, 808, 1016, 1224, 1432, 1640, 1848, 2056, 2264, 2472, 2680, 2888 |
| 29 | P32248 | CCR7 | See #26 | 171-191 | SEQ ID NO: 185 | SEQ ID NO: 393 | 601, 809, 1017, 1225, 1433, 1641, 1849, 2057, 2265, 2473, 2681, 2889 |
| 30 | P32248 | CCR7 | See #26 | 220-247 | SEQ ID NO: 186 | SEQ ID NO: 394 | 602, 810, 1018, 1226, 1434, 1642, 1850, 2058, 2266, 2474, 2682, 2890 |
| 31 | P32248 | CCR7 | See #26 | 264-289 | SEQ ID NO: 187 | SEQ ID NO: 395 | 603, 811, 1019, 1227, 1435, 1643, 1851, 2059, 2267, 2475, 2683, 2891 |
| 32 | P32248 | CCR7 | See #26 | 314-331 | SEQ ID NO: 188 | SEQ ID NO: 396 | 604, 812, 1020, 1228, 1436, 1644, 1852, 2060, 2268, 2476, 2684, 2892 |
| 33 | A0A5B9 | TRBC2 | T-cell receptor beta-2 chain C region | 146-168 | SEQ ID NO: 189 | SEQ ID NO: 397 | 605, 813, 1021, 1229, 1437, 1645, 1853, 2061, 2269, 2477, 2685, 2893 |
| 34 | B7Z8K6 | TRDC | T-cell receptor delta chain C region | 131-153 | SEQ ID NO: 190 | SEQ ID NO: 398 | 606, 814, 1022, 1230, 1438, 1646, 1854, 2062, 2270, 2478, 2686, 2894 |
| 35 | O00206 | TLR4 | Toll-like receptor 4 (hToll) (CD antigen CD284) | 632-652 | SEQ ID NO: 191 | SEQ ID NO: 399 | 607, 815, 1023, 1231, 1439, 1647, 1855, 2063, 2271, 2479, 2687, 2895 |
| 36 | P01730 | CD4 | T-cell surface glycoprotein CD4 (T-cell surface antigen T4/Leu-3) (CD antigen CD4) | 397-418 | SEQ ID NO: 192 | SEQ ID NO: 400 | 608, 816, 1024, 1232, 1440, 1648, 1856, 2064, 2272, 2480, 2688, 2896 |
| 37 | P01850 | TRBC1 | T-cell receptor beta-1 chain C region | 152-172 | SEQ ID NO: 193 | SEQ ID NO: 401 | 609, 817, 1025, 1233, 1441, 1649, 1857, 2065, 2273, 2481, 2689, 2897 |

TABLE 2-continued

IRST$_{apm}$-derived transmembrane domains

| # | UniProt Identifier | Short name | Protein names | TM domain amino acid position | SEQ ID NO: wt amino acid sequence | SEQ ID NO: wt nucleic acid sequence | SEQ ID NO: optimized nucleic acid sequence |
|---|---|---|---|---|---|---|---|
| 38 | P07766 | CD3E | T-cell surface glycoprotein CD3 epsilon chain (T-cell surface antigen T3/Leu-4 epsilon chain) (CD antigen CD3e) | 127-152 | SEQ ID NO: 194 | SEQ ID NO: 402 | 610, 818, 1026, 1234, 1442, 1650, 1858, 2066, 2274, 2482, 2690, 2898 |
| 39 | P08575 | PTPRC | Receptor-type tyrosine-protein phosphatase C (EC 3.1.3.48) (Leukocyte common antigen) (L-CA) (T200) (CD antigen CD45) | 576-597 | SEQ ID NO: 195 | SEQ ID NO: 403 | 611, 819, 1027, 1235, 1443, 1651, 1859, 2067, 2275, 2483, 2691, 2899 |
| 40 | P08637 | FCG3A | Low affinity immunoglobulin gamma Fc region receptor III-A (CD16a antigen) (Fc-gamma RIII-alpha) (Fc-gamma RIII) (Fc-gamma RIIIa) (FcRIII) (FcRIIIa) (FcR-10) (IgG Fc receptor III-2) (CD antigen CD16a) | 209-229 | SEQ ID NO: 404 196 | | 612, 820, 1028, 1236, 1444, 1652, 1860, 2068, 2276, 2484, 2692, 2900 |
| 41 | P10747 | CD28 | T-cell-specific surface glycoprotein CD28 (TP44) (CD antigen CD28) | 153-179 | SEQ ID NO: 197 | SEQ ID NO: 405 | 613, 821, 1029, 1237, 1445, 1653, 1861, 2069, 2277, 2485, 2693, 2901 |
| 42 | P11912 | CD79A | B-cell antigen receptor complex-associated protein alpha chain (Ig-alpha) (MB-1 membrane glycoprotein) (Membrane-bound immunoglobulin-associated protein) (Surface IgM-associated protein) (CD antigen CD79a) | 144-165 | SEQ ID NO: 198 | SEQ ID NO: 406 | 614, 822, 1030, 1238, 1446, 1654, 1862, 2070, 2278, 2486, 2694, 2902 |
| 43 | P15391 | CD19 | B-lymphocyte antigen CD19 (B-lymphocyte surface antigen B4) (Differentiation antigen CD19) (T-cell surface antigen Leu-12) (CD antigen CD19) | 292-313 | SEQ ID NO: 199 | SEQ ID NO: 407 | 615, 823, 1031, 1239, 1447, 1655, 1863, 2071, 2279, 2487, 2695, 2903 |
| 44 | P16410 | CTLA4 | Cytotoxic T-lymphocyte protein 4 (Cytotoxic T-lymphocyte-associated antigen 4) (CTLA-4) (CD antigen CD152) | 162-182 | SEQ ID NO: 200 | SEQ ID NO: 408 | 616, 824, 1032, 1240, 1448, 1656, 1864, 2072, 2280, 2488, 2696, 2904 |
| 45 | P26718 | NKG2D | NKG2-D type II integral membrane protein (Killer cell lectin-like receptor subfamily K member 1) (NK cell receptor D) (NKG2-D-activating NK receptor) (CD antigen CD314) | 52-72 | SEQ ID NO: 201 | SEQ ID NO: 409 | 617, 825, 1033, 1241, 1449, 1657, 1865, 2073, 2281, 2489, 2697, 2905 |
| 46 | P30273 | FCERG | High affinity immunoglobulin epsilon receptor subunit gamma (Fc receptor gamma-chain) (FcRgamma) (Fc-epsilon RI-gamma) (IgE Fc receptor subunit gamma) (FceRI gamma) | 24-44 | SEQ ID NO: 202 | SEQ ID NO: 410 | 618, 826, 1034, 1242, 1450, 1658, 1866, 2074, 2282, 2490, 2698, 2906 |
| 47 | P40259 | CD79B | B-cell antigen receptor complex-associated protein beta chain (B-cell-specific glycoprotein B29) (Ig-beta) (Immunoglobulin-associated B29 protein) (CD antigen CD79b) | 160-180 | SEQ ID NO: 203 | SEQ ID NO: 411 | 619, 827, 1035, 1243, 1451, 1659, 1867, 2075, 2283, 2491, 2699, 2907 |

TABLE 2-continued

IRST$_{epm}$-derived transmembrane domains

| # | UniProt Identifier | Short name | Protein names | TM domain amino acid position | SEQ ID NO: wt amino acid sequence | SEQ ID NO: wt nucleic acid sequence | SEQ ID NO: optimized nucleic acid sequence |
|---|---|---|---|---|---|---|---|
| 48 | P42081 | CD86 | T-lymphocyte activation antigen CD86 (Activation B7-2 antigen) (B70) (BU63) (CTLA-4 counter-receptor B7.2) (FUN-1) (CD antigen CD86) | 248-268 | SEQ ID NO: 204 | SEQ ID NO: 412 | 620, 828, 1036, 1244, 1452, 1660, 1868, 2076, 2284, 2492, 2700, 2908 |
| 49 | Q15762 | CD226 | CD226 antigen (DNAX accessory molecule 1) (DNAM-1) (CD antigen CD226) | 255-275 | SEQ ID NO: 205 | SEQ ID NO: 413 | 621, 829, 1037, 1245, 1453, 1661, 1869, 2077, 2285, 2493, 2701, 2909 |
| 50 | Q685J3 | MUC17 | Mucin-17 (MUC-17) (Small intestinal mucin-3) (MUC-3) | 4394-4414 | SEQ ID NO: 206 | SEQ ID NO: 414 | 622, 830, 1038, 1246, 1454, 1662, 1870, 2078, 2286, 2494, 2702, 2910 |
| 51 | Q9NNX6 | CD209 | CD209 antigen (C-type lectin domain family 4 member L) (Dendritic cell-specific ICAM-3-grabbing non-integrin 1) (DC-SIGN) (DC-SIGN1) (CD antigen CD209) | 38-58 | SEQ ID NO: 207 | SEQ ID NO: 415 | 623, 831, 1039, 1247, 1455, 1663, 1871, 2079, 2287, 2495, 2703, 2911 |
| 52 | Q9NR97 | TLR8 | Toll-like receptor 8 (CD antigen CD288) | 828-848 | SEQ ID NO: 208 | SEQ ID NO: 416 | 624, 832, 1040, 1248, 1456, 1664, 1872, 2080, 2288, 2496, 2704, 2912 |

According to preferred embodiments, the artificial nucleic acid molecule according to the invention may encode in its at least one encoding region at least one IRST$_{epm}$-derived transmembrane domain comprising or consisting of an amino acid sequence according to any one of SEQ ID NOs: 180-208, or a (preferably functional) fragment, variant or derivative of any one of said sequences, preferably comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

Accordingly, the artificial nucleic acid molecule, preferably RNA, of the invention may preferably comprise in its at least one coding region a nucleic acid sequence according to any one of SEQ ID NOs: 388-416, 596-624, 804-832, 1012-1040, 1220-1248, 1428-1456, 1636-1664, 1844-1872, 2052-2080, 2260-2288, 2468-2496, 2676-2704, 2884-2912, or a (preferably functional) fragment, variant or derivative of any one of said sequences, preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

More preferably, the artificial nucleic acid molecule, preferably RNA, of the invention may encode in its at least one coding region a CTLA4-derived transmembrane domain comprising or consisting of an amino acid sequence according to SEQ ID NO: 200, or a (preferably functional) fragment, variant or derivative thereof, preferably comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to SEQ ID NO: 200.

Preferably, the artificial nucleic acid molecule, preferably RNA, of the invention may thus comprise in its at least one coding region a nucleic acid sequence comprising or consisting of a nucleic acid sequence according to any one of SEQ ID NOs: 408, 616, 824, 1032, 1240, 1448, 1656, 1864, 2072, 2280, 2488, 2696 or 2904, or a (preferably functional) fragment, variant or derivative of any one of said sequences, preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of said sequences.

Cytoplasmic Domain (CD)

According to preferred embodiments, the at least one IRST$_{epm}$-derived additional amino acid sequence encoded in the at least one coding region of the artificial nucleic acid molecule, preferably RNA, according to the invention, may optionally (further) comprise or consist of an IRST$_{epm}$-derived cytoplasmic domain. Accordingly, in the artificial nucleic acid molecule, preferably RNA, of the invention, said at least one additional IRST$_{epm}$-derived amino acid sequence may preferably (further) comprise or consist of c. at least one cytoplasmic domain.

"Cytoplasmic domains" are intracellular domains that typically interact with the interior of the cell. Without wishing to be bound by specific theory, it is envisaged that IRST$_{epm}$-derived cytoplasmic domains may confer further advantageous targeting characteristics to the encoded antigenic peptides or proteins to MHC I and in particular MHC II processing compartments.

Preferably, the IRST$_{epm}$-derived cytoplasmic domain may be present in addition to the IRST$_{epm}$-derived transmembrane domain. The cytoplasmic domain and the transmembrane domain may be derived from identical or different IRST$_{epm}$ proteins. According to some preferred embodiments, the cytoplasmic domain and transmembrane domain are present in one continuous additional IRST$_{epm}$-derived amino acid sequence.

Transmembrane Domain+Cytoplasmic Domain (CD)

According to preferred embodiments, the at least one IRST$_{epm}$-derived additional amino acid sequence encoded in the at least one coding region of the artificial nucleic acid molecule, preferably RNA, according to the invention, may comprise or consist of an IRST$_{epm}$-derived transmembrane domain and an IRST$_{epm}$-derived cytoplasmic domain. Accordingly, in the artificial nucleic acid molecule, preferably RNA, of the invention, said at least one additional IRST$_{epm}$-derived amino acid sequence may preferably comprise or consist of b. at least one transmembrane domain and c. at least one cytoplasmic domain.

TABLE 3

IRST$_{epm}$-derived proteins comprising a transmembrane domain and a cytoplasmatic domain

| # | UniProt Identifier | Short name | TM + Cys domain amino acid position | SEQ ID NO: (AA) | Gene names | SEQ ID NO: wt nucleic acid | SEQ ID NO: optimized nucleic acid |
|---|---|---|---|---|---|---|---|
| 53 | P16671 | CD36 | 440-472 | SEQ ID NO: 76645 | CD36 GP3B GP4 | 76668 | 76691, 76714, 76737, 76760, 76783, 76806, 76829, 76852, 76875, 76898, 76921, 76944 |
| 54 | P32248 | CCR7 | 153-191 | SEQ ID NO: 76646 | CCR7 CMKBR7 EBI1 EVI1 | 76669 | 76692, 76715, 76738, 76761, 76784, 76807, 76830, 76853, 76876, 76899, 76922, 76945 |
| 55 | P32248 | CCR7 | 248-289 | SEQ ID NO: 76647 | CCR7 CMKBR7 EBI1 EVI1 | 76670 | 76693, 76716, 76739, 76762, 76785, 76808, 76831, 76854, 76877, 76900, 76923, 76946 |
| 56 | A0A5B9 | TRBC2 | 145-178 | SEQ ID NO: 76625 | TRBC2 TCRBC2 | 76648 | 76671, 76694, 76717, 76740, 76763, 76786, 76809, 76832, 76855, 76878, 76901, 76924 |
| 57 | B7Z8K6 | TRDC | 131-154 | SEQ ID NO: 76626 | TRDC | 76649 | 76672, 76695, 76718, 76741, 76764, 76787, 76810, 76833, 76856, 76879, 76902, 76925 |
| 58 | O00206 | TLR4 | 632-839 | SEQ ID NO: 76627 | TLR4 | 76650 | 76673, 76696, 76719, 76742, 76765, 76788, 76811, 76834, 76857, 76880, 76903, 76926 |
| 59 | P01730 | CD4 | 397-458 | SEQ ID NO: 76628 | CD4 | 76651 | 76674, 76697, 76720, 76743, 76766, 76789, 76812, 76835, 76858, 76881, 76904, 76927 |
| 60 | P01850 | TRBC1 | 152-178 | SEQ ID NO: 76629 | TRBC1 | 76652 | 76675, 76698, 76721, 76744, 76767, 76790, 76813, 76836, 76859, 76882, 76905, 76928 |

TABLE 3-continued

IRST_opm_-derived proteins comprising a transmembrane domain and a cytoplasmatic domain

| # | UniProt Identifier | Short name | TM + Cys domain amino acid position | SEQ ID NO: (AA) | Gene names | SEQ ID NO: wt nucleic acid | SEQ ID NO: optimized nucleic acid |
|---|---|---|---|---|---|---|---|
| 61 | P07766 | CD3E | 27-207 | SEQ ID NO: 76630 | CD3E T3E | 76653 | 76676, 76699, 76722, 76745, 76768, 76791, 76814, 76837, 76860, 76883, 76906, 76929 |
| 62 | P08575 | PTPRC | 576-1304 | SEQ ID NO: 76631 | PTPRC CD45 | 76654 | 76677, 76700, 76723, 76746, 76769, 76792, 76815, 76838, 76861, 76884, 76907, 76930 |
| 63 | P08637 | FCG3A | 209-254 | SEQ ID NO: 76632 | FCGR3A CD16A FCG3 FCGR3 IGFR3 | 76655 | 76678, 76701, 76724, 76747, 76770, 76793, 76816, 76839, 76862, 76885, 76908, 76931 |
| 64 | P10747 | CD28 | 153-179 | SEQ ID NO: 76633 | CD28 | 76656 | 76679, 76702, 76725, 76748, 76771, 76794, 76817, 76840, 76863, 76886, 76909, 76932 |
| 65 | P11912 | CD79A | 144-226 | SEQ ID NO: 76634 | CD79A IGA MB1 | 76657 | 76680, 76703, 76726, 76749, 76772, 76795, 76818, 76841, 76864, 76887, 76910, 76933 |
| 66 | P15391 | CD19 | 292-556 | SEQ ID NO: 76635 | CD19 | 76658 | 76681, 76704, 76727, 76750, 76773, 76796, 76819, 76842, 76865, 76888, 76911, 76934 |
| 67 | P16410 | CTLA4 | 162-223 | SEQ ID NO: 76636 | CTLA4 CD152 | 76659 | 76682, 76705, 76728, 76751, 76774, 76797, 76820, 76843, 76866, 76889, 76912, 76935, 76947, 77004-77017, 77066 |
| 68 | P26718 | NKG2D | 1-72 | SEQ ID NO: 76637 | KLRK1 D12S2489E NKG2D | 76660 | 76683, 76706, 76729, 76752, 76775, 76798, 76821, 76844, 76867, 76890, 76913, 76936 |
| 69 | P30273 | FCERG | 24-86 | SEQ ID NO: 76638 | FCER1G | 76661 | 76684, 76707, 76730, 76753, 76776, 76799, 76822, 76845, 76868, 76891, 76914, 76937 |
| 70 | P40259 | CD79B | 160-229 | SEQ ID NO: 76639 | CD79B B29 IGB | 76662 | 76685, 76708, 76731, 76754, 76777, 76800, 76823, 76846, 76869, 76892, 76915, 76938 |
| 71 | P42081 | CD86 | 248-329 | SEQ ID NO: 76640 | CD86 CD28LG2 | 76663 | 76686, 76709, 76732, 76755, 76778, 76801, 76824, 76847, 76870, 76893, 76916, 76939 |
| 72 | Q15762 | CD226 | 255-336 | SEQ ID NO: 76641 | CD226 DNAM1 | 76664 | 76687, 76710, 76733, 76756, 76779, 76802, |

TABLE 3-continued

IRST$_{epm}$-derived proteins comprising a transmembrane domain and a cytoplasmatic domain

| # | UniProt Identifier | Short name | TM + Cys domain amino acid position | SEQ ID NO: (AA) | Gene names | SEQ ID NO: wt nucleic acid | SEQ ID NO: optimized nucleic acid |
|---|---|---|---|---|---|---|---|
| 73 | Q685J3 | MUC17 | 4393-4493 | SEQ ID NO: 76642 | MUC17 MUC3 | 76665 | 76825, 76848, 76871, 76894, 76917, 76940 76688, 76711, 76734, 76757, 76780, 76803, 76826, 76849, 76872, 76895, 76918, 76941 |
| 74 | Q9NNX6 | CD209 | 1-58 | SEQ ID NO: 76643 | CD209 CLEC4L | 76666 | 76689, 76712, 76735, 76758, 76781, 76804, 76827, 76850, 76873, 76896, 76919, 76942 |
| 75 | Q9NR97 | TLR8 | 828-1041 | SEQ ID NO: 76644 | TLR8 UNQ249/PRO286 | 76667 | 76690, 76713, 76736, 76759, 76782, 76805, 76828, 76851, 76874, 76897, 76920, 76943 |

According to preferred embodiments, the artificial nucleic acid molecule according to the invention may encode in its at least one coding region at least one IRST$_{epm}$-derived transmembrane domain and at least one cytoplasmic domain comprising or consisting of an amino acid sequence according to any one of SEQ ID NOs: 76625-76647, or a (preferably functional) fragment, variant or derivative of any one of said sequences, preferably comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

Accordingly, the artificial nucleic acid molecule, preferably RNA, of the invention may preferably comprise in its at least one coding region a nucleic acid sequence according to any one of SEQ ID NOs: 76648-76670, 76694-76716, 76717-76739, 76671-76693, 77004-770017, 76763-76785, 76786-76808, 76809-76831, 76832-76854, 76855-76877, 76878-76900, 76901-76923, 76924-76946, 76947, 76740-76762, 77066, or a (preferably functional) fragment, variant or derivative of any one of said sequences, preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

More preferably, the artificial nucleic acid molecule, preferably RNA, of the invention may encode in its at least one coding region a CTLA4-derived transmembrane domain and cytoplasmic domain comprising or consisting of an amino acid sequence according to SEQ ID NO: 76636, or a (preferably functional) fragment, variant or derivative thereof, preferably comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to SEQ ID NO: 76636.

Preferably, the artificial nucleic acid molecule, preferably RNA, of the invention may thus comprise in its at least one coding region a nucleic acid sequence comprising or consisting of a nucleic acid sequence according to any one of SEQ ID NOs: 76659, 76705, 76728, 76682, 77004-77017, 76774, 76797, 76820, 76843, 76866, 76912, 76889, 76935, 76947, 76751, 77066 or a (preferably functional) fragment, variant or derivative of any one of said sequences, preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of said sequences.

The nucleic acid sequence of the RNA of the invention may be adapted in a manner to allow differentiation of different RNA species in a composition comprising more than one RNA species. Preferably, the nucleic acid sequence of the RNA is adapted without introducing changes in the amino acid sequence encoded by the respective RNA. Preferably, the nucleic acid sequence of the RNA is adapted in a stretch of 10-200 nucleotides to allow differentiation of different RNA species via PCR based analytical methods. Said adapted sequence stretch(es) may be positioned in an untranslated region (UTR), in the coding sequence of a signal peptide, in the coding sequence of the epitope, in a linker region, in the coding sequence of a helper epitope, in the CTLA4 transmembrane region, in the CTLA4 cytoplasmatic region, in the CTLA4 transmembrane and cytoplasmatic region. Preferably, adapted sequence stretches allowing differentiation of different RNA species in a composition are introduced in the CTLA4 transmembrane and cytoplasmatic region. As a non-limiting example, a composition comprising two different RNA species, wherein the adapted sequence stretches allowing for differentiation is in the CTLA4 transmembrane and cytoplasmatic region (for example SEQ ID NO: 77004 and SEQ ID NO: 77005). As a further non-limiting example, a composition comprising three different RNA species, wherein the adapted sequence stretches allowing for differentiation is in the CTLA4 transmembrane and cytoplasmatic region (for example SEQ ID NO: 77004, SEQ ID NO: 77005 and SEQ ID NO: 77006). As a further non-limiting example, a composition comprising thirteen different RNA species, wherein the adapted sequence stretches allowing for differentiation is in the CTLA4 transmembrane and cytoplasmatic region (for example SEQ ID NO: 77004-SEQ ID NO: 77017).

Antigenic Peptide or Protein (AN)

The artificial nuclei acid molecule, preferably RNA, according to the invention encodes, in its at least one coding region, a. at least one antigenic peptide or protein. According to preferred embodiments, the nucleic acid sequence encoding said at least one antigenic peptide or protein may be fused (in frame) to a nucleic acid sequence encoding the at least one $IRST_{epm}$-derived amino acid sequence. Therefore, expression of the artificial nucleic acid molecule, preferably RNA, of the invention may preferably result in a fusion protein comprising the at least one antigenic protein or peptide joined to (optionally via appropriate linkers) the at least one $IRST_{epm}$-derived additional amino acid sequence. Said additional amino acid sequence preferably directs the antigenic peptide or protein to MHC class I and more preferably MHC class II processing compartments, resulting in enhanced MHC class I and/or preferably MHC class II presentation. Generally, the present invention envisages the combination of any of the antigenic peptides or proteins described herein with any of the $IRST_{epm}$-derived additional amino acid sequences, any of the linkers, and any of the signal peptides described herein, in any suitable order, in the antigenic fusion proteins encoded by the artificial nucleic acid molecules, preferably RNAs, of the invention.

The term "antigenic peptide or protein" generally refers to any peptide or protein capable, under appropriate conditions, of interacting with/being recognized by components of the immune system (such as antibodies or immune cells). The "antigenic peptide or protein" preferably interacts with/is recognized by the components of the immune system via its "epitope(s)" or "antigenic determinant(s)". Thus, the term "antigenic peptide or protein" refers to a (poly-)peptide comprising, consisting of or being capable of providing at least one (functional) epitope. It is particularly envisaged that the artificial nucleic acid molecules, preferably RNAs, of the invention encode full-length antigenic peptides or proteins, or preferably fragmenst thereof. Said fragment may comprise or consist of (functional) epitopes of said antigenic peptides or proteins. Preferably, said fragments or epitopes are expressed in the host cell, directed to MHC class I and preferably MHC class II processing compartments, and recognized by components of the immune system.

The term "components of the immune system" preferably refers to immune cells, immune cell receptors and antibodies of the adaptive immune system. "Antigenic peptides or proteins" are preferably capable of being processed by the intracellular machinery to be presented to immune cells on an MHC molecule, preferably resulting in an antigen-specific immune response (e.g. cell-mediated immunity or formation of antibodies). "Antigenic peptides or proteins" may be the product of translation of an artificial nucleic acid molecule, preferably RNA, of the invention.

The term "epitope" or "antigenic determinant" refers to a part or fragment of an antigenic peptide or protein that is recognized by the immune system. Said fragment may typically comprise from about 5 to about 20 or even more amino acids. Epitopes may be "conformational" (or "discontinuous"), i.e. composed of discontinuous sequences of the amino acids of the antigenic peptide or protein that they are derived from, but brought together in the three-dimensional structure of e.g. a MHC-complex, or "linear", i.e. consist of a continuous sequence of amino acids of the antigenic peptides or proteins that they are derived from. The term "epitope" generally encompasses "T cell epitopes" (recognized by T cells via their T cell receptor) and "B cell epitopes" (recognized by B cells via their B cell receptor). "B cell epitopes" are typically located on the outer surface of (native) protein or peptide antigens as defined herein, and may preferably comprise or consist of between 5 to 15 amino acids, more preferably between 5 to 12 amino acids, even more preferably between 6 to 9 amino acids. "T cell epitopes" are typically recognized by T cells in a MHC-I or MHC-II bound form, i.e. as a complex formed by an antigenic protein or peptide fragment comprising the epitope, and a MHC-I or MHC-II surface molecule. "T cell epitopes" may typically have a length of about 6 to about 20 or even more amino acids, T cell epitopes presented by MHC class I molecules may preferably have a length of about 8 to about 10 amino acids, e.g. 8, 9, or 10, (or even 11, or 12 amino acids). T cell epitopes presented by MHC class II molecules may preferably have a length of about 13 or more amino acids, e.g. 13, 14, 15, 16, 17, 18, 19, 20, 21, 22, 23, 24, 25, 26, 27, 28, 29, 30 or even more amino acids. In the context of the present invention, the term "epitope" may in particular refer to T cell epitopes.

When referring to an artificial nucleic acid molecule, preferably RNA, encoding "at least one antigenic peptide or protein" herein, it is envisaged that said artificial nucleic acid molecule may encode one or more full-length (wild-type/variant/derivative) antigenic peptide(s) or protein(s), or one or more fragment(s), in particular a (functional) epitope (s), of said (wild-type/variant/derivative) antigenic peptide or protein. Said full-length (wild-type/variant/derivative) antigenic peptide(s) or protein(s), or its fragment(s), preferably comprises, consists of or provides at least one (functional) epitope, i.e. said (wild-type/variant/derivative) antigenic peptide(s) or protein(s) or its fragment(s) preferably either comprise(s) or consist(s) of a native epitope (preferably recognized by B cells) or is capable of being processed and presented by an MHC-I or MHC-II molecule to provide a MHC-bound epitope (preferably recognized by T cells). A "functional" epitope refers to an epitope capable of inducing a desired adaptive immune response in a subject.

The at least one antigenic peptide or protein encoded by the artificial nucleic acid molecule, preferably RNA, of the invention may be N-terminally, C-terminally or intrasequentially fused to or comprised by the at least one $IRST_{epm}$-derived amino acid sequence, optionally via appropriate peptide linkers (providing an "antigenic fusion protein" as defined herein). Thus, it is inter alia envisaged herein that the artificial nucleic acid molecule, preferably RNA, of the invention encodes an $IRST_{epm}$-derived amino acid sequence as defined herein, which comprises an antigenic peptide or protein, or yields a functional epitope, as defined herein.

The choice of appropriate antigenic peptides or proteins generally depends on the condition or disease to be treated or prevented. In general, the artificial nucleic acid molecule, preferably RNA, may encode any antigenic peptide or protein (or any desired combination of antigenic peptides or proteins) in its at least one coding region. It is also envisaged herein to provide artificial nucleic acid molecules, preferably RNAs, encoding a plurality of any combination of at least 2, 3, 4, 5, 6, 7, 8, 9 or 10 or more (identical or different) antigenic peptides or proteins, preferably as defined herein (see e.g. polyvalent vaccines).

Preferred antigenic peptides and proteins are specified below.

Antigenic Peptides or Proteins Derived from Tumor Antigens

According to preferred embodiments, the artificial nucleic acid molecule, preferably RNA, according to the invention encodes, in its at least one coding region, at least one antigenic peptide or protein derived from a tumor antigen.

The term "tumor antigen" refers to antigens derived from or associated with a (preferably malignant) tumor or a cancer disease. As used herein, the terms "cancer" and "tumor" are used interchangeably to refer to a neoplasm characterized by the uncontrolled and usually rapid proliferation of cells that tend to invade surrounding tissue and to metastasize to distant body sites. The term encompasses benign and malignant neoplasms. Malignancy in cancers is typically characterized by anaplasia, invasiveness, and metastasis; whereas benign malignancies typically have none of those properties. The terms "cancer" and "tumor" in particular refer to neoplasms characterized by tumor growth, but also to cancers of blood and lymphatic system. A "tumor antigen" is typically derived from a tumor/cancer cell, preferably a mammalian tumor/cancer cell, and may be located in or on the surface of a tumor cell derived from a mammalian, preferably from a human, tumor, such as a systemic or a solid tumor. "Tumor antigens" generally include tumor-specific antigens (TSAs) and tumor-associated-antigens (TAAs). TSAs may only be presented by tumor cells and not by normal "healthy" cells. They typically result from a tumor specific mutation. TAAs, which are more common, are usually presented by both tumor and healthy cells. These antigens are recognized and the antigen-presenting cell can be destroyed by cytotoxic T cells. Additionally, tumor antigens can also occur on the surface of the tumor in the form of, e.g., a mutated receptor. In this case, they can be recognized by antibodies.

Preferably, the at least one antigenic peptide or protein encoded by the at least one coding region of the artificial nucleic acid molecule, preferably RNA, of the invention, may be derived from Melanoma antigen recognized by T-cells 1, Eukaryotic translation initiation factor 4 gamma 1, Histone H1.2, Cyclin-dependent kinase 4, 40S ribosomal protein S21, DNA replication licensing factor MCM4, Actin, gamma-enteric smooth muscle, Melanocyte protein PMEL, Phospholipid transfer protein, Vimentin, Eukaryotic translation initiation factor 3 subunit D, Melanoma-associated antigen 1, Fructose-bisphosphate aldolase A, Guanine nucleotide-binding protein G(I)/G(S)/G(T) subunit beta-2, ER membrane protein complex subunit 7, Actin, cytoplasmic 1, High mobility group protein B1, Coiled-coil-helix-coiled-coil-helix domain-containing protein 2, HLA class II histocompatibility antigen, DP beta 1 chain, 60S ribosomal protein L13, Thymosin beta-10, Guanine nucleotide-binding protein G(s) subunit alpha isoforms short, Guanine nucleotide-binding protein subunit beta-2-like 1, Bax inhibitor 1, Wilms tumor protein, Gamma-secretase C-terminal fragment 59, Thymidylate synthase, 60S ribosomal protein L10, Lys-63-specific deubiquitinase BRCC36, Myelin basic protein, HLA class I histocompatibility antigen, A-2 alpha chain, Ragulator complex protein LAMTOR5, 40S ribosomal protein S25, POTE ankyrin domain family member F, Mortality factor 4-like protein 1, Melanoma-associated antigen 3, Heme oxygenase 1, G2/mitotic-specific cyclin-B1, Proteasome subunit alpha type-5, Protein THEMIS2, Fatty acid synthase, Mammaglobin-A, Actin-related protein 2, 60S ribosomal protein L28, 60S acidic ribosomal protein P0, Cellular tumor antigen p53, Proteasome subunit beta type-3, DNA (cytosine-5)-methyltransferase 1, Catenin beta-1, Myosin-9, Reticulocalbin-2, Heterogeneous nuclear ribonucleoprotein A1, 60S ribosomal protein L8, Ribonucleoside-diphosphate reductase subunit M2, Melanoma-associated antigen B2, Protein SSX2, Proliferating cell nuclear antigen, Receptor tyrosine-protein kinase erbB-2, Heat shock protein HSP 90-beta, Ornithine decarboxylase, Ubiquitin-conjugating enzyme E2 E3, 60S ribosomal protein L19, Small nuclear ribonucleoprotein-associated proteins B and B', Elongation factor 2, Putative small nuclear ribonucleoprotein G-like protein 15, Serine-tRNA ligase, cytoplasmic, Beta-2-microglobulin, ADP/ATP translocase 2, Acyl-CoA desaturase, Ubiquitin-60S ribosomal protein L40, Prelamin-A/C, Heat shock cognate 71 kDa protein, Melanoma-associated antigen 2, Beta-adrenergic receptor kinase 1, Farnesyl pyrophosphate synthase, 40S ribosomal protein S8, Glutamate carboxypeptidase 2, Serine/threonine-protein phosphatase PP1-beta catalytic subunit, ATP-binding cassette sub-family F member 2, Gamma-interferon-inducible lysosomal thiol reductase, Stress-70 protein, mitochondrial, Mucin-1, Rac GTPase-activating protein 1, HLA class I histocompatibility antigen, B-39 alpha chain, 40S ribosomal protein S16, Tyrosinase, HLA class I histocompatibility antigen, alpha chain E, Bifunctional purine biosynthesis protein PURH, Transferrin receptor protein 1, ELAV-like protein 1, U1 small nuclear ribonucleoprotein A, Heat shock 70 kDa protein 1-like, HLA class II histocompatibility antigen, DR alpha chain, T-complex protein 1 subunit alpha, Carcinoembryonic antigen-related cell adhesion molecule 5, Histone H2AX, Lamin-B1, 60S acidic ribosomal protein P2, Actin, cytoplasmic 2, B-lymphocyte antigen CD20, Actin, aortic smooth muscle, Probable global transcription activator SNF2L2, Myotubularin-related protein 5, Proteasome subunit beta type-1, 60S ribosomal protein L7a, Histone H3.3, 60S ribosomal protein L24, 40S ribosomal protein S3, HLA class I histocompatibility antigen, Cw-7 alpha chain, HLA class I histocompatibility antigen, B-15 alpha chain, Serine/threonine-protein kinase Sgk1, Serine/threonine-protein phosphatase PP1-alpha catalytic subunit, Heterogeneous nuclear ribonucleoprotein K, L-dopachrome tautomerase, Protein flightless-1 homolog, Dual specificity protein phosphatase 5, TSC22 domain family protein 3, Cancer/testis antigen 1, Serine/threonine-protein phosphatase 2A 65 kDa regulatory subunit A alpha isoform, Protein transport protein Sec23B, Protein transport protein Sec23A, CD59 glycoprotein, Collagen alpha-5(IV) chain, AT-rich interactive domain-containing protein 3A, Polypyrimidine tract-binding protein 1, Spermine synthase, Glutamine-fructose-6-phosphate aminotransferase [isomerizing] 1, Eukaryotic translation initiation factor 3 subunit L, Protein BTG2, DNA-directed RNA polymerase II subunit RPB1, Myeloblastin, HLA class I histocompatibility antigen, Cw-3 alpha chain, Importin subunit alpha-5, rRNA 2'-O-methyltransferase fibrillarin, Cyclin-A2, Probable ATP-dependent RNA helicase DDX5, Cytochrome c oxidase subunit 2, IST1 homolog, 60S ribosomal protein L35, Triosephosphate isomerase, Sorting nexin-5, Melanoma-associated antigen 4, Ubiquilin-4, HLA class I histocompatibility antigen, Cw-2 alpha chain, Interferon-induced transmembrane protein 1, Amyloid beta A4 protein, Heat shock 70 kDa protein 1B, HLA class I histocompatibility antigen, A-1 alpha chain, G antigen 12H, Transaldolase, Putative pre-mRNA-splicing factor ATP-dependent RNA helicase DHX16, 14-3-3 protein gamma, Serine/threonine-protein kinase SMG1, Cyclin-L1, Glyceraldehyde-3-phosphate dehydrogenase, Elongation of very long chain fatty acids protein 1, Microtubule-associated protein RP/EB family member 2, T-complex protein 1 subunit epsilon, Sphingolipid delta(4)-desaturase DES1, Elongation of very long chain fatty acids protein 5, ORM1-like protein 2, Baculoviral IAP repeat-containing protein 7, E3 ubiquitin-protein ligase TRIM68, Putative HTLV-1-related endogenous sequence, Myelin proteolipid protein, SAM and SH3 domain-containing protein 1, E3 ubiquitin-protein ligase SIAH1, Muscleblind-like protein 2, Annexin A1, Nuclear ubiquitous casein and cyclin-dependent kinase substrate 1, Pleiotropic regulator 1, NADH dehydrogenase [ubiquinone] 1 alpha subcomplex subunit 3, CD99 antigen, Guanine nucleotide-binding protein G(o) subunit alpha, Calsyntenin-1, GPI transamidase component PIG-T, Perilipin-3, WD40 repeat-containing protein SMU1, Protein S100-B, Annexin A11, Histone H2B type 2-F, Calmodulin, Phosphoinositide-3-kinase-interacting protein 1, THO complex subunit 4, Neuroblast differentiation-associated protein AHNAK, Phosphoserine aminotransferase, Histone deacetylase 7, Gelsolin, Tight junction protein ZO-1, NADH dehydrogenase [ubiquinone] iron-sulfur protein 7, mitochondrial, LIM domain transcription factor LMO4, Spectrin beta chain, non-erythrocytic 1, NADH dehydrogenase [ubiquinone] 1 subunit C2, Testican-2, Alpha-adducin, V-type proton ATPase subunit F, 40S ribosomal protein SA, Bcl-2-associated transcription factor 1, ATP synthase-coupling factor 6, mitochondrial, Phosphatidylethanolamine-binding protein 1, 40S ribosomal protein S29, Septin-2, Methyl-CpG-binding domain protein 3, Transformation/transcription domain-associated protein, Transcription factor HES-1, Paralemmin-2, Sodium/potassium-transporting ATPase subunit alpha-3, Stathmin, Heterogeneous nuclear ribonucleoprotein L-like, Nodal modulator 3, Interferon-induced GTP-binding protein Mx2, Neuronal membrane glycoprotein M6-b, Contactin-1, Cytosolic non-specific dipeptidase, Noelin-2, Serine/threonine-protein kinase DCLK1, U2 small nuclear ribonucleoprotein B, Nuclear autoantigenic sperm protein, 60S ribosomal protein L5, Endoplasmic reticulum-Golgi intermediate compartment protein 1, Programmed cell death protein 4, Endoplasmin, Eukaryotic translation initiation factor 3 subunit F, Cofilin-1, Pyruvate kinase PKM, Dolichyl-diphosphooligosaccharide-protein glycosyltransferase subunit STT3A, 5'(3')-deoxyribonucleotidase, cytosolic type, CKLF-like MARVEL transmembrane domain-containing protein 6, Cleavage and polyadenylation specificity factor subunit 1, Neutral amino acid transporter B(0), Protein PRRC1, Probable ATP-dependent RNA helicase DDX49, Nuclear pore complex protein Nup160, ATP synthase subunit beta, mitochondrial, Signal peptidase complex subunit 2, Protein kinase C iota type, Histone acetyltransferase p300, Histone H2A type 1-A, Small nuclear ribonucleoprotein G, Nucleosome assembly protein 1-like 1, 40S ribosomal protein S11, Structural maintenance of chromosomes protein 3, Centrin-2, GTP-binding nuclear protein Ran, 40S ribosomal protein S3a, ATP-dependent RNA helicase A, T-complex protein 1 subunit eta, Proteasome-associated protein ECM29 homolog, GPN-loop GTPase 1, 60S ribosomal protein L10a, Heterogeneous nuclear ribonucleoproteins C1/C2, Hydroxymethylglutaryl-CoA synthase, cytoplasmic, Sterol O-acyltransferase 1, Tuberin, Eukaryotic translation elongation factor 1 epsilon-1, Phosphoinositide 3-kinase regulatory subunit 4, Annexin A2, U2 small nuclear ribonucleoprotein A', Serine/threonine-protein kinase SIK1, Nucleolin, L-lactate dehydrogenase B chain, L-lactate dehydrogenase A chain, Aladin, Microtubule-associated protein 4, Peroxiredoxin-5, mitochondrial, HLA class I histocompatibility antigen, B-7 alpha chain, Carbamoyl-phosphate synthase [ammonia], mitochondrial, Coiled-coil domain-containing protein 12, Kinectin, Keratin, type I cytoskeletal 18, 40S ribosomal protein S5, Nucleosome assembly protein 1-like 4, U4/U6 small nuclear ribonucleoprotein Prp31, ELAV-like protein 3, Minor histocompatibility protein HA-1, Low affinity immunoglobulin epsilon Fc receptor, 26S proteasome non-ATPase regulatory subunit 2, ATP-dependent RNA helicase DDX3X, Putative homeodomain transcription factor 2, Transcription factor BTF3, Ribosome biogenesis protein BRX1 homolog, HLA class I histocompatibility antigen, B-8 alpha chain, Dynamin-2, ELAV-like protein 4, ATP-dependent RNA helicase DDX3Y, Histone demethylase UTY, Pumilio homolog 3, Histone H4, Histone H3.2, Protein S100-A9, Macrophage migration inhibitory factor, Hemoglobin subunit alpha, 40S ribosomal protein S17, Collagen alpha-1(I) chain, Collagen alpha-2(I) chain, T-complex protein 1 subunit theta, Cullin-1, DNA replication licensing factor MCM7, BolA-like protein 2, DNA topoisomerase 2-beta, Proteasome subunit alpha type-4, Bifunctional glutamate/proline-tRNA ligase, Sodium/potassium-transporting ATPase subunit alpha-1, MICOS complex subunit MIC60, Peptidyl-prolyl cis-trans isomerase A, NADH dehydrogenase [ubiquinone] 1 beta subcomplex subunit 7, Zinc finger MYM-type protein 2, Transforming protein RhoA, Putative endoplasmin-like protein, Plasminogen activator inhibitor 1 RNA-binding protein, Uncharacterized protein C20orf24, Importin subunit beta-1, Melanoma-associated antigen D2, Protein Spindly, Coatomer subunit epsilon, Targeting protein for Xklp2, H/ACA ribonucleoprotein complex subunit 4, H/ACA ribonucleoprotein complex subunit 3, Cerebellar degeneration-related protein 2, Exocyst complex component 2, 1-phosphatidylinositol 3-phosphate 5-kinase, Proteasome activator complex subunit 3, Nuclear pore complex protein Nup205, Neurogenic locus notch homolog protein 1, Lysosomal protective protein, Serine/threonine-protein kinase 38-like, Alpha-1B-glycoprotein, Neuropilin-2, Calreticulin, Filamin-A, Syntenin-1, Cathepsin D, HLA class I histocompatibility antigen, B-51 alpha chain, Profilin-1, Lymphocyte-specific protein 1, Synemin, Insulin receptor substrate 2, ETS translocation variant 5, E3 ubiquitin-protein ligase Mdm2, U1 small nuclear ribonucleoprotein 70 kDa, Coatomer subunit gamma-1, T-complex protein 1 subunit gamma, DCN1-like protein 1, U3 small nucleolar ribonucleoprotein protein IMP3, Phosphoglycerate kinase 1, Diphthamide biosynthesis protein 1, Methionine aminopeptidase 2, Dipeptidyl peptidase 9, Chloride intracellular channel protein 4, 3-hydroxy-3-methylglutaryl-coenzyme A reductase, Acyl-protein thioesterase 2, 26S proteasome non-ATPase regulatory subunit 14, Golgi-specific brefeldin A-resistance guanine nucleotide exchange factor 1, E3 ubiquitin-protein ligase BRE1A, Abl interactor 2, Nuclear pore complex protein Nup88, Thioredoxin-like protein 4A, Transmembrane emp24 domain-containing protein 2, Glycogen phosphorylase, muscle form, Junction plakoglobin, Dolichyl-diphosphooligosaccharide-protein glycosyltransferase subunit 2, Putative eukaryotic translation initiation factor 2 subunit 3-like protein, Serine/threonine-protein kinase/endoribonuclease IRE1, Interferon-induced GTP-binding protein Mx1, Mitotic spindle-associated MMXD complex subunit MIP18, Sulfiredoxin-1, Nucleolar GTP-binding protein 1, 10 kDa heat shock protein, mitochondrial, Anoctamin-6, Nucleolar pre-ribosomal-associated protein 1, RNA-binding protein 34, S-adenosylmethionine synthase isoform type-2, Transmembrane protein 209, HLA class I histocompatibility antigen, B-13 alpha chain, Ubiquitin carboxyl-terminal hydrolase 11, Ataxin-10, Vacuolar protein sorting-associated protein 13B, Suppressor of SWI41 homolog, Golgin subfamily A member 7, Stomatin-like protein 2, mitochondrial, Nuclear pore complex protein Nup107, N-alpha-acetyltransferase 10, Cytochrome c oxidase subunit 6B1, General transcription factor II-1 repeat domain-containing protein 2B, Heterogeneous nuclear ribonucleoprotein A0, Condensin complex subunit 3, Regulation of nuclear pre-mRNA domain-containing protein 1A, Helicase SRCAP, Spartin, Uncharacterized protein ZMYM6NB, CLIP-associating protein 1, Alpha-actinin-4, Nucleolar protein 58, Serine/threonine-protein kinase Kist, Transcription factor Sp2, Apolipoprotein L1, Tankyrase-2, Uncharacterized protein C19orf43, Heat shock protein HSP 90-alpha, X-ray repair cross-complementing protein 5, Nucleolar protein 7, U5 small nuclear ribonucleoprotein 200 kDa helicase, 15 kDa selenoprotein, Ribosomal RNA processing protein 1 homolog B, 116 kDa U5 small nuclear ribonucleoprotein component, Paraneoplastic antigen Ma1, Retinoic acid-induced protein 1, ADP-ribosylation factor GTPase-activating protein 2, Nucleolar protein 56, RNA-binding protein 14, Eukaryotic initiation factor 4A-1, Septin-7, Protein polybromo-1, Annexin A4, Centromere protein F, 60S ribosomal protein L22-like 1, Histone H2B type 1-A, ADP-dependent glucokinase, Heterogeneous nuclear ribonucleoprotein U, High affinity cAMP-specific 3',5'-cyclic phosphodiesterase 7A, E3 ubiquitin-protein ligase UBR2, m7GpppX diphosphatase, Microtubule-actin cross-linking factor 1, isoforms 1/2/3/5, YTH domain-containing protein 1, Eukaryotic translation initiation factor 5A-1, Activating transcription factor 7-interacting protein 1, Transmembrane protein 258, U3 small nucleolar RNA-associated protein 6 homolog, Nucleolar RNA helicase 2, DNA-directed RNA polymerase II subunit RPB7, RRP12-like protein, 26S protease regulatory subunit 6B, 26S protease regulatory subunit 7, 26S protease regulatory subunit 4, Nucleolar protein 11, Prothymosin alpha, Vezatin, Protein AF-10, Negative elongation factor C/D, Transcription factor E2F1, RNA-binding protein 6, Eukaryotic translation initiation factor 4 gamma 3, Next to BRCA1 gene 1 protein, Mitochondrial import receptor subunit TOM7 homolog, Heterogeneous nuclear ribonucleoprotein U-like protein 1, Poly [ADP-ribose] polymerase 1, Eukaryotic translation initiation factor 3 subunit C, Condensin-2 complex subunit G2, Signal transducer and activator of transcription 1-alpha/beta, Signal transducer and activator of transcription 3, Ataxin-2-like protein, G patch domain-containing protein 4, Golgi resident protein GCP60, AP-1 complex subunit sigma-3, Cleavage stimulation factor subunit 3, ATP-dependent RNA helicase DDX24, Mediator of RNA polymerase II transcription subunit 23, Sorting and assembly machinery component 50 homolog, Protein LAP2, Spectrin beta chain, erythrocytic, E3 ubiquitin-protein ligase RBBP6, 40S ribosomal protein S18, Keratinocyte-associated protein 2, Dolichyl-diphosphooligosaccharide-protein glycosyltransferase subunit DAD1, Minor histocompatibility antigen H13, Catenin alpha-2, TBC1 domain family member 31, Poly [ADP-ribose] polymerase 4, Basic leucine zipper and W2 domain-containing protein 1, Neutral alpha-glucosidase AB, RuvB-like 2, Protein MCM10 homolog, Plexin-C1, DNA repair protein XRCC1, Protein AATF, Short transient receptor potential channel 4-associated protein, Cell cycle progression protein 1, Dihydrofolate reductase, mitochondrial, Splicing factor 3A subunit 3, RNMT-activating mini protein, Coatomer subunit delta, Coatomer subunit alpha, Mothers against decapentaplegic homolog 9, Ubiquitin-like protein FUBI, Lysine-tRNA ligase, Cytochrome c oxidase subunit 6A1, mitochondrial, Polycomb protein SUZ12, SNARE-associated protein Snapin, Signal recognition particle 54 kDa protein, Probable JmjC domain-containing histone demethylation protein 2C, Putative ATP-dependent RNA helicase DDX11-like protein 8, General transcription factor 3C polypeptide 1, Tonsoku-like protein, Nuclear pore complex protein Nup214, ATP-dependent 6-phosphofructokinase, platelet type, Alpha-endosulfine, 60S ribosomal protein L26, DNA mismatch repair protein Msh2, Chromodomain-helicase-DNA-binding protein 8, Cell division cycle protein 27 homolog, Transmembrane protein 43, Clathrin heavy chain 1, Disintegrin and metalloproteinase domain-containing protein 10, Protein CASP, Gem-associated protein 5, Ribosomal biogenesis protein LAS1L, WD repeat-containing protein 34, DnaJ homolog subfamily B member 4, Tyrosine-protein kinase Fyn, Activating signal cointegrator 1, Putative mitochondrial import inner membrane translocase subunit Tim23B, Peroxisomal acyl-coenzyme A oxidase 1, HLA class II histocompatibility antigen, DO alpha chain, Poly [ADP-ribose] polymerase 14, Mediator of RNA polymerase II transcription subunit 18, 60S ribosomal protein L7, Zinc finger protein 548, Protein FAM32A, Heat shock protein HSP 90-alpha A2, Myc-associated zinc finger protein, Heterogeneous nuclear ribonucleoproteins A2/B1, V-type proton ATPase 116 kDa subunit a isoform 4, Zinc finger protein 770, Protein SSXT, Zinc finger and BTB domain-containing protein 43, Signal transducing adapter molecule 2, Cirhin, DTW domain-containing protein 1, Bone morphogenetic protein receptor type-2, Dedicator of cytokinesis protein 7, SUMO-activating enzyme subunit 1, Superkiller viralicidic activity 2-like 2, 60S ribosomal protein L15, Transcription elongation factor SPT6, 60S ribosomal protein L18a, Catalase, Tuftelin-interacting protein 11, Hepatoma-derived growth factor-related protein 2, Putative annexin A2-like protein, Protein transport protein Sec16A, Transcription elongation factor SPT5, Splicing factor 3B subunit 4, Serine/threonine-protein kinase 17B, Pre-mRNA-splicing factor CWC22 homolog, Serine/threonine-protein kinase mTOR, E3 ubiquitin-protein ligase RNF213, RNA polymerase I-specific transcription initiation factor RRN3, Nuclear receptor corepressor 2, HLA class II histocompatibility antigen, DQ alpha 1 chain, Nuclear pore membrane glycoprotein 210, NADH dehydrogenase [ubiquinone] 1 beta subcomplex subunit 10, Lysine-specific histone demethylase 1A, Thioredoxin-interacting protein, 60S ribosomal protein L27, Putative elongation factor 1-alpha-like 3, Long-chain-fatty-acid-CoA ligase 4, Signal recognition particle receptor subunit alpha, Embryonic stem cell-specific 5-hydroxymethylcytosine-binding protein, DNA-directed RNA polymerases I, II, and III subunit RPABC5, Dystonin, 60S ribosomal protein L23a, ATP-citrate synthase, Protein quaking, Homocysteine-responsive endoplasmic reticulum-resident ubiquitin-like domain member 1 protein, Transducin-like enhancer protein 2, Gamma-interferon-inducible protein 16, Cytoplasmic dynein 1 heavy chain 1, Staphylococcal nuclease domain-containing protein 1, Thioredoxin, Ribonucleoside-diphosphate reductase large subunit, Lamin-B receptor, Asparagine synthetase [glutamine-hydrolyzing], Heterogeneous nuclear ribonucleoprotein L, Caprin-1, DNA-dependent protein kinase catalytic subunit, RAC-beta serine/threonine-protein kinase, Replication factor C subunit 1, Pre-mRNA-processing factor 40 homolog A, Helicase-like transcription factor, Pre-mRNA-splicing factor RBM22, Kinesin-like protein KIF18A, Vacuolar protein sorting-associated protein 13A, Raftlin, Coiled-coil domain-containing protein 94, Signal-induced proliferation-associated 1-like protein 2, Pre-mRNA-processing-splicing factor 8, Serine/arginine-rich splicing factor 3, T-complex protein 1 subunit zeta-2, Periphilin-1, Metastasis-associated protein MTA2, Spatacsin, Heterogeneous nuclear ribonucleoprotein A/B, Protein RRP5 homolog, 60 kDa heat shock protein, mitochondrial, Protein transport protein Sec61 subunit beta, 40S ribosomal protein S19, Protein DEK, Cyclin-dependent kinases regulatory subunit 2, Protein disulfide-isomerase A3, Heterogeneous nuclear ribonucleoprotein R, Lamina-associated polypeptide 2, isoform alpha, ATP synthase F(0) complex subunit C1, mitochondrial, Cytospin-A, Zinc finger protein 557, Zinc finger protein 669, WD repeat-containing protein 6, Signal transducer and activator of transcription 6, Antigen peptide transporter 1, Retinoic acid receptor RXR-gamma, Eukaryotic translation initiation factor 2-alpha kinase 1, CDK5 regulatory subunit-associated protein 2, Trifunctional purine biosynthetic protein adenosine-3, R3H domain-containing protein 4, WD repeat-containing protein 27, UAP56-interacting factor, Histone acetyltransferase KAT8, Probable tRNA N6-adenosine threonylcarbamoyltransferase, Deoxynucleotidyltransferase terminal-interacting protein 2, Serpin B8, ATP synthase subunit alpha, mitochondrial, 1,4-alpha-glucan-branching enzyme, Phosphatidylinositol 4,5-bisphosphate 3-kinase catalytic subunit alpha isoform, Probable threonine-tRNA ligase 2, cytoplasmic, Coiled-coil domain-containing protein 127, Glucosylceramidase, ATPase family AAA domain-containing protein 5, Casein kinase II subunit alpha, Gamma-tubulin complex component 2, Integrator complex subunit 11, Pogo transposable element with KRAB domain, Nuclear factor erythroid 2-related factor 2, Serpin B9, Folliculin-interacting protein 2, Exportin-5, Protein transport protein Sec61 subunit gamma, Brefeldin A-inhibited guanine nucleotide-exchange protein 1, Charged multivesicular body protein 5, Calpain small subunit 1, PR domain zinc finger protein 15, DnaJ homolog subfamily C member 11, Ubiquitin-conjugating enzyme E2 variant 3, Spermatid perinuclear RNA-binding protein, Cytosolic carboxypeptidase 1, DNA repair protein RAD51 homolog 1, Eukaryotic translation initiation factor 3 subunit C-like protein, Methionine aminopeptidase 1, Tyrosine-protein phosphatase non-receptor type 11, Protein UXT, Nardilysin, Mediator of RNA polymerase II transcription subunit 13, Absent in melanoma 1 protein, Ubiquitin carboxyl-terminal hydrolase 22, ADP-sugar pyrophosphatase, Ras GTPase-activating protein-binding protein 1, Nuclear pore complex protein Nup155, Zinc finger protein 550, Zinc finger protein 674, Nucleoporin NUP188 homolog, Signal recognition particle subunit SRP72, Oxysterol-binding protein-related protein 8, Probable cation-transporting ATPase 13A3, Band 4.1-like protein 2, 26S proteasome non-ATPase regulatory subunit 13, Cytochrome b-c1 complex subunit 9, Mitotic checkpoint protein BUB3, Exocyst complex component 4, Patatin-like phospholipase domain-containing protein 2, Tubulin beta-4A chain, ATP-binding cassette sub-family F member 3, Pre-mRNA-splicing factor ATP-dependent RNA helicase DHX15, Actin-related protein 2/3 complex subunit 2, Protein FAM60A, Chromobox protein homolog 6, Splicing factor 3B subunit 1, FAS-associated factor 2, 26S proteasome non-ATPase regulatory subunit 3, Histone deacetylase 9, F-box only protein 5, ATP-binding cassette sub-family D member 1, V-type proton ATPase subunit d 1, Enhancer of rudimentary homolog, ATP synthase subunit epsilon-like protein, mitochondrial, Polyadenylate-binding protein 1, Protein OS-9, Interferon-induced, double-stranded RNA-activated protein kinase, Alpha-taxilin, Tetratricopeptide repeat protein 9C, Transmembrane emp24 domain-containing protein 4, Non-receptor tyrosine-protein kinase TYK2, E3 ubiquitin-protein ligase AMFR, Proteasome subunit alpha type-2, Nucleolysin TIA-1 isoform p40, Nucleolysin TIAR, Kinesin-like protein KIF20A, Non-specific lipid-transfer protein, Ectonucleoside triphosphate diphosphohydrolase 1, FACT complex subunit SSRP1, Double-stranded RNA-binding protein Staufen homolog 1, Serine/threonine-protein phosphatase 6 regulatory subunit 3, SUMO-specific isopeptidase USPL1, 5'-nucleotidase domain-containing protein 1, Serine/arginine-rich splicing factor 6, Serine/threonine-protein kinase 17A, A-kinase anchor protein 2, Zinc finger protein Rlf, Histone-lysine N-methyltransferase SETD2, Nesprin-2, Uncharacterized protein C14orf119, Cyclin-G-associated kinase, Peroxisomal membrane protein 2, Nucleoporin GLE1, Nuclear pore complex protein Nup93, 60S ribosomal export protein NMD3, 14 kDa phosphohistidine phosphatase, MK167 FHA domain-interacting nucleolar phosphoprotein, Kinesin-associated protein 3, U4/U6 small nuclear ribonucleoprotein Prp4, Transmembrane emp24 domain-containing protein 3, E3 ubiquitin-protein ligase MARCH7, Midasin, Arf-GAP with coiled-coil, ANK repeat and PH domain-containing protein 2, Zinc finger protein 330, Protein FAM208B, Heat shock 70 kDa protein 14, COP9 signalosome complex subunit 6, Axin-1, Proteasome subunit beta type-8, Dedicator of cytokinesis protein 11, Mitochondrial Rho GTPase 2, Cysteine-rich PDZ-binding protein, Exosome complex exonuclease RRP44, Collagen type IV alpha-3-binding protein, Vigilin, WD repeat-containing protein 1, Cytoplasmic FMR1-interacting protein 1, Eukaryotic translation initiation factor 3 subunit I, Epidermal growth factor receptor substrate 15, E3 ubiquitin-protein ligase Topors, Tubulin beta chain, Cohesin subunit SA-2, Phosphatidylinositol 3,4,5-trisphosphate-dependent Rac exchanger 1 protein, Phospholipid-transporting ATPase IG, Vacuolar protein sorting-associated protein 26A, Syntaxin-binding protein 3, Centrosomal protein CEP57L1, Pleckstrin homology domain-containing family B member 2, Zinc finger protein 706, SWI/SNF-related matrix-associated actin-dependent regulator of chromatin subfamily D member 2, V-type proton ATPase subunit E 2, 40S ribosomal protein S13, Cation-independent mannose-6-phosphate receptor, Nucleoporin Nup37, RNA polymerase II elongation factor ELL, Heterogeneous nuclear ribonucleoprotein F, Tetratricopeptide repeat protein 13, Tapasin, Condensin-2 complex subunit D3, Endoplasmic reticulum-Golgi intermediate compartment protein 3, Threonine-tRNA ligase, cytoplasmic, Choline/ethanolaminephosphotransferase 1, 28S ribosomal protein S17, mitochondrial, Protein Niban, Ubiquitin carboxyl-terminal hydrolase 7, E3 ubiquitin-protein ligase RNF19A, Interleukin enhancer-binding factor 2, Transitional endoplasmic reticulum ATPase, Nuclear factor NF-kappa-B p100 subunit, Phospholipase D2, Acidic fibroblast growth factor intracellular-binding protein, Alanine-tRNA ligase, cytoplasmic, Histone-lysine N-methyltransferase 2C, Attractin, Histone-lysine N-methyltransferase, H3 lysine-79 specific, Dynamin-1-like protein, Pyridine nucleotide-disulfide oxidoreductase domain-containing protein 1, Chromodomain-helicase-DNA-binding protein 7, Polypyrimidine tract-binding protein 3, HLA class I histocompatibility antigen, B-52 alpha chain, Cell division cycle-associated 7-like protein, Mediator of RNA polymerase II transcription subunit 10, Hypoxia-inducible factor 1-alpha, Metastasis-associated protein MTA3, Oxysterol-binding protein-related protein 3, tRNA (adenine(58)-N(1))-methyltransferase non-catalytic subunit TRM6, Nucleolar complex protein 4 homolog, Geminin, Chromodomain-helicase-DNA-binding protein 1-like, Up-regulated during skeletal muscle growth protein 5, Integrator complex subunit 3, Mitogen-activated protein kinase 6, RNA binding motif protein, X-linked-like-1, Serine/threonine-protein kinase PLK1, Glycoprotein endo-alpha-1,2-mannosidase-like protein, Cold-inducible RNA-binding protein, DNA mismatch repair protein Msh6, Serine hydroxymethyltransferase, cytosolic, Store-operated calcium entry-associated regulatory factor, FACT complex subunit SPT16, Histone-lysine N-methyltransferase EZH1, Trafficking protein particle complex subunit 4, DnaJ homolog subfamily C member 3, Meckelin, Serine/threonine-protein kinase pim-2, RNA-binding protein 7, Glutathione S-transferase Mu 2, Protein patched homolog 1, ARF GTPase-activating protein GIT2, Thioredoxin-related transmembrane protein 2, Zinc finger CCCH domain-containing protein 18, Probable ATP-dependent RNA helicase DDX47, Eukaryotic translation initiation factor 2 subunit 3, AP-1 complex subunit beta-1, Septin-6, DNA topoisomerase 2-alpha, Coilin, ATPase family AAA domain-containing protein 2, Choline-phosphate cytidylyltransferase A, Serine/threonine-protein kinase pim-1, Death-associated protein kinase 2, Transcription termination factor 2, C-1-tetrahydrofolate synthase, cytoplasmic, Major histocompatibility complex class I-related gene protein, Delta(24)-sterol reductase, Protein SET, Constitutive coactivator of PPAR-gamma-like protein 1, DNA replication complex GINS protein PSF1, AP-1 complex subunit mu-2, Dolichol-phosphate mannosyltransferase subunit 1, Heterogeneous nuclear ribonucleoprotein M, Plastin-3, THO complex subunit 2, 60S ribosomal protein L4, Hexokinase-2, Ribosome-binding protein 1, Proteasome subunit beta type-5, Anaphase-promoting complex subunit 2, Protein-tyrosine kinase 2-beta, NEDD8 ultimate buster 1, Baculoviral IAP repeat-containing protein 6, E3 ubiquitin-protein ligase CBL-B, Basigin, Phosphatidylinositol 4-kinase type 2-beta, Histone-binding protein RBBP7, High mobility group protein B3, Lymphocyte antigen 75, Putative RRN3-like protein RRN3P1, Chloride intracellular channel protein 1, Transmembrane emp24 domain-containing protein 7, Myosin light polypeptide 6, Proteasome inhibitor PI31 subunit, Kinesin-like protein KIF20B, rRNA-processing protein FCF1 homolog, Cyclin-dependent kinase 6, Filamin A, Replication protein A 32 kDa subunit, ATP-dependent RNA helicase DHX8, Cysteine and glycine-rich protein 1, ER membrane protein complex subunit 2, Cleavage stimulation factor subunit 1, Exportin-2, Protein KIAA0100, Cyclin-dependent kinase inhibitor 3, Eukaryotic translation initiation factor 3 subunit M, Sigma non-opioid intracellular receptor 1, DNA repair protein RAD50, Nuclear pore complex protein Nup153, Protein SCO1 homolog, mitochondrial, F-box/LRR-repeat protein 3, von Willebrand factor, DNA nucleotidylexotransferase, Endothelial differentiation-related factor 1, Serine/arginine-rich splicing factor 9, Probable E3 ubiquitin-protein ligase makorin-2, Antigen KI-67, Mediator of RNA polymerase II transcription subunit 17, Non-canonical poly(A) RNA polymerase PAPD5, Interleukin-9 receptor, Trafficking protein particle complex subunit 5, Magnesium transporter protein 1, Transforming acidic coiled-coil-containing protein 3, Membrane-associated tyrosine- and threonine-specific cdc2-inhibitory kinase, Ig kappa chain C region, Multifunctional protein ADE2, TPT1-like protein, AP-5 complex subunit zeta-1, Protein transport protein Sec31A, DnaJ homolog subfamily C member 7, WD repeat-containing protein 82, Disco-interacting protein 2 homolog A, DNA replication licensing factor MCM5, Disks large homolog 1, Ubiquitin-conjugating enzyme E2 J1, Nucleolar transcription factor 1, Citrate synthase, mitochondrial, GMP reductase 2, Single Ig IL-1-related receptor, Sulfhydryl oxidase 1, Cyclin-D1-binding protein 1, HLA class II histocompatibility antigen, DRB1-15 beta chain, Pre-mRNA-splicing factor ISY1 homolog, CUGBP Elav-like family member 1, Gamma-secretase subunit PEN-2, Tyrosine-protein kinase BAZ1B, Influenza virus NS1A-binding protein, Target of rapamycin complex subunit LST8, Splicing factor 3B subunit 2, Importin subunit alpha-1, Cullin-4A, Carbonic anhydrase 9, BTB/POZ domain-containing adapter for CUL3-mediated RhoA degradation protein 3, Melanoma-associated antigen 10, 26S proteasome non-ATPase regulatory subunit 6, 40S ribosomal protein S26, Long-chain-fatty-acid-CoA ligase 3, N6-adenosine-methyltransferase subunit METTL14, Ubiquitin-conjugating enzyme E2 H, Adenylosuccinate synthetase isozyme 2, Serine/threonine-protein phosphatase 2A 56 kDa regulatory subunit epsilon isoform, Actin-binding protein IPP, Mitogen-activated protein kinase 4, Tyrosine-protein phosphatase non-receptor type 23, Mitochondrial carrier homolog 1, Microspherule protein 1, Splicing factor 3B subunit 3, Casein kinase I isoform delta, Protein kish-A, Seipin, CMP-N-acetylneuraminate-beta-galactosamide-alpha-2,3-sialyltransferase 2, Cleft lip and palate transmembrane protein 1, Proteasome subunit beta type-6, RNA-binding protein 42, Alpha-enolase, Unconventional myosin-Ic, THO complex subunit 5 homolog, Solute carrier family 35 member B1, Sarcoplasmic/endoplasmic reticulum calcium ATPase 1, ATP-dependent RNA helicase DDX50, Splicing factor, proline- and glutamine-rich, DDB1- and CUL4-associated factor 11, EH domain-containing protein 1, COP9 signalosome complex subunit 7a, Cullin-2, Glutathione S-transferase A4, WD repeat-containing protein 19, Serine palmitoyltransferase 2, Apoptosis-associated speck-like protein containing a CARD, DNA damage-inducible transcript 3 protein, Erlin-2, DNA polymerase alpha subunit B, Thyroid adenoma-associated protein, AP-3 complex subunit delta-1, Extended synaptotagmin-2, Transportin-1, NudC domain-containing protein 3, Ubiquitin carboxyl-terminal hydrolase 35, Proline and serine-rich protein 1, Hsp90 co-chaperone Cdc37, Ubiquitin-conjugating enzyme E2 S, Talin-1, Kinetochore protein NDC80 homolog, Integrator complex subunit 4, BRISC complex subunit Abro1, Enhancer of filamentation 1, SET and MYND domain-containing protein 4, Leucine-rich PPR motif-containing protein, mitochondrial, HAUS augmin-like complex subunit 1, T-complex protein 1 subunit zeta, FERM, RhoGEF and pleckstrin domain-containing protein 2, Mannose-1-phosphate guanyltransferase alpha, Structural maintenance of chromosomes flexible hinge domain-containing protein 1, A-kinase anchor protein 11, tRNA-splicing ligase RtcB homolog, Sister chromatid cohesion protein PDS5 homolog A, Autophagy-related protein 101, ATP-binding cassette sub-family F member 1, Ankyrin repeat and KH domain-containing protein 1, Phosphopantothenoylcysteine decarboxylase, Bifunctional methylenetetrahydrofolate dehydrogenase/cyclohydrolase, mitochondrial, Leucine-rich repeat flightless-interacting protein 2, ADP-ribosylation factor GTPase-activating protein 3, Plexin-B2, Ankyrin repeat and LEM domain-containing protein 2, Signal transducer and activator of transcription 5B, DNA-directed RNA polymerase I subunit RPA2, Son of sevenless homolog 1, Formin-like protein 1, Cytoskeleton-associated protein 5, DNA dC→dU-editing enzyme APOBEC-3F, General transcription factor 3C polypeptide 2, DCC-interacting protein 13-alpha, Nucleoside diphosphate kinase 3, Dipeptidyl peptidase 8, Myotubularin, Ubiquitin fusion degradation protein 1 homolog, Epidermal growth factor receptor substrate 15-like 1, Serine/threonine-protein kinase N1, Sphingomyelin phosphodiesterase 4, Probable dolichyl pyrophosphate Glc1Man9GlcNAc2 alpha-1,3-glucosyltransferase, Gamma-tubulin complex component 5, Bromodomain adjacent to zinc finger domain protein 2A, Serine/threonine-protein phosphatase 4 regulatory subunit 3A, Protein yippee-like 5, Protein TASOR, Protein FAM177A1, 60S ribosomal protein L34, TBCC domain-containing protein 1, T-complex protein 1 subunit beta, Plectin, GDP-mannose 4,6 dehydratase, Protein arginine N-methyltransferase 3, Unconventional myosin-If, TBC1 domain family member 9B, Poly [ADP-ribose] polymerase 10, Transport and Golgi organization protein 6 homolog, Protein transport protein Sec24A, GMP synthase [glutamine-hydrolyzing], Nuclear pore complex protein Nup133, SHC SH2 domain-binding protein 1, 3-hydroxyacyl-CoA dehydrogenase type-2, Translation initiation factor eIF-2B subunit delta, Ubiquitin-associated protein 2-like, DNA dC→dU-editing enzyme APOBEC-3B, Proteasome activator complex subunit 4, cAMP-dependent protein kinase type I-alpha regulatory subunit, 6-phosphofructo-2-kinase/fructose-2,6-bisphosphatase 4, Calcium and integrin-binding protein 1, Zinc transporter ZIP6, DDB1- and CUL4-associated factor 15, Alpha-ketoglutarate-dependent dioxygenase FTO, Serine/threonine-protein phosphatase 6 catalytic subunit, U4/U6 small nuclear ribonucleoprotein Prp3, Putative helicase MOV-10, Ubiquitin carboxyl-terminal hydrolase 10, CAD protein, Importin-4, Filamin-B, Probable helicase with zinc finger domain, Rho GTPase-activating protein 12, Proline-rich protein 12, WD repeat-containing protein 70, Hexokinase-1, Nischarin, Protein SPT2 homolog, Bardet-Biedl syndrome 1 protein, Ubiquitin-like domain-containing CTD phosphatase 1, Programmed cell death protein 5, Na(+)/H(+) exchange regulatory cofactor NHE-RF1, Hom s 1, Tumor necrosis factor receptor superfamily member 10B, Glucocorticoid modulatory element-binding protein 1, Hydroxyacyl-coenzyme A dehydrogenase, mitochondrial, Myocyte-specific enhancer factor 2A, Zinc finger protein 106, Rho GTPase-activating protein 35, Probable RNA-binding protein 23, Anamorsin, Anaphase-promoting complex subunit 1, Intraflagellar transport protein 172 homolog, Protein PRRC2B, TRPM8 channel-associated factor 1, DNA damage-binding protein 1, ORM1-like protein 3, WD repeat-containing protein 18, Chitinase domain-containing protein 1, Protein VPRBP, E3 ubiquitin-protein ligase TRIM22, Tetratricopeptide repeat protein 17, Ninein, Golgin subfamily A member 4, Multiple C2 and transmembrane domain-containing protein 1, Nucleoside diphosphate-linked moiety X motif 19, Probable helicase senataxin, Folliculin-interacting protein 1, Ras GTPase-activating-like protein IQGAP1, 26S proteasome non-ATPase regulatory subunit 1, F-box only protein 8, Melanoma inhibitory activity protein 3, IQ domain-containing protein D, Dihydroxyacetone phosphate acyltransferase, Protein DBF4 homolog A, F-box only protein 25, Hermansky-Pudlak syndrome 5 protein, Guanine nucleotide-binding protein subunit beta-5, Cytosolic phospholipase A2, 60S acidic ribosomal protein P1, ATP-binding cassette sub-family B member 7, mitochondrial, Dual specificity mitogen-activated protein kinase kinase 7, Lon protease homolog 2, peroxisomal, Protein virilizer homolog, Histone-lysine N-methyltransferase SETD1A, Endosomal/lysomomal potassium channel TMEM175, Serine/threonine-protein kinase TAO2, Cell division control protein 6 homolog, AT-rich interactive domain-containing protein 4B, Transcription activator BRG1, Ankyrin repeat and SOCS box protein 3, Ribonucleases P/MRP protein subunit POP1, Translin-associated protein X, Phosphotriesterase-related protein, Methionine adenosyltransferase 2 subunit beta, Chromosome transmission fidelity protein 8 homolog, Catenin alpha-1, Splicing factor 3A subunit 1, Aurora kinase B, Vam6/Vps39-like protein, Kelch-like protein 13, Interleukin-6 receptor subunit beta, Ankyrin repeat domain-containing protein 17, Protein IWS1 homolog, G2/M phase-specific E3 ubiquitin-protein ligase, Adenomatous polyposis coli protein, Flotillin-2, Calpastatin, Cyclin-dependent kinase 9, E3 ubiquitin-protein ligase listerin, Guanosine-3',5'-bis(diphosphate) 3'-pyrophosphohydrolase MESH1, Protein PRR14L, MAP kinase-activated protein kinase 5, Nck-associated protein 1, Nuclear pore glycoprotein p62, DNA excision repair protein ERCC-6-like, Kelch repeat and BTB domain-containing protein 4, N-acetylneuraminate lyase, DENN domain-containing protein 4C, Fatty acyl-CoA reductase 2, 28S ribosomal protein S33, mitochondrial, RNA-binding protein 4B, Zinc finger protein 143, cAMP-responsive element modulator, WD repeat-containing protein 43, CTD small phosphatase-like protein 2, Ras-related GTP-binding protein C, DNA repair and recombination protein RAD54B, HIV Tat-specific factor 1, Negative elongation factor A, Rho-associated protein kinase 1, E3 ISG15-protein ligase HERC5, Renal cancer differentiation gene 1 protein, E3 ubiquitin-protein ligase UBR4, Prolyl 4-hydroxylase subunit alpha-1, Archaemetzincin-2, EH domain-binding protein 1, Hyaluronan mediated motility receptor, Conserved oligomeric Golgi complex subunit 5, Ribosomal L1 domain-containing protein 1, Regulator of G-protein signaling 10, Protein Jade-2, DNA-directed RNA polymerase II subunit RPB3, Electron transfer flavoprotein subunit beta, Protein Mis18-alpha, Phosphatidylinositol 4-kinase beta, Cytochrome P450 20A1, Ectopic P granules protein 5 homolog, CCAAT/enhancer-binding protein zeta, MORF4 family-associated protein 1-like 1, Proteasome subunit beta type-2, cAMP-dependent protein kinase type I-beta regulatory subunit, Rap1 GTPase-GDP dissociation stimulator 1, Probable E3 ubiquitin-protein ligase HERC4, Protein SON, Proteasome activator complex subunit 2, CCR4-NOT transcription complex subunit 1, DNA fragmentation factor subunit beta, CREB-binding protein, SCAN domain-containing protein 1, Cyclin-dependent kinase inhibitor 1C, ERI1 exoribonuclease 3, Cyclin-1, Tight junction protein ZO-2, DNA-directed RNA polymerase II subunit RPB11-b1, Conserved oligomeric Golgi complex subunit 4, Cipl-interacting zinc finger protein, Neuferricin, Cyclin-dependent kinase 1, RCC1 and BTB domain-containing protein 1, Eukaryotic translation initiation factor 3 subunit H, Zinc finger SWIM domain-containing protein 1, DNA-directed RNA polymerase II subunit RPB4, Rho guanine nucleotide exchange factor 2, E3 ubiquitin-protein ligase TRIM37, DEP domain-containing protein 1A, Small nuclear ribonucleoprotein Sm D1, Lipopolysaccharide-responsive and beige-like anchor protein, Electron transfer flavoprotein subunit alpha, mitochondrial, Solute carrier family 43 member 3, Integrin alpha-4, Uridine-cytidine kinase-like 1, KH domain-containing, RNA-binding, signal transduction-associated protein 1, Rho guanine nucleotide exchange factor 18, Steroid receptor RNA activator 1, Cytochrome c oxidase subunit 7C, mitochondrial, Flotillin-1, Breast cancer type 1 susceptibility protein, Ral GTPase-activating protein subunit beta, F-box only protein 22, Glycerol-3-phosphate dehydrogenase, mitochondrial, Propionyl-CoA carboxylase beta chain, mitochondrial, Utrophin, Testis-expressed sequence 10 protein, SEC14-like protein 1, Ethylmalonyl-CoA decarboxylase, HEAT repeat-containing protein 2, 60S ribosomal protein L6, Mitochondrial dynamics protein MID51, Zinc finger protein 131, Vacuolar protein sorting-associated protein 53 homolog, Putative sodium-coupled neutral amino acid transporter 10, KN motif and ankyrin repeat domain-containing protein 2, Pyridoxal-dependent decarboxylase domain-containing protein 1, Pinin, V-type proton ATPase subunit H, Ubiquitin-conjugating enzyme E2 B, Inhibitor of nuclear factor kappa-B kinase-interacting protein, Double-strand-break repair protein rad21 homolog, PRA1 family protein 3, DEP domain-containing protein 1 B, ATP-binding cassette sub-family B member 10, mitochondrial, SHC-transforming protein 1, Serine/threonine-protein phosphatase PP1-gamma catalytic subunit, Eukaryotic translation initiation factor 2 subunit 1, Anaphase-promoting complex subunit 7, TATA-binding protein-associated factor 172, 2'-5'-oligoadenylate synthase 3, LisH domain-containing protein ARMC9, Ankyrin repeat and SOCS box protein 6, DNA polymerase epsilon catalytic subunit A, Sestrin-1, V-type proton ATPase catalytic subunit A, Trinucleotide repeat-containing gene 6A protein, TNFAIP3-interacting protein 2, Phosphatidylinositol 3-kinase regulatory subunit gamma, TELO2-interacting protein 1 homolog, Leucine-rich repeat and coiled-coil domain-containing protein 1, Transmembrane emp24 domain-containing protein 9, F-box/LRR-repeat protein 5, Programmed cell death 6-interacting protein, Ribosome production factor 1, Exostosin-2, Bloom syndrome protein, U1 small nuclear ribonucleoprotein C, Transcription factor RFX3, Ubiquitin carboxyl-terminal hydrolase 34, Polymerase I and transcript release factor, Mediator of RNA polymerase II transcription subunit 12, Heterogeneous nuclear ribonucleoprotein C-like 1, Serine/threonine-protein kinase ATR, Neurochondrin, Adrenocortical dysplasia protein homolog, Ran GTPase-activating protein 1, Arfaptin-2, Pericentrin, Hermansky-Pudlak syndrome 4 protein, Choline/ethanolamine kinase, WD repeat-containing protein 3, Peroxisomal membrane protein 4, Dynactin subunit 1, AP-3 complex subunit mu-1, Alsin, RNA-binding protein 28, Zinc finger MYM-type protein 3, RNA polymerase II-associated protein 1, General transcription factor 3C polypeptide 5, EH domain-containing protein 4, Huntingtin, Set1/Ash2 histone methyltransferase complex subunit ASH2, Non-POU domain-containing octamer-binding protein, Ancient ubiquitous protein 1, Coiled-coil domain-containing protein 93, Probable ATP-dependent RNA helicase DDX27, Nuclear respiratory factor 1, Fanconi anemia group D2 protein, E3 ubiquitin-protein ligase UHRF1, Cyclic AMP-dependent transcription factor ATF-1, HEAT repeat-containing protein 5B, NmrA-like family domain-containing protein 1, Tetratricopeptide repeat protein 21 B, Inositol 1,4,5-trisphosphate receptor type 1, Perilipin-2, V-type proton ATPase subunit C 1, Protein NOXP20, Short transient receptor potential channel 1, Mitochondrial import receptor subunit TOM22 homolog, AP-3 complex subunit mu-2, Malate dehydrogenase, mitochondrial, Quinone oxidoreductase, Dual specificity protein phosphatase 14, Cell division cycle and apoptosis regulator protein 1, Protein PAT1 homolog 2, Tropomyosin alpha-4 chain, 40S ribosomal protein S15a, Prefoldin subunit 4, Neurobeachin-like protein 2, E3 ubiquitin-protein ligase RNF130, Calmodulin-regulated spectrin-associated protein 1, HEAT repeat-containing protein 3, Carbohydrate sulfotransferase 14, Isochorismatase domain-containing protein 1, Rab GTPase-activating protein 1-like, Centrosomal protein of 76 kDa, Exportin-1, von Willebrand factor A domain-containing protein 8, Ras-related protein Rab-5A, MAU2 chromatid cohesion factor homolog, Kelch-like protein 24, Protein FAM171B, Protein yippee-like 1, Inhibitor of nuclear factor kappa-B kinase subunit alpha, Probable ATP-dependent RNA helicase DDX56, Uncharacterized protein C18orf8, Protein LLP homolog, AP-2 complex subunit sigma, Maestro heat-like repeat-containing protein family member 1, Nucleolar protein 9, High mobility group protein 20A, HLA class II histocompatibility antigen, DR beta 3 chain, Importin-9, Protein asunder homolog, Ribonuclease UK114, Zinc finger BED domain-containing protein 1, Tyrosine-protein kinase JAK1, Putative RNA-binding protein 15, AKT-interacting protein, Werner syndrome ATP-dependent helicase, Protein downstream neighbor of Son, Protein artemis, Adenosylhomocysteinase 2, Ligand-dependent nuclear receptor-interacting factor 1, Kelch-like protein 8, Adenosylhomocysteinase, DNA-directed RNA polymerases I, II, and III subunit RPABC3, Transcription factor 25, Nuclear migration protein nudC, COP9 signalosome complex subunit 1, Nucleoprotein TPR, Neutral alpha-glucosidase C, UPF0585 protein C16orf13, BTB/POZ domain-containing protein KCTD3, DBF4-type zinc finger-containing protein 2, NADH dehydrogenase [ubiquinone] iron-sulfur protein 8, mitochondrial, Protein unc-50 homolog, Vacuole membrane protein 1, SUMO-activating enzyme subunit 2, Mitotic checkpoint serine/threonine-protein kinase BUB1 beta, EKC/KEOPS complex subunit TPRKB, PRKC apoptosis WT1 regulator protein, Probable methyltransferase TARBP1, E3 ubiquitin-protein ligase HUWE1, 26S proteasome non-ATPase regulatory subunit 8, Leucine-tRNA ligase, cytoplasmic, Striatin-interacting protein 2, Zinc finger protein Pegasus, A-kinase anchor protein 10, mitochondrial, RNA polymerase II subunit A C-terminal domain phosphatase, DNA repair protein complementing XP-G cells, Protein phosphatase 1 G, Interleukin-1 receptor-associated kinase-like 2, Dual specificity protein kinase CLK2, Sterol regulatory element-binding protein 2, Actin-related protein 2/3 complex subunit 4, Replication factor C subunit 5, Histone deacetylase 3, 40S ribosomal protein S10, Protein unc-93 homolog B1, Sodium- and chloride-dependent taurine transporter, Cullin-7, Kinetochore-associated protein 1, Histone deacetylase 1, Syntaxin-binding protein 5, Speriolin-like protein, Erythroid differentiation-related factor 1, Ubiquitin-conjugating enzyme E2 J2, E3 ubiquitin-protein ligase Hakai, Annexin A5, cAMP-dependent protein kinase catalytic subunit alpha, Cytochrome c, COMM domain-containing protein 2, Akirin-1, ORM1-like protein 1, Sodium channel and clathrin linker 1, Tetratricopeptide repeat protein 14, Structural maintenance of chromosomes protein 4, BCL-6 corepressor, NEDD8-activating enzyme E1 regulatory subunit, RANBP2-like and GRIP domain-containing protein 2, Mediator of RNA polymerase II transcription subunit 19, Afadin, Tubulin beta-2A chain, N-alpha-acetyltransferase 50, Origin recognition complex subunit 1, Syntaxin-binding protein 2, Abl interactor 1, FERM domain-containing protein 4A, 60S ribosome subunit biogenesis protein NIP7 homolog, Dolichol-phosphate mannosyltransferase subunit 3, Protein enabled homolog, F-actin-capping protein subunit beta, Centromere protein W, Histone H1.1, Crooked neck-like protein 1, Exportin-T, Chondroitin sulfate glucuronyltransferase, 78 kDa glucose-regulated protein, X-ray repair cross-complementing protein 6, WD and tetratricopeptide repeats protein 1, DNA replication licensing factor MCM3, Retinoblastoma-like protein 1, Alpha-2-macroglobulin receptor-associated protein, Immunoglobulin-binding protein 1, Myeloid leukemia factor 2, Histone-lysine N-methyltransferase NSD3, Secernin-1, DNA dC→dU-editing enzyme APOBEC-3D, Syntaxin-18, WD repeat-containing protein 91, Tubulin-specific chaperone A, MAP3K12-binding inhibitory protein 1, Spectrin alpha chain, non-erythrocytic 1, Transcriptional regulator ATRX, Nuclear receptor corepressor 1, Protein kinase C delta type, ATP-dependent RNA helicase DDX42, E3 ubiquitin-protein ligase TTC3, RAB6A-GEF complex partner protein 1, B-cell receptor-associated protein 31, Poly(A)-specific ribonuclease PARN, Translation initiation factor eIF-2B subunit epsilon, RNA-binding protein 8A, Pre-mRNA-processing factor 6, Cleavage and polyadenylation specificity factor subunit 7, 39S ribosomal protein L20, mitochondrial, Melanoma-associated antigen F1, Lysine-specific demethylase 2B, Translation factor GUF1, mitochondrial, V-type proton ATPase subunit E 1, 60S ribosomal protein L9, Actin-related protein 2/3 complex subunit 5, Prefoldin subunit 6, Serine hydroxymethyltransferase, mitochondrial, Interferon alpha-inducible protein 6, Engulfment and cell motility protein 2, Transcription initiation factor IIE subunit beta, F-box only protein 21, Cytochrome c oxidase subunit 7A-related protein, mitochondrial, Mitochondrial ubiquitin ligase activator of NFKB 1, NAD(P)H dehydrogenase [quinone] 1, Lysine-specific demethylase 5D, Major facilitator superfamily domain-containing protein 12, Casein kinase II subunit beta, Sec1 family domain-containing protein 1, Receptor expression-enhancing protein 3, Kinetochore protein Nuf2, E3 ubiquitin-protein ligase makorin-1, Probable ATP-dependent RNA helicase DHX37, Exosome complex component RRP41, Angio-associated migratory cell protein, Trans-3-hydroxy-L-proline dehydratase, Helicase with zinc finger domain 2, Fanconi anemia group I protein, Pescadillo homolog, Nucleolar and spindle-associated protein 1, Retinoblastoma-associated protein, DNA repair protein XRCC2, Derlin-1, DNA (cytosine-5)-methyltransferase 3A, Putative rhophilin-2-like protein RHPN2P1, TRAF2 and NCK-interacting protein kinase, Nucleoside diphosphate kinase 6, Methylsterol monooxygenase 1, Protein HIRA, Probable phospholipid-transporting ATPase IF, Integrator complex subunit 12, Signal peptidase complex catalytic subunit SEC11C, Sororin, Histone H2B type 1-K, Integrator complex subunit 8, Toll-interacting protein, Amyloid protein-binding protein 2, 182 kDa tankyrase-1-binding protein, Cytoplasmic FMR1-interacting protein 2, Heat shock protein 105 kDa, Chromodomain-helicase-DNA-binding protein 2, 26S protease regulatory subunit 10B, Zinc finger MYND domain-containing protein 11, General transcription factor IIH subunit 5, Ubiquitin carboxyl-terminal hydrolase 19, Serrate RNA effector molecule homolog, Ras GTPase-activating protein-binding protein 2, Heat shock 70 kDa protein 4, Coatomer subunit beta, NADH dehydrogenase [ubiquinone] 1 alpha subcomplex subunit 13, DDB1- and CUL4-associated factor 10, Negative elongation factor E, Coiled-coil domain-containing protein 66, E3 ubiquitin-protein ligase MGRN1, WD repeat-containing protein 36, Unconventional myosin-Ie, PH domain leucine-rich repeat-containing protein phosphatase 1, Paxillin, Kinesin-like protein KIF21A, 2',3'-cyclic-nucleotide 3'-phosphodiesterase, Protein FAM192A, Proteasome subunit beta type-4, Sorting nexin-14, Krueppel-like factor 6, Tropomodulin-3, Nuclear receptor-binding protein, Nitrogen permease regulator 2-like protein, OTU domain-containing protein 5, Histone-binding protein RBBP4, Sorting nexin-24, Poly(rC)-binding protein 2, Vacuolar fusion protein CCZ1 homolog, ATP-dependent RNA helicase DDX19B, Elongation factor 1-gamma, Adenylate cyclase type 3, MICOS complex subunit MIC19, Ferritin light chain, Glutaredoxin-3, Pre-B-cell leukemia transcription factor 3, AP-2 complex subunit alpha-1, 40S ribosomal protein S24, Enhancer of mRNA-decapping protein 3, Neuroblastoma-amplified sequence, Protein phosphatase 1 regulatory subunit 7, Exosome component 10, Cyclin-dependent kinase 14, Translocation protein SEC62, Constitutive coactivator of peroxisome proliferator-activated receptor gamma, Protein SCAF11, Rho GTPase-activating protein 21, Arfaptin-1, AP-2 complex subunit mu, Ubiquitin carboxyl-terminal hydrolase 36, Glutathione S-transferase kappa 1, Kelch repeat and BTB domain-containing protein 7, Calcium homeostasis endoplasmic reticulum protein, RNA polymerase II-associated protein 3, Zinc finger E-box-binding homeobox 1, Dynein light chain 1, cytoplasmic, 39S ribosomal protein L2, mitochondrial, Fidgetin-like protein 1, WD repeat-containing protein 46, Exosome complex component RRP40, Ubiquinol-cytochrome-c reductase complex assembly factor 1, Antizyme inhibitor 1, Transketolase, Carbohydrate sulfotransferase 10, LanC-like protein 1, Histone H2A.V, E3 ubiquitin-protein ligase TRIP12, Unconventional myosin-VI, Integrin-linked protein kinase, Serine/threonine-protein kinase WNK1, Centromere protein M, Ankyrin repeat family A protein 2, Little elongation complex subunit 1, Deoxynucleoside triphosphate triphosphohydrolase SAMHD1, Lanosterol 14-alpha demethylase, NADH dehydrogenase [ubiquinone] 1 beta subcomplex subunit 4, TFIIH basal transcription factor complex helicase XPD subunit, Thymidine kinase, cytosolic, Peroxiredoxin-6, LYR motif-containing protein 1, SWI/SNF complex subunit SMARCC2, Lysine-specific histone demethylase 1B, Induced myeloid leukemia cell differentiation protein Mcl-1, V-type proton ATPase 16 kDa proteolipid subunit, HLA class II histocompatibility antigen, DP alpha 1 chain, ATP synthase subunit g, mitochondrial, Interferon regulatory factor 9, Cleavage and polyadenylation specificity factor subunit 2, Sentrin-specific protease 6, Zinc finger CCCH domain-containing protein 4, Squalene monooxygenase, RNA cytidine acetyltransferase, Ribonuclease inhibitor, UDP-glucose:glycoprotein glucosyltransferase 2, Bifunctional apoptosis regulator, SWI/SNF-related matrix-associated actin-dependent regulator of chromatin subfamily E member 1, Zinc finger protein 302, Phosphatidylinositol 4-phosphate 5-kinase type-1 alpha, Transmembrane emp24 domain-containing protein 10, Phosphatidylinositol-binding clathrin assembly protein, DnaJ homolog subfamily B member 14, Ezrin, Moesin, Transcription elongation factor B polypeptide 2, Small kinetochore-associated protein, RANBP2-like and GRIP domain-containing protein 1, Mitochondrial fission 1 protein, Spliceosome RNA helicase DDX39B, Activating signal cointegrator 1 complex subunit 2, Fibroblast growth factor receptor 1, 60S ribosomal protein L7-like 1, Tyrosine-protein kinase JAK2, Replication factor C subunit 2, SAGA-associated factor 29, B-cell linker protein, SWI/SNF-related matrix-associated actin-dependent regulator of chromatin subfamily A member 5, Myc proto-oncogene protein, Translationally-controlled tumor protein, Baculoviral IAP repeat-containing protein 2, Serine/threoni ne-protein kinase Chk1, 40S ribosomal protein S9, Galactosylgalactosylxylosylprotein 3-beta-glucuronosyltransferase 3, BRISC and BRCA1-A complex member 1, SWI/SNF-related matrix-associated actin-dependent regulator of chromatin subfamily D member 3, Tyrosine-tRNA ligase, cytoplasmic, Target of rapamycin complex 2 subunit MAPKAP1, Activator of 90 kDa heat shock protein ATPase homolog 1, Class E basic helix-loop-helix protein 40, 60S ribosomal protein L27a, Cilia- and flagella-associated protein 20, Polyribonucleotide 5'-hydroxyl-kinase Clpl, Elongator complex protein 3, Nodal modulator 2, Low density lipoprotein receptor adapter protein 1, Protein FAM136A, Selenoprotein T, cAMP-dependent protein kinase catalytic subunit beta, Small EDRK-rich factor 2, A-kinase anchor protein 13, Renin receptor, Chromosome alignment-maintaining phosphoprotein 1, Mediator of RNA polymerase II transcription subunit 27, Zinc finger and BTB domain-containing protein 40, Protein FAM3C, Pseudouridylate synthase 7 homolog, Cyclin-dependent kinase 11A, Cyclin-dependent kinase 11B, Zinc finger FYVE domain-containing protein 16, Cyclic AMP-dependent transcription factor ATF-6 beta, Bridging integrator 3, 26S proteasome non-ATPase regulatory subunit 11, RNA-binding protein 43, Serine/threonine-protein kinase Chk2, 60S ribosomal protein L13a, G2/mitotic-specific cyclin-B2, Tryptophan-tRNA ligase, mitochondrial, B-lymphocyte antigen CD19, Astrotactin-2, Rab GDP dissociation inhibitor beta, Unconventional myosin-Id, Nipped-B-like protein, E3 ubiquitin-protein ligase RAD18, Motile sperm domain-containing protein 2, Microtubule-associated protein RP/EB family member 1, DNA replication licensing factor MCM2, Methionine synthase reductase, Leucine-rich repeat-containing protein 58, Proteasome assembly chaperone 2, Neuroguidin, 40S ribosomal protein S7, PRELI domain containing protein 3B, Cyclin-T1, Dolichyl-diphosphooligosaccharide-protein glycosyltransferase 48 kDa subunit, Large proline-rich protein BAG6, Myosin-7B, DnaJ homolog subfamily B member 5, Nuclear factor interleukin-3-regulated protein, Ras-related protein Rab-7a, Fizzy-related protein homolog, CUGBP Elav-like family member 2, Serine/threonine-protein kinase PAK 2, Serine/threonine/tyrosine-interacting-like protein 1, Monocarboxylate transporter 7, Oxysterol-binding protein-related protein 9, DnaJ homolog subfamily A member 1, Copine-8, Forkhead box protein K2, RNA polymerase II subunit A C-terminal domain phosphatase SSU72, Alpha-galactosidase A, Mis18-binding protein 1, Desmin, DNA-(apurinic or apyrimidinic site) lyase, tRNA (cytosine(34)-C(5))-methyltransferase, Condensin-2 complex subunit H2, Protein C10, TRAF3-interacting JNK-activating modulator, Eukaryotic translation initiation factor 3 subunit E, TCF3 fusion partner, Inorganic pyrophosphatase, LBH domain-containing protein 1, NADH dehydrogenase [ubiquinone] 1 beta subcomplex subunit 11, mitochondrial, Ubiquilin-2, Gamma-taxilin, Di-N-acetylchitobiase, Sorting nexin-17, Ras-related GTP-binding protein A, Tropomyosin alpha-3 chain, Tetratricopeptide repeat protein 39C, Aurora kinase A, Histone H2B type 2-E, Sorbitol dehydrogenase, Serine/threonine-protein kinase Nek6, U3 small nucleolar ribonucleoprotein protein MPP10, 60S ribosomal protein L31, Importin-8, Replication factor C subunit 4, Putative Polycomb group protein ASXL1, Protein PML, DNA-directed RNA polymerases I, II, and Ill subunit RPABC2, Translational activator GCN1, Zinc finger protein 195, Fragile X mental retardation syndrome-related protein 1, Dual specificity tyrosine-phosphorylation-regulated kinase 1A, Integrator complex subunit 1, RNA pseudouridylate synthase domain-containing protein 4, Phosducin-like protein 3, Golgi phosphoprotein 3, Guanine nucleotide-binding protein G(I)/G(S)/G(O) subunit gamma-5, Cartilage-associated protein, Ubiquitin-associated domain-containing protein 2, Heterogeneous nuclear ribonucleoprotein Q, Semaphorin-7A, Pentatricopeptide repeat domain-containing protein 3, mitochondrial, Egl nine homolog 2, Parkinson disease 7 domain-containing protein 1, Nuclear pore complex protein Nup98-Nup96, Glycogen synthase kinase-3 beta, BTB/POZ domain-containing protein KCTD20, Tubulin gamma-1 chain, LYR motif-containing protein 2, NF-kappa-B inhibitor beta, Kinesin-like protein KIF18B, Histone deacetylase 5, HCLS1-associated protein X-1, 40S ribosomal protein S4, X isoform, E3 ubiquitin-protein ligase MARCH6, Kelch-like protein 20, Terminal uridylyltransferase 4, TNF receptor-associated factor 1, DnaJ homolog subfamily B member 12, E3 ubiquitin-protein ligase UBR5, DNA methyltransferase 1-associated protein 1, Zinc finger MIZ domain-containing protein 1, Apoptosis inhibitor 5, 39S ribosomal protein L55, mitochondrial, Phosphate carrier protein, mitochondrial, Formin-binding protein 1, F-box only protein 33, Protein-lysine N-methyltransferase EEF2KMT, Growth factor receptor-bound protein 2, 60S ribosomal protein L23, Neuroepithelial cell-transforming gene 1 protein, Isoleucine-tRNA ligase, cytoplasmic, Uncharacterized protein KIAA1551, 60S ribosomal protein L30, Protein BRICK1, Protein PRRC2C, Cytoskeleton-associated protein 2-like, Cyclin-dependent kinase 12, Cold shock domain-containing protein E1, Eukaryotic translation initiation factor 4H, Cell division cycle 5-like protein, Biogenesis of lysosome-related organelles complex 1 subunit 1, Beta-catenin-like protein 1, 60S ribosomal protein L37a, Peroxisomal multifunctional enzyme type 2, Ubiquitin-40S ribosomal protein S27a, RAD50-interacting protein 1, Dynamin-binding protein, Diphosphoinositol polyphosphate phosphohydrolase 1, Diphosphoinositol polyphosphate phosphohydrolase 2, Coatomer subunit beta', Plakophilin-4, tRNA pseudouridine synthase-like 1, Protein ERGIC-53, F-box only protein 3, ATP synthase mitochondrial F1 complex assembly factor 1, tRNA (guanine(26)-N(2))-dimethyltransferase, Poly [ADP-ribose] polymerase 3, Drebrin-like protein, YEATS domain-containing protein 4, Sorting nexin-3, Copper transport protein ATOX1, U3 small nucleolar RNA-associated protein 14 homolog A, Acetolactate synthase-like protein, Inosine-5'-monophosphate dehydrogenase 2, Transmembrane protein 107, Mitochondrial import receptor subunit TOM5 homolog, Ribosome biogenesis protein WDR12, WD repeat-containing protein 74, Centrosomal protein of 104 kDa, Probable E3 ubiquitin-protein ligase TRIM8, UPF0769 protein C21orf59, E3 ubiquitin-protein ligase Itchy homolog, Ubiquilin-1, Ferritin heavy chain, Single-stranded DNA-binding protein 2, PERQ amino acid-rich with GYF domain-containing protein 2, Transcriptional adapter 1, Zinc finger protein 296, UV-stimulated scaffold protein A, WD repeat-containing protein 63, Programmed cell death protein 6, WD repeat-containing protein 62, Beta-parvin, DnaJ homolog subfamily A member 2, Protein sel-1 homolog 1, HLA class II histocompatibility antigen, DRB1-11 beta chain, Retinoic acid receptor alpha, Vacuolar protein sorting-associated protein 51 homolog, Misshapen-like kinase 1, Arginine-glutamic acid dipeptide repeats protein, Manganese-transporting ATPase 13A1, Myotubularin-related protein 10, Double-stranded RNA-specific adenosine deaminase, Adenylate cyclase type 6, Cytochrome c oxidase subunit 6C, N-alpha-acetyltransferase 30, COP9 signalosome complex subunit 2, Cell division cycle-associated protein 2, Zinc finger protein 697, Protection of telomeres protein 1, Uridine diphosphate glucose pyrophosphatase, Ubiquitin carboxyl-terminal hydrolase 48, RNA-binding protein EWS, Immediate early response gene 5 protein, PCI domain-containing protein 2, MAP7 domain-containing protein 1, 60S ribosomal protein L18, WD repeat and coiled-coil-containing protein C2orf44, Kanadaptin, Double-stranded RNA-binding protein Staufen homolog 2, F-box only protein 11, E3 ubiquitin-protein ligase CHFR, Heterogeneous nuclear ribonucleoprotein U-like protein 2, Cathepsin Z, MOB kinase activator 1A, Lysine-specific demethylase 5C, Lysine-specific demethylase 5A, Probable cation-transporting ATPase 13A4, Sentrin-specific protease 5, SRR1-like protein, Epidermal growth factor receptor kinase substrate 8, Cytoplasmic dynein 1 light intermediate chain 1, Zinc finger protein 619, Fatty acyl-CoA reductase 1, NHP2-like protein 1, RNA-binding protein 27, RNA-binding protein 26, Geranylgeranyl pyrophosphate synthase, Myosin phosphatase Rho-interacting protein, Protein kinase C delta-binding protein, Histidine triad nucleotide-binding protein 1, Interferon-related developmental regulator 1, GPI mannosyltransferase 3, Ubiquitin-like protein 7, Exportin-6, Male-specific lethal 3 homolog, Flap endonuclease 1, Elongation factor 1-alpha 1, COP9 signalosome complex subunit 3, HIG1 domain family member 2A, mitochondrial, 3-phosphoinositide-dependent protein kinase 1, Sodium-coupled neutral amino acid transporter 2, Intraflagellar transport protein 81 homolog, Cleavage and polyadenylation specificity factor subunit 3, Centrosomal protein of 57 kDa, Interferon-stimulated gene 20 kDa protein, DNA-directed RNA polymerase II subunit RPB2, Protein kintoun, Leucine-rich repeat-containing protein 20, Probable 18S rRNA (guanine-N(7))-methyltransferase, Heterogeneous nuclear ribonucleoprotein A3, Transmembrane protein 263, Glutathione S-transferase P, Adenylosuccinate lyase, ER membrane protein complex subunit 1, JmjC domain-containing protein 8, AN1-type zinc finger protein 5, Cullin-3, MICOS complex subunit MIC27, Selenoprotein H, Centromere protein H, Beta-hexosaminidase subunit alpha, Zinc phosphodiesterase ELAC protein 2, BRCA1-A complex subunit BRE, SRSF protein kinase 1, Insulin-like growth factor 2 mRNA-binding protein 2, Coiled-coil domain-containing protein 85B, Centrosomal protein of 55 kDa, COMM domain-containing protein 4, 14-3-3 protein theta, Armadillo repeat-containing X-linked protein 3, Uncharacterized protein C6orf226, DNA-directed RNA polymerase I subunit RPA1, Syntaxin-binding protein 1, Small nuclear ribonucleoprotein Sm D2, T-complex protein 1 subunit delta, Nucleophosmin, Serine/arginine repetitive matrix protein 2, PC4 and SFRS1-interacting protein, Nardilysin (N-arginine dibasic convertase), isoform CRA_d, Ragulator complex protein LAMTOR4, Golgin subfamily B member 1, E3 SUMO-protein ligase PIAS3, Prohibitin, Maspardin, Chromodomain-helicase-DNA-binding protein 6, V-type proton ATPase subunit D, Taperin, Coronin-1C, Importin subunit alpha-4, Pre-mRNA-processing factor 19, Single-stranded DNA-binding protein, mitochondrial, Vacuolar protein sorting-associated protein 33A, STAGA complex 65 subunit gamma, F-box only protein 38, Protein C-ets-1, DNA repair endonuclease XPF, Clathrin light chain A, Inhibitor of growth protein 4, Protein zer-1 homolog, Apolipoprotein L2, Serine/Arginine-related protein 53, Transcription initiation factor IIB, Ras suppressor protein 1, V-type proton ATPase 116 kDa subunit a isoform 1, Scavenger receptor class B member 1, Importin-11, Periodic tryptophan protein 1 homolog, Sequestosome-1, DNA replication licensing factor MCM6, Lupus La protein, 40S ribosomal protein S2, DNA-directed RNA polymerases I, II, and III subunit RPABC4, Dual specificity protein kinase CLK3, Mitochondrial import inner membrane translocase subunit TIM50, Cyclin-dependent kinase 7, Interleukin enhancer-binding factor 3, Poly(U)-binding-splicing factor PUF60, Fc receptor-like A, Heterogeneous nuclear ribonucleoprotein H, Nucleolar complex protein 2 homolog, DNA topoisomerase 1, Eukaryotic initiation factor 4A-II, Inner centromere protein, ZW10 interactor, Epsilon-sarcoglycan, Protein disulfide-isomerase A6, Transcription factor E2F7, GDP-L-fucose synthase, Runt-related transcription factor 3, Chromodomain-helicase-DNA-binding protein 4, SRA stem-loop-interacting RNA-binding protein, mitochondrial, Poly [ADP-ribose] polymerase 9, Zinc finger protein 451, Coatomer subunit zeta-1, Eukaryotic translation initiation factor 4B, Death-associated protein kinase 3, Leucine-rich repeat-containing protein 47, Guanylate-binding protein 1, Actin-related protein 2/3 complex subunit 1B, Proteasome maturation protein, Probable ATP-dependent RNA helicase DDX41, General vesicular transport factor p115, SH2 domain-containing protein 3C, Polyadenylate-binding protein-interacting protein 1, Histone H3.1, Probable ATP-dependent RNA helicase DDX6, Poly(rC)-binding protein 1, Steroid hormone receptor ERR1, Cytoskeleton-associated protein 4, Integrin beta-7, Eukaryotic translation initiation factor 3 subunit A, F-box only protein 7, GPN-loop GTPase 2, Melanoma-associated antigen 12, Basic leucine zipper and W2 domain-containing protein 2, Stomatin-like protein 3, Condensin complex subunit 1, Septin-11, Glutamine-dependent NAD(+) synthetase, Mitogen-activated protein kinase kinase kinase 5, Ubiquitin-like modifier-activating enzyme 1, Disco-interacting protein 2 homolog B, HLA class I histocompatibility antigen, A-24 alpha chain, Integrator complex subunit 2, UPF0428 protein CXorf56, MMS19 nucleotide excision repair protein homolog, AF4/FMR2 family member 4, Ras-related C3 botulinum toxin substrate 1, Bone morphogenetic protein receptor type-1B, Multiple epidermal growth factor-like domains protein 8, Keratin, type II cytoskeletal 1, Tumor suppressor candidate 3, Rho GTPase-activating protein 24, Nuclear nucleic acid-binding protein C1 D, Pecanex-like protein 1, Melanoma antigen preferentially expressed in tumors, RNA exonuclease 4, YTH domain-containing family protein 2, Probable bifunctional methylenetetrahydrofolate dehydrogenase/cyclohydrolase 2, HLA class I histocompatibility antigen, A-29 alpha chain, Ubiquitin-like protein ISG15, N-acetyltransferase 8, Protein prune homolog 2, Phosphatidylinositol 4,5-bisphosphate 3-kinase catalytic subunit delta isoform, Glutathione peroxidase 1, Dermokine, PRELI domain-containing protein 1, mitochondrial, Putative WAS protein family homolog 3, Mitochondrial import inner membrane translocase subunit Tim23, SLAM family member 6, Probable ubiquitin carboxyl-terminal hydrolase FAF-Y, Annexin A3, Microtubule-associated protein 1B, Glyoxylate reductase/hydroxypyruvate reductase, 40S ribosomal protein S4, Y isoform 1, Probable ATP-dependent RNA helicase DDX4, EH domain-containing protein 2, Ubiquitin carboxyl-terminal hydrolase 45, Trinucleotide repeat-containing gene 18 protein, Aldo-keto reductase family 1 member C1, Protein phosphatase 1 regulatory subunit 35, Frizzled-2, E3 ubiquitin-protein ligase HECTD1, V-type proton ATPase subunit S1, Peroxisomal membrane protein PEX16, Pro-interleukin-16, Amidophosphoribosyltransferase, Hsc70-interacting protein, YEATS domain-containing protein 2, Protein arginine N-methyltransferase 1, Cyclic AMP-responsive element-binding protein 3-like protein 2, Solute carrier family 25 member 46, General transcription factor II-I, 40S ribosomal protein S30, 2'-5'-oligoadenylate synthase 1, NADH dehydrogenase [ubiquinone] 1 alpha subcomplex subunit 1, Reticulocalbin-1, S-adenosylmethionine synthase isoform type-1, Membralin, Dynamin-like 120 kDa protein, mitochondrial, Growth hormone-inducible transmembrane protein, Heat shock-related 70 kDa protein 2, Eukaryotic translation initiation factor 3 subunit B, Ras-specific guanine nucleotide-releasing factor 1, Voltage-dependent anion-selective channel protein 2, Protein unc-13 homolog D, Golgi apparatus protein 1, Eukaryotic translation initiation factor 6, Probable ribonuclease ZC3H12D, Ragulator complex protein LAMTOR1, Ribonucleoside-diphosphate reductase subunit M2 B, Zinc finger protein 638, B- and T-lymphocyte attenuator, CD44 antigen, Cordon-bleu protein-like 1, C—C chemokine receptor type 7, Ragulator complex protein LAMTOR3, IgG receptor FcRn large subunit p51, Serine/threonine-protein kinase LATS1, E3 ubiquitin-protein ligase CHIP, T-cell activation Rho GTPase-activating protein, Platelet endothelial cell adhesion molecule, TBC1 domain family member 22A, Endoplasmic reticulum resident protein 44, Lipolysis-stimulated lipoprotein receptor, Glucose-6-phosphate isomerase, Cystatin-C, Ras-related protein Rab-11A, Cadherin EGF LAG seven-pass G-type receptor 1, Tumor protein p53-inducible protein 11, Short-chain dehydrogenase/reductase 3, Probable ribosome biogenesis protein RLP24, Ceruloplasmin, Ceramide glucosyltransferase, Dystrophin, Uncharacterized protein CXorf21, MyoD family inhibitor domain-containing protein, Obscurin-like protein 1, Beta-1,4-galactosyltransferase 1, Plasma membrane calcium-transporting ATPase 1, Vesicle-associated membrane protein 3, Protein CDV3 homolog, Peroxiredoxin-1, Methyltransferase-like protein 7A, HLA class II histocompatibility antigen, DO beta chain, Receptor-type tyrosine-protein phosphatase alpha, ATP-binding cassette sub-family A member 6, 14-3-3 protein beta/alpha, Glycosyltransferase 8 domain-containing protein 1, Serine incorporator 3, NACHT, LRR and PYD domains-containing protein 2, Baculoviral IAP repeat-containing protein 5, Alpha-mannosidase 2, DnaJ homolog subfamily C member 5, Fas apoptotic inhibitory molecule 3, HLA class II histocompatibility antigen, DM alpha chain, Heterogeneous nuclear ribonucleoprotein A1-like 2, Transcription regulator protein BACH2, Zinc finger protein 107, Probable ATP-dependent RNA helicase DDX46, Kynureninase, Interleukin-4 receptor subunit alpha, Polypeptide N-acetylgalactosaminyltransferase 1, Fibromodulin, Pericentriolar material 1 protein, 60S ribosomal protein L3, Glycosylphosphatidylinositol anchor attachment 1 protein, AT-rich interactive domain-containing protein 5B, Carbohydrate sulfotransferase 2, Kelch-like ECH-associated protein 1, DmX-like protein 1, 14-3-3 protein zeta/delta, Plexin-B3, Elongation factor Tu, mitochondrial, Protocadherin-9, Monoglyceride lipase, Afadin- and alpha-actinin-binding protein, Platelet glycoprotein 4, Transmembrane protein C16orf54, Cullin-associated NEDD8-dissociated protein 1, Proline and serine-rich protein 2, Pro-cathepsin H, RUN and FYVE domain-containing protein 1, Neurofibromin, Leukosialin, Arrestin domain-containing protein 4, TP53-target gene 5 protein, Vitamin D-binding protein, Tumor necrosis factor receptor superfamily member 13C, Phosphate-regulating neutral endopeptidase, Interleukin-1 beta, Interleukin-17 receptor A, Putative heat shock 70 kDa protein 7, Cytochrome b ascorbate-dependent protein 3, Vesicle-associated membrane protein 1, Ras GTPase-activating protein nGAP, BRCA2 and CDKN1A-interacting protein, Rab GTPase-activating protein 1, Melanoma-associated antigen C2, C—C motif chemokine 3, Ig gamma-1 chain C region, Serum albumin, Basement membrane-specific heparan sulfate proteoglycan core protein, Protein phosphatase 1M, Guanine nucleotide-binding protein G(I)/G(S)/G(T) subunit beta-1, HLA class I histocompatibility antigen, A-23 alpha chain, Zinc finger protein ZPR1, Cytochrome c oxidase assembly factor 3 homolog, mitochondrial, Arf-GAP with Rho-GAP domain, ANK repeat and PH domain-containing protein 1, Keratin, type I cytoskeletal 9, Anion exchange protein 2, Tumor susceptibility gene 101 protein, A-kinase anchor protein 1, mitochondrial, 4-hydroxyphenylpyruvate dioxygenase-like protein, Nucleosome-remodeling factor subunit BPTF, Centrin-3, Uridine-cytidine kinase 2, Isovaleryl-CoA dehydrogenase, mitochondrial, Alkyldihydroxyacetonephosphate synthase, peroxisomal, Polyadenylate-binding protein 4, Polyadenylate-binding protein 3, Bromodomain adjacent to zinc finger domain protein 2B, Protein unc-45 homolog A, Iron-sulfur cluster assembly 2 homolog, mitochondrial, ATP-dependent RNA helicase DHX36, Multidrug resistance protein 1, WD repeat-containing protein 11, Serine-rich coiled-coil domain-containing protein 2, Protein KRI1 homolog, Centrosomal protein of 192 kDa, Zinc finger protein 829, Protein kinase C-binding protein 1, AT-rich interactive domain-containing protein 1A, Msx2-interacting protein, Long-chain-fatty-acid-CoA ligase 1, Intercellular adhesion molecule 3, Treacle protein, Cytochrome c oxidase subunit 7A2, mitochondrial, HLA class I histocompatibility antigen, Cw-5 alpha chain, HLA class I histocompatibility antigen, B-55 alpha chain, Dihydropyrimidinase-related protein 2, Deoxyuridine 5'-triphosphate nucleotidohydrolase, mitochondrial, Translocon-associated protein subunit alpha, Endoplasmic reticulum resident protein 29, Lysosomal alpha-glucosidase, Armadillo repeat-containing protein 8, Pre-rRNA-processing protein TSR1 homolog, Protein FAM98B, 40S ribosomal protein S28, Rab GDP dissociation inhibitor alpha, Lysosome-associated membrane glycoprotein 2, Menin, Uncharacterized protein C1orf131, Protein MON2 homolog, Major facilitator superfamily domain-containing protein 10, Protein CNPPD1, E3 ubiquitin-protein ligase MYCBP2, NEDD4 family-interacting protein 1, Inositol hexakisphosphate kinase 2, Translocon-associated protein subunit delta, Cleavage and polyadenylation specificity factor subunit 5, Zinc finger protein 281, Calpain-1 catalytic subunit, Copine-1, Ornithine decarboxylase antizyme 1, ER degradation-enhancing alpha-mannosidase-like protein 1, Nuclear envelope integral membrane protein 1, ER membrane protein complex subunit 4, 60S ribosomal protein L17, Charged multivesicular body protein 2a, Pre-mRNA cleavage complex 2 protein Pcf11, Myosin-7, NADH dehydrogenase [ubiquinone] 1 beta subcomplex subunit 5, mitochondrial, Protein diaphanous homolog 3, Cytochrome b-c1 complex subunit 8, Intron-binding protein aquarius, Serine/threonine-protein kinase 38, 39S ribosomal protein L43, mitochondrial, Protein diaphanous homolog 1, 60S ribosomal protein L37, Vacuolar protein sorting-associated protein 4A, COMM domain-containing protein 3, POTE ankyrin domain family member E, TAR DNA-binding protein 43, Hemoglobin subunit delta, Ubiquitin-conjugating enzyme E2 D2, CDK5 regulatory subunit-associated protein 1, Nuclear export mediator factor NEMF, Late secretory pathway protein AVL9 homolog, Elongation factor 1-beta, Poly(A) RNA polymerase GLD2, Little elongation complex subunit 2, Modulator of apoptosis 1, Zinc finger protein 24, G1/S-specific cyclin-E2, Signal peptidase complex subunit 1, Lon protease homolog, mitochondrial, Deoxynucleotidyltransferase terminal-interacting protein 1, Retinoblastoma-like protein 2, Cullin-4B, DDB1- and CUL4-associated factor 8, Zyxin, Protein SDA1 homolog, Muscleblind-like protein 3, U6 snRNA-associated Sm-like protein LSm7, RuvB-like 1, Calcium-binding protein 39-like, Small subunit processome component 20 homolog, Mitochondrial-processing peptidase subunit alpha, DNA ligase 1, Gamma-aminobutyric acid receptor-associated protein-like 1, Translocating chain-associated membrane protein 1, NADH dehydrogenase [ubiquinone] iron-sulfur protein 5, Heme oxygenase 2, WD repeat-containing protein 35, NADH dehydrogenase [ubiquinone] 1 alpha subcomplex subunit 12, Nuclear factor erythroid 2-related factor 3, Rho GTPase-activating protein 1, Tubulin alpha-1C chain, Sorting nexin-4, CWF19-like protein 1, Methionine-tRNA ligase, cytoplasmic, Nuclease-sensitive element-binding protein 1, pre-mRNA 3' end processing protein WDR33, Fatty acid desaturase 2, Surfeit locus protein 4, Protein BIVM-ERCC5, Interferon-induced helicase C domain-containing protein 1, Suppressor of fused homolog, Astrocytic phosphoprotein PEA-15, Protein ELYS, Solute carrier family 23 member 2, Splicing factor 3B subunit 5, Lymphokine-activated killer T-cell-originated protein kinase, Signal transducer and activator of transcription 2, Zinc finger protein 280C, Peroxisomal acyl-coenzyme A oxidase 3, Oxidative stress-induced growth inhibitor 2, Iron-responsive element-binding protein 2, StAR-related lipid transfer protein 7, mitochondrial, F-actin-capping protein subunit alpha-2, Mitochondrial folate transporter/carrier, Protein-lysine N-methyltransferase METTL10, Cytochrome c oxidase subunit 4 isoform 1, mitochondrial, Guanine nucleotide-binding protein-like 3-like protein, Rho-related BTB domain-containing protein 1, Pre-mRNA-splicing factor SPF27, Serine/arginine-rich splicing factor 1, Ribosome biogenesis protein BMS1 homolog, BRCA1-associated protein, Lipopolysaccharide-induced tumor necrosis factor-alpha factor, TraB domain-containing protein, Phosphatidylinositol 4-kinase alpha, Microsomal glutathione S-transferase 3, Prolyl endopeptidase, Vacuolar protein sorting-associated protein 41 homolog, GTPase-activating protein and VPS9 domain-containing protein 1, 26S proteasome non-ATPase regulatory subunit 4, Protein SDE2 homolog, ADP-ribosylation factor 5, Regulation of nuclear pre-mRNA domain-containing protein 2, ADP/ATP translocase 3, 60S ribosomal protein L36, Myotrophin, Protein PRRC2A, NSFL1 cofactor p47, Interferon regulatory factor 2-binding protein 1, Serine/threonine-protein kinase 4, S-formylglutathione hydrolase, E3 ubiquitin/ISG15 ligase TRIM25, Omega-amidase NIT2, COP9 signalosome complex subunit 8, Asparagine-tRNA ligase, cytoplasmic, Glucose-6-phosphate 1-dehydrogenase, Transgelin-2, Malignant T-cell-amplified sequence 1, Synaptic vesicle membrane protein VAT-1 homolog, Calnexin, Parafibromin, Transcription factor 12, Extended synaptotagmin-1, Spectrin beta chain, non-erythrocytic 4, COX assembly mitochondrial protein 2 homolog, Lymphocyte cytosolic protein 2, DNA polymerase epsilon subunit 3, Sorting nexin-1, BAG family molecular chaperone regulator 3, Beta-enolase, RNA-binding protein 4, Destrin, Eukaryotic translation initiation factor 1A, Y-chromosomal, 5'-3' exoribonuclease 2, Nucleoporin SEH1, Reticulon-4, 26S protease regulatory subunit 6A, Heat shock 70 kDa protein 4L, Cytoskeleton-associated protein 2, Coiled-coil domain-containing protein 124, Serine-threonine kinase receptor-associated protein, 26S proteasome non-ATPase regulatory subunit 12, Ataxin-3, Polyglutamine-binding protein 1, Transcriptional repressor p66-alpha, Paired amphipathic helix protein Sin3a, Ribose-5-phosphate isomerase, Transmembrane and coiled-coil domain-containing protein 1, Dynein light chain roadblock-type 1, Rho guanine nucleotide exchange factor 1, Isocitrate dehydrogenase [NADP] cytoplasmic, Trifunctional enzyme subunit alpha, mitochondrial, Cleavage stimulation factor subunit 2, Telomeric repeat-binding factor 2-interacting protein 1, RNA-binding protein FUS, Far upstream element-binding protein 3, TATA-binding protein-associated factor 2N, Prosaposin, Myb-binding protein 1A, Barrier-to-autointegration factor, Signal recognition particle subunit SRP68, Protein FAM219A, Tripeptidyl-peptidase 1, HLA class I histocompatibility antigen, B-38 alpha chain, Proteasome subunit beta type-7, Neudesin, Tubulin beta-6 chain, Actin-related protein 2/3 complex subunit 3, Solute carrier family 35 member F5, Myoferlin, HLA class I histocompatibility antigen, B-44 alpha chain, Fructose-bisphosphate aldolase B, Neutral cholesterol ester hydrolase 1, FERM domain-containing protein 6, Cyclic AMP-dependent transcription factor ATF-4, Transcription factor AP-1, Growth arrest and DNA damage-inducible protein GADD45 alpha, Probable C-mannosyltransferase DPY19L4, Integrin alpha-3, Protein transport protein Sec61 subunit alpha isoform 2, Rho GTPase-activating protein 7, Exosome complex component RRP42, WD repeat-containing protein 48, Protein LDOC1, BTB/POZ domain-containing protein KCTD4, DNA-binding protein SATB2, Tribbles homolog 3, Small nuclear ribonucleoprotein E, SH3 domain-binding glutamic acid-rich-like protein 3, HLA class II histocompatibility antigen, DRB1-4 beta chain, HLA class I histocompatibility antigen, Cw-4 alpha chain, Fatty acid-binding protein, liver, Polymeric immunoglobulin receptor, DAZ-associated protein 2, Lck-interacting transmembrane adapter 1, Cysteine-rich protein 2-binding protein, Bifunctional 3'-phosphoadenosine 5'-phosphosulfate synthase 2, Bifunctional 3'-phosphoadenosine 5'-phosphosulfate synthase 1, Phosphatidylinositol 5-phosphate 4-kinase type-2 alpha, Calsyntenin-3, Ras-related protein Rab-20, Structure-specific endonuclease subunit SLX4, Myosin regulatory light polypeptide 9, Centrosome-associated protein 350, StAR-related lipid transfer protein 5, WASH complex subunit 7, Lysocardiolipin acyltransferase 1, Puromycin-sensitive aminopeptidase-like protein, Myocyte-specific enhancer factor 2D, Ribosomal RNA processing protein 36 homolog, G1/S-specific cyclin-D3, Dipeptidyl peptidase 1, Histone acetyltransferase KAT6A, Putative ATP-dependent RNA helicase DHX57, Histone-arginine methyltransferase CARM 1, Myosin regulatory light chain 12A, Cytochrome c oxidase subunit NDUFA4, Ras-related protein Rab-5B, Dermcidin, RING finger and transmembrane domain-containing protein 2, Inositol 1,4,5-trisphosphate receptor type 3, E3 ubiquitin-protein ligase TRIM56, DNA repair protein complementing XP-C cells, HLA class I histocompatibility antigen, B-35 alpha chain, Ubiquitin-conjugating enzyme E2 C, Bardet-Biedl syndrome 2 protein, Protein S100-A8, Zinc finger protein 608, BTB/POZ domain-containing protein KCTD1, RNA-binding protein with serine-rich domain 1, Laminin subunit beta-3, UDP-N-acetylglucosamine-dolichyl-phosphate N-acetylglucosaminephosphotransferase, DAZ-associated protein 1, Ribosomal protein S6 kinase alpha-1, Type II inositol 3,4-bisphosphate 4-phosphatase, Zinc finger CCHC domain-containing protein 14, Prefoldin subunit 5, Protein prenyltransferase alpha subunit repeat-containing protein 1, Peroxisomal membrane protein PEX14, Protein FAM134C, Dolichol kinase, Eukaryotic peptide chain release factor subunit 1, Cyclin-H, Phosphorylated CTD-interacting factor 1, Golgi-associated PDZ and coiled-coil motif-containing protein, Protein farnesyltransferase/geranylgeranyltransferase type-1 subunit alpha, SPRY domain-containing protein 3, Platelet-activating factor acetylhydrolase IB subunit alpha, Elongation factor Tu GTP-binding domain-containing protein 1, Protein RMD5 homolog B, Probable E3 ubiquitin-protein ligase HECTD4, KIF1-binding protein, CDNA FLJ25829 fis, clone TST08126, Heat shock protein beta-1, Serpin B12, S1 RNA-binding domain-containing protein 1, Agrin, Abhydrolase domain-containing protein 2, Muskelin, DNA polymerase delta catalytic subunit, Zinc finger protein 419, Angiomotin, Protein Smaug homolog 2, N-acetylgalactosamine-6-sulfatase, Probable C-mannosyltransferase DPY19L3, Src substrate cortactin, Signal peptidase complex catalytic subunit SEC11A, Matrin-3, NFX1- type zinc finger-containing protein 1, UPF0505 protein C16orf62, DNA damage-regulated autophagy modulator protein 2, Semaphorin-4C, Niemann-Pick C1 protein, Transmembrane 9 superfamily member 2, Cyclin-dependent kinase 19, Probable glutamate-tRNA ligase, mitochondrial, Chondroitin sulfate proteoglycan 4, Peroxisomal carnitine O-octanoyltransferase, WD repeat-containing protein 44, Cytochrome c oxidase subunit 1, Regulator of microtubule dynamics protein 1, GPI transamidase component PIG-S, Ubiquitin-protein ligase E3C, Transcription elongation regulator 1, Sorting nexin-9, N-acetylglucosamine-6-sulfatase, Thymosin beta-4, Integral membrane protein GPR155, Intraflagellar transport protein 122 homolog, Calponin-3, Inactive hydroxysteroid dehydrogenase-like protein 1, Calcyclin-binding protein, F-box only protein 31, MORN repeat-containing protein 1, Leukocyte receptor cluster member 8, Serine/threonine-protein kinase NLK, Histone acetyltransferase KAT6B, Protein FAM26F, MORN repeat-containing protein 2, Probable ATP-dependent RNA helicase YTHDC2, Leucine-rich repeat-containing protein 1, Sphingomyelin phosphodiesterase 2, Myosin regulatory light chain 12B, Sorting nexin-6, Peptidyl-prolyl cis-trans isomerase-like 2, Nucleolar GTP-binding protein 2, Serine/threonine-protein kinase MRCK alpha, 2-oxoisovalerate dehydrogenase subunit alpha, mitochondrial, Structural maintenance of chromosomes protein 1A, Ubiquitin-like modifier-activating enzyme 6, SAFB-like transcription modulator, Putative heat shock protein HSP 90-beta 2, Ubiquitin-like protein 3, Kelch repeat and BTB domain-containing protein 6, WD repeat-containing protein 81, DDB1- and CUL4-associated factor 13, T-complex protein 11-like protein 1, Aspartate-tRNA ligase, cytoplasmic, MAP kinase-activated protein kinase 2, Thyroid receptor-interacting protein 11, Clusterin-associated protein 1, Ubiquitin carboxyl-terminal hydrolase 32, Low-density lipoprotein receptor class A domain-containing protein 3, Homeodomain-interacting protein kinase 2, Zinc finger protein 318, E3 ubiquitin-protein ligase BRE1B, O-acetyl-ADP-ribose deacetylase 1, Coiled-coil domain-containing protein 141, Endoribonuclease Dicer, EVI5-like protein, MAP kinase-interacting serine/threonine-protein kinase 2, Nicotinamide phosphoribosyltransferase, Fibronectin type III domain-containing protein 3B, Alpha-catulin, TOX high mobility group box family member 4, Nuclear factor of activated T-cells 5, Elongator complex protein 5, Protein FAM13A, Transcription factor E2F3, Tubulin-specific chaperone cofactor E-like protein, Phospholipid scramblase 4, Complex I intermediate-associated protein 30, mitochondrial, Replication protein A 70 kDa DNA-binding subunit, Adenylyl cyclase-associated protein 1, Protein arginine N-methyltransferase 7, LIM domain kinase 2, NADPH-cytochrome P450 reductase, Peptidyl-prolyl cis-trans isomerase D, Ankyrin repeat and IBR domain-containing protein 1, Small G protein signaling modulator 2, Protein-glutamate O-methyltransferase, Zinc transporter 5, Peptidyl-prolyl cis-trans isomerase FKBP8, Eyes absent homolog 3, Nicotinamide riboside kinase 1, PCNA-interacting partner, Beta-mannosidase, Probable ATP-dependent RNA helicase DDX17, Synergin gamma, Kremen protein 2, Guanine nucleotide exchange factor VAV3, DNA polymerase zeta catalytic subunit, Histone acetyltransferase type B catalytic subunit, Interferon regulatory factor 2-binding protein-like, Protein YIF1B, Ubiquitin carboxyl-terminal hydrolase 8, Group XV phospholipase A2, Probable C-mannosyltransferase DPY19L1, Probable E3 ubiquitin-protein ligase HERC1, Iduronate 2-sulfatase, Type 2 lactosamine alpha-2,3-sialyltransferase, Protein FAM65B, Protein RCC2, DNA ligase 3, FAS-associated factor 1, Geranylgeranyl transferase type-2 subunit alpha, CLIP-associating protein 2, Zinc finger protein 746, G patch domain and KOW motifs-containing protein, Retinoid-inducible serine carboxypeptidase, Kelch-like protein 15, Trafficking protein particle complex subunit 3, Xaa-Pro aminopeptidase 1, PMS1 protein homolog 1, SEC23-interacting protein, Syndetin, CDK5 regulatory subunit-associated protein 3, Endophilin-B1, GON-4-like protein, MHC class I polypeptide-related sequence A, Zinc finger protein with KRAB and SCAN domains 5, Zinc finger CW-type PWWP domain protein 1, Conserved oligomeric Golgi complex subunit 6, Unconventional myosin-Va, N6-adenosine-methyltransferase 70 kDa subunit, Arylamine N-acetyltransferase 1, CD82 antigen, Lathosterol oxidase, Synembryn-B, Mitochondrial enolase superfamily member 1, Serine/threonine-protein kinase N2, Hermansky-Pudlak syndrome 1 protein, Protein 4.1, Lysine-specific demethylase 2A, TP53-regulating kinase, Tubulin beta-4B chain, Integrin alpha-V, Protein disulfide-isomerase A5, Oligoribonuclease, mitochondrial, Protein furry homolog-like, N-alpha-acetyltransferase 16, NatA auxiliary subunit, Trophinin, Vacuolar protein sorting-associated protein 13C, F-box/LRR-repeat protein 14, F-box/LRR-repeat protein 17, Transmembrane protein 218, Protein unc-13 homolog B, RNA-binding protein Raly, Interferon-induced protein with tetratricopeptide repeats 1, Mitochondrial import receptor subunit TOM70, RNA polymerase II-associated factor 1 homolog, Cytokine receptor-like factor 3, Cytosol aminopeptidase, Protein zyg-11 homolog B, N-acetylglucosamine-1-phosphotransferase subunits alpha/beta, Protein transport protein Sec61 subunit alpha isoform 1, Mitogen-activated protein kinase kinase kinase 7, Intraflagellar transport protein 43 homolog, Zinc finger protein 627, Zinc finger protein 614, Zinc finger protein 324B, S100P-binding protein, Early endosome antigen 1, Phospholipid scramblase 1, Sialidase-1, Inhibitor of nuclear factor kappa-B kinase subunit beta, Deoxyribose-phosphate aldolase, Rho-related BTB domain-containing protein 3, Ribosomal protein S6 kinase delta-1, Nucleoporin NDC1, Importin-7, Cyclin-dependent kinase 2-associated protein 1, PAS domain-containing serine/threonine-protein kinase, Vacuolar protein sorting-associated protein 18 homolog, Transmembrane and TPR repeat-containing protein 3, Alpha/beta hydrolase domain-containing protein 17B, Immediate early response gene 5-like protein, Casein kinase II subunit alpha', DNA excision repair protein ERCC-6-like 2, 3'(2'),5'-bisphosphate nucleotidase 1, MAP kinase-activating death domain protein, Dynactin subunit 2, Mucosa-associated lymphoid tissue lymphoma translocation protein 1, Putative deoxyribonuclease TATDN1, Interferon regulatory factor 3, Tubulin polyglutamylase complex subunit 2, Regulator of microtubule dynamics protein 3, Probable histidine-tRNA ligase, mitochondrial, 39S ribosomal protein L52, mitochondrial, Tectonin beta-propeller repeat-containing protein 2, 7SK snRNA methylphosphate capping enzyme, Proline-rich nuclear receptor coactivator 1, Ubiquinone biosynthesis protein COQ9, mitochondrial, Clustered mitochondria protein homolog, Dexamethasone-induced protein, Semaphorin-4F, Fatty acid-binding protein, epidermal, Acylamino-acid-releasing enzyme, Zinc finger MYM-type protein 4, YTH domain-containing family protein 3, A-kinase anchor protein 6, Lambda-crystallin homolog, Telomerase protein component 1, DNA helicase B, Presenilin-1, Zinc finger protein 428, NF-kappa-B-repressing factor, Probable ATP-dependent RNA helicase DHX35, Prolyl 3-hydroxylase OGFOD1, N-alpha-acetyltransferase 20, E3 ubiquitin-protein ligase RNF135, Thrombospondin-3, NADH-ubiquinone oxidoreductase chain 5, 52 kDa repressor of the inhibitor of the protein kinase, Homeodomain-interacting protein kinase 1, Serine/threonine-protein kinase R103, YY1-associated protein 1, Myosin-14, LIM domain and actin-binding protein 1, Zinc finger protein 462, Protein YIPF5, Putative SMEK homolog 3, Charged multivesicular body protein 4b, Microphthalmia-associated transcription factor, Unhealthy ribosome biogenesis protein 2 homolog, Probable 28S rRNA (cytosine-C(5))-methyltransferase, Vesicle-associated membrane protein 7, Leucyl-cystinyl aminopeptidase, Mitogen-activated protein kinase kinase kinase kinase 2, GRAM domain-containing protein 4, Nuclear factor erythroid 2-related factor 1, Uncharacterized protein KIAA2013, Lysophospholipid acyltransferase LPCAT4, Actin-related protein 6, Hepatocyte growth factor-regulated tyrosine kinase substrate, Zinc finger protein 74, Phosphofurin acidic cluster sorting protein 1, PH domain leucine-rich repeat-containing protein phosphatase 2, HMG box-containing protein 1, Aryl hydrocarbon receptor, LIM and SH3 domain protein 1, E3 ubiquitin-protein ligase synoviolin, Vacuolar protein sorting-associated protein 13D, Ubiquitin carboxyl-terminal hydrolase 25, RNA polymerase-associated protein CTR9 homolog, Charged multivesicular body protein 7, RAB6A-GEF complex partner protein 2, UDP-glucose:glycoprotein glucosyltransferase 1, DNA-directed RNA polymerase II subunit RPB9, Nitric oxide synthase, endothelial, Peptidyl-prolyl cis-trans isomerase FKBP3, Ubiquitin carboxyl-terminal hydrolase 15, WASH complex subunit strumpellin, Selenocysteine insertion sequence-binding protein 2-like, Nuclear cap-binding protein subunit 2, Methyltransferase-like protein 22, F-box only protein 9, DmX-like protein 2, Ectonucleotide pyrophosphatase/phosphodiesterase family member 2, Creatine kinase B-type, Protein FAM91A1, Paired box protein Pax-3, Integrin beta-3, Protein SEC13 homolog, Histone-lysine N-methyltransferase SETDB2, Scm-like with four MBT domains protein 1, Forkhead box protein M1, Protein kinase C and casein kinase substrate in neurons protein 2, Clathrin interactor 1, Protein FAM189B, Nuclear receptor-interacting protein 1, Centriole, cilia and spindle-associated protein, Ubiquitin carboxyl-terminal hydrolase 38, Recombining binding protein suppressor of hairless, Holliday junction recognition protein, Integrin alpha-5, Immunoglobulin superfamily member 8, Signal-induced proliferation-associated 1-like protein 1, Eukaryotic translation initiation factor 2A, Mitochondrial import inner membrane translocase subunit Tim17-A, Protein strawberry notch homolog 1, Splicing factor 3B subunit 6, Glutamine-tRNA ligase, BRCA2-interacting transcriptional repressor EMSY, E3 SUMO-protein ligase NSE2, Retinal dehydrogenase 1, Alpha-N-acetylglucosaminidase, E3 SUMO-protein ligase RanBP2, Endoplasmic reticulum metallopeptidase 1, Leucine-rich repeat flightless-interacting protein 1, Uncharacterized protein C15orf41, High affinity cAMP-specific and IBMX-insensitive 3',5'-cyclic phosphodiesterase 8A, Sodium/potassium-transporting ATPase subunit alpha-2, Neuroplastin, Leukotriene A-4 hydrolase, DNA-directed RNA polymerases I and III subunit RPAC1, Mitotic spindle assembly checkpoint protein MAD2A, Exosome complex component RRP4, SET domain-containing protein 4, Transmembrane protein 70, mitochondrial, Mitotic spindle assembly checkpoint protein MAD1, Akirin-2, BCL2/adenovirus E1B 19 kDa protein-interacting protein 2, U3 small nucleolar RNA-associated protein 15 homolog, Fascin, Proteasome subunit alpha type-7, 14-3-3 protein epsilon, Spindlin-3, LETM1 and EF-hand domain-containing protein 1, mitochondrial, Nucleolar protein 14, Ubiquitin-conjugating enzyme E2 Z, Elongator complex protein 1, DNA repair protein XRCC4, Importin-5, Splicing factor 1, Phosphatidylinositol 4-phosphate 3-kinase C2 domain-containing subunit beta, Acetyl-coenzyme A transporter 1, Zinc finger protein 275, E3 ubiquitin-protein ligase HACE1, AT-rich interactive domain-containing protein 2, Tetraspanin-33, Peroxisome assembly factor 2, Oral-facial-digital syndrome 1 protein, Nuclear factor of activated T-cells, cytoplasmic 1, TBC1 domain family member 8, Protein MEF2BNB, Complex I assembly factor TMEM126B, mitochondrial, DNA polymerase delta subunit 3, Gamma-secretase subunit APH-1A, Bcl-2-modifying factor, Epididymis-specific alpha-mannosidase, Ras association domain-containing protein 3, Uncharacterized protein C15orf61, Spindlin-1, Cholinesterase, Acetyl-CoA carboxylase 1, Transmembrane protein 87A, Lysyl oxidase homolog 3, SWI/SNF-related matrix-associated actin-dependent regulator of chromatin subfamily E member 1-related, Prostamide/prostaglandin F synthase, E3 ubiquitin-protein ligase TRIM4, MAGUK p55 subfamily member 2, Far upstream element-binding protein 1, Dimethylaniline monooxygenase [N-oxide-forming] 4, Dihydropyrimidine dehydrogenase [NADP(+)], Spermatogenesis-associated protein 20, AN1-type zinc finger protein 6, YTH domain-containing family protein 1, SUN domain-containing protein 2, 45 kDa calcium-binding protein, Integrator complex subunit 6, Protein Lines homolog 1, Proline-rich protein 7, Zinc finger MIZ domain-containing protein 2, RNA-binding protein 5, Serine/arginine-rich splicing factor 10, Tetraspanin-4, Ribosomal RNA small subunit methyltransferase NEP1, Presenilin-2, Prolyl 3-hydroxylase 2, Mitogen-activated protein kinase kinase kinase 1, Coiled-coil domain-containing protein 121, Osteoclast-stimulating factor 1, 39S ribosomal protein L35, mitochondrial, UDP-N-acetylhexosamine pyrophosphorylase-like protein 1, RNA-binding protein 39, Thioredoxin-like protein AAED1, Eukaryotic translation initiation factor 3 subunit K, Protein timeless homolog, Zinc finger and BTB domain-containing protein 6, ATP-binding cassette sub-family A member 3, Vinculin, Microtubule-associated protein 1A, C-Jun-amino-terminal kinase-interacting protein 2, Plakophilin-2, 39S ribosomal protein L34, mitochondrial, Ras-related protein Rab-27A, Serine/threonine-protein kinase tousled-like 1, Protein S100-A4, Centriolin, Transcriptional repressor CTCF, Golgin subfamily A member 3, Death-inducer obliterator 1, Glycogen debranching enzyme, Transmembrane protein 181, A-kinase anchor protein 9, E3 ubiquitin-protein ligase MYLIP, Guanine nucleotide-binding protein G(i) subunit alpha-2, Peptidyl-prolyl cis-trans isomerase FKBP4, Metaxin-1, Uncharacterized protein KIAA1143, Disabled homolog 2, Serine/threonine-protein kinase tousled-like 2, Squamous cell carcinoma antigen recognized by T-cells 3, Natural resistance-associated macrophage protein 2, S-adenosyl-L-methionine-dependent tRNA 4-demethylwyosine synthase, Puromycin-sensitive aminopeptidase, Protocadherin gamma-A11, Eukaryotic peptide chain release factor GTP-binding subunit ERF3A, Protocadherin Fat 1, H(+)/Cl(−) exchange transporter 7, Zinc finger protein 407, Desmoplakin, Kelch-like protein 7, H(+)/Cl(−) exchange transporter 3, Protein phosphatase 1 regulatory subunit 3C, Interleukin-17 receptor C, Solute carrier family 22 member 18, Sodium/potassium-transporting ATPase subunit beta-1, ATP-binding cassette sub-family B member 8, mitochondrial, Sorbin and SH3 domain-containing protein 2, Histidine-tRNA ligase, cytoplasmic, Probable cation-transporting ATPase 13A2, Unconventional myosin-Ib, MAP/microtubule affinity-regulating kinase 3, NADH dehydrogenase [ubiquinone] flavoprotein 2, mitochondrial, Ceramide synthase 5, Transcription intermediary factor 1-beta, Arginine-tRNA ligase, cytoplasmic, Neurosecretory protein VGF, U8 snoRNA-decapping enzyme, Epididymal secretory protein E1, Phenylalanine-tRNA ligase alpha subunit, Zinc finger protein 536, Vascular endothelial growth factor A, Decapping and exoribonuclease protein, Glia-derived nexin, PITH domain-containing protein 1, Gamma-aminobutyric acid receptor subunit beta-3, Lysine-specific demethylase 3B, Protein diaphanous homolog 2, Nuclear protein localization protein 4 homolog, Aldehyde dehydrogenase family 1 member A3, Ubiquitin-like protein 5, Zinc finger BED domain-containing protein 5, Rho GTPase-activating protein 5, Tyrosine-protein phosphatase non-receptor type 1, ATP-dependent RNA helicase DDX18, Structural maintenance of chromosomes protein 2, Dihydropyrimidinase-related protein 1, Mitochondrial import receptor subunit TOM20 homolog, ADP-ribosylation factor 3, WD repeat-containing protein 26, Mitogen-activated protein kinase kinase kinase 3, Zinc finger protein 579, Uridine phosphorylase 1, MORF4 family-associated protein 1, Exocyst complex component 1, Keratin, type I cytoskeletal 10, Rho GTPase-activating protein 18, Mitotic checkpoint serine/threonine-protein kinase BUB1, Transmembrane protein 131, Ceramide synthase 6, MICOS complex subunit MIC25, E3 ubiquitin-protein ligase RNF114, JNK1/MAPK8-associated membrane protein, Coiled-coil domain-containing protein 14, Brefeldin A-inhibited guanine nucleotide-exchange protein 2, Exosome complex component MTR3, PR domain zinc finger protein 4, Protein CutA, Trafficking protein particle complex subunit 2-like protein, TGF-beta-activated kinase 1 and MAP3K7-binding protein 1, Cyclin-dependent kinase 2-associated protein 2, Wings apart-like protein homolog, Pre-mRNA-splicing factor ATP-dependent RNA helicase PRP16, Two pore calcium channel protein 1, DNA/RNA-binding protein KIN17, Ribonucleoprotein PTB-binding 1, Sterol regulatory element-binding protein 1, NADH dehydrogenase [ubiquinone] 1 alpha subcomplex assembly factor 4, Proline-rich nuclear receptor coactivator 2, Zinc finger protein 526, Protein Wiz, PHD finger protein 23, Carboxymethylenebutenolidase homolog, Protein phosphatase 1 regulatory subunit 15B, Putative PIP5K1A and PSMD4-like protein, Acyl-protein thioesterase 1, Alpha-1,2-mannosyltransferase ALG9, Ankyrin repeat domain-containing protein 10, Vesicle transport protein SEC20, Triple functional domain protein, Inositol hexakisphosphate and diphosphoinositol-pentakisphosphate kinase 1, Probable ATP-dependent RNA helicase DDX10, Zinc finger protein 292, Leucine-rich repeat and calponin homology domain-containing protein 3, Calcium-binding protein 39, Small integral membrane protein 15, Protein phosphatase 1A, ATP-dependent RNA helicase DHX29, Structural maintenance of chromosomes protein 6, Caldesmon, REST corepressor 1, Calmodulin-like protein 4, F-box/WD repeat-containing protein 5, Zinc finger RNA-binding protein, L-aminoadipate-semialdehyde dehydrogenase-phosphopantetheinyl transferase, Hom s 5, Harmonin, tRNA selenocysteine 1-associated protein 1, Vacuolar protein sorting-associated protein 35, Argininosuccinate synthase, RNA-binding protein 3, 40S ribosomal protein S6, Myosin-11, Carbonic anhydrase 12, Myosin-10, Carboxy-terminal domain RNA polymerase II polypeptide A small phosphatase 2, Electrogenic sodium bicarbonate cotransporter 1, Epidermal growth factor receptor, 39S ribosomal protein L49, mitochondrial, ELKS/Rab6-interacting/CAST family member 1, Statherin, ATP-dependent RNA helicase DDX1, 6-phosphofructo-2-kinase/fructose-2,6-bisphosphatase 3, Formin-like protein 3, Elongator complex protein 2, Prostaglandin G/H synthase 1, ATP-dependent DNA helicase Q5, Nucleolar protein 10, Thioredoxin-like protein 1, ETS translocation variant 3, Actin, alpha skeletal muscle, KAT8 regulatory NSL complex subunit 3, Neutral and basic amino acid transport protein rBAT, Myotubularin-related protein 2, Glutathione S-transferase Mu 4, ADP-ribosylation factor-like protein 2-binding protein, A-kinase-interacting protein 1, Sorting nexin-7, Serine-protein kinase ATM, Poly [ADP-ribose] polymerase, Piezo-type mechanosensitive ion channel component 1, Multidrug resistance-associated protein 1, Glutathione-specific gamma-glutamylcyclotransferase 1, Macrophage metalloelastase, SURP and G-patch domain-containing protein 1, Factor VIII intron 22 protein, Sacsin, Epithelial discoidin domain-containing receptor 1, Pseudouridylate synthase 7 homolog-like protein, La-related protein 1, Adenylate kinase 2, mitochondrial, ATR-interacting protein, Transmembrane protein 41B, Protein SZT2, Transient receptor potential cation channel subfamily V member 2, Phosphatidylcholine translocator ABCB4, Ras GTPase-activating-like protein IQGAP2, F-box DNA helicase 1, Fas apoptotic inhibitory molecule 1, Interferon regulatory factor 2-binding protein 2, Inactive serine/threonine-protein kinase VRK3, Complement C1q tumor necrosis factor-related protein 3, Coiled-coil domain-containing protein 106, LIM and senescent cell antigen-like-containing domain protein 1, Fibrinogen alpha chain, Cytospin-B, DNA-directed RNA polymerase III subunit RPC7, Regulator of nonsense transcripts 1, Keratin, type II cytoskeletal 2 epidermal, Gem-associated protein 4, Histone-lysine N-methyltransferase ASH1 L, MORC family CW-type zinc finger protein 4, C-terminal-binding protein 2, Basic salivary proline-rich protein 2, Salivary acidic proline-rich phosphoprotein 1/2, Histone chaperone ASF1A, Beclin-1, Putative methyltransferase-like protein 15P1, Putative peripheral benzodiazepine receptor-related protein, Protein FAM216A, AP-2 complex subunit beta, PHD and RING finger domain-containing protein 1, E3 ubiquitin-protein ligase TRAF7, Voltage-dependent anion-selective channel protein 3, F-box/WD repeat-containing protein 11, Protein O-GlcNAcase, Tubulin-folding cofactor B, Activating signal cointegrator 1 complex subunit 1, Polypyrimidine tract-binding protein 2, Mitochondrial genome maintenance exonuclease 1, NEDD4-binding protein 2-like 1, Zinc finger and BTB domain-containing protein 38, Protein sel-1 homolog 3, Repressor of RNA polymerase III transcription MAF1 homolog, Versican core protein, Histone-lysine N-methyltransferase 2E, Endothelial PAS domain-containing protein 1, Histone-lysine N-methyltransferase NSD2, Amyloid-like protein 2, Transcription initiation factor TFIID subunit 4, Cysteine and histidine-rich protein 1, Formin-like protein 2, KRR1 small subunit processome component homolog, V-type proton ATPase 116 kDa subunit a isoform 3, Dymeclin, Histone deacetylase 4, Solute carrier family 2, facilitated glucose transporter member 1, Tripeptidyl-peptidase 2, Probable UDP-sugar transporter protein SLC35A5, Probable ATP-dependent RNA helicase DDX60-like, Cystatin-A, Splicing factor U2AF 65 kDa subunit, Membrane-bound transcription factor site-1 protease, UBX domain-containing protein 4, Kinesin-like protein KIF11, FAST kinase domain-containing protein 2, LEM domain-containing protein 2, Galectin-3, Solute carrier family 12 member 6, BCL2/adenovirus E1B 19 kDa protein-interacting protein 3, Serine/threonine-protein phosphatase 2A 56 kDa regulatory subunit gamma isoform, Bardet-Biedl syndrome 4 protein, Progestin and adipoQ receptor family member 4, 40S ribosomal protein S23, Peroxisomal membrane protein PMP34, Polycystic kidney disease and receptor for egg jelly-related protein, Protein Red, Protein KHNYN, 40S ribosomal protein S15, Putative methyltransferase NSUN6, Sin3 histone deacetylase corepressor complex component SDS3, Protein S100-A10, Melanoma-associated antigen D4, Calcium/calmodulin-dependent protein kinase type IV, E3 ubiquitin-protein ligase RNF19B, Girdin, Testin, SWI/SNF-related matrix-associated actin-dependent regulator of chromatin subfamily B member 1, Calcium uptake protein 2, mitochondrial, Tetratricopeptide repeat protein 25, Inhibitor of growth protein 5, Son of sevenless homolog 2, Trans-Golgi network integral membrane protein 2, Insulin-like growth factor 2 mRNA-binding protein 3, Transcription factor SOX-8, Serine/threonine-protein kinase DCLK2, Golgin subfamily A member 5, TBC1 domain family member 13, HLA class II histocompatibility antigen, DR beta 5 chain, E3 SUMO-protein ligase CBX4, PWWP domain-containing protein MUM1, Interferon-induced transmembrane protein 2, DNA polymerase kappa, Methionine synthase, SWI/SNF-related matrix-associated actin-dependent regulator of chromatin subfamily A containing DEAD/H box 1, Translocation protein SEC63 homolog, Chromodomain Y-like protein, Procollagen-lysine,2-oxoglutarate 5-dioxygenase 2, F-box only protein 28, Tripartite motif-containing protein 34, Tubulin-tyrosine ligase, DNA topoisomerase 3-beta-1, Hermansky-Pudlak syndrome 3 protein, G/T mismatch-specific thymine DNA glycosylase, Transducin beta-like protein 3, Negative regulator of reactive oxygen species, BAG family molecular chaperone regulator 2, Ganglioside GM2 activator, RNA-binding protein 12B, Beta-galactoside alpha-2,6-sialyltransferase 1, Dynactin subunit 5, N-terminal Xaa-Pro-Lys N-methyltransferase 1, Ran-binding protein 9, E3 ubiquitin-protein ligase RNF216, SET domain-containing protein 5, F-box/WD repeat-containing protein 7, TRIO and F-actin-binding protein, Pleckstrin homology domain-containing family A member 2, Beta-actin-like protein 2, Stimulator of interferon genes protein, Putative V-set and immunoglobulin domain-containing-like protein IGHV4OR15-8, Ig kappa chain V-I region HK102, Arachidonate 5-lipoxygenase, U2 snRNP-associated SURP motif-containing protein, HLA class I histocompatibility antigen, A-3 alpha chain, Nuclear pore complex protein Nup50, Trinucleotide repeat-containing gene 6B protein, Four and a half LIM domains protein 2, Protein disulfide-isomerase, Radial spoke head protein 3 homolog, Collagen alpha-3(VI) chain, Synaptobrevin homolog YKT6, Myotubularin-related protein 6, Polypeptide N-acetylgalactosaminyltransferase 2, Cytochrome c oxidase subunit 5B, mitochondrial, Dol-P-Man:Man(7)GlcNAc(2)-PP-Dol alpha-1,6-mannosyltransferase, Serglycin, UDP-glucuronic acid decarboxylase 1, Integrin beta-2, Forkhead-associated domain-containing protein 1, Zinc finger protein 36, C3H1 type-like 2, Chloride intracellular channel protein 6, Rab3 GTPase-activating protein non-catalytic subunit, Guanylate-binding protein 4, Cell division control protein 42 homolog, 40S ribosomal protein S27-like, Septin-9, Macrosialin, Serine/threonine-protein kinase RIO1, Transcription elongation factor A protein 1, Transmembrane protein 14A, Protein nepro homolog, Torsin-4A, Protein CEBPZOS, HLA class I histocompatibility antigen, B-57 alpha chain, Ras-related protein M-Ras, DNA polymerase delta subunit 2, Zinc finger protein 343, ADP-ribosylation factor 6, Discoidin, CUB and LCCL domain-containing protein 2, Deoxyhypusine synthase, Lysophospholipid acyltransferase 5, Nuclear cap-binding protein subunit 1, 40S ribosomal protein S27, Serpin H1, Tetratricopeptide repeat protein 30A, A-kinase anchor protein 8-like, Actin-related protein 3, Inositol-tetrakisphosphate 1-kinase, STE20-related kinase adapter protein alpha, Grancalcin, Transcriptional repressor p66-beta, Cytochrome b-245 heavy chain, Lanosterol synthase, Protein phosphatase 1 regulatory subunit 12A, Protein FAM168A, HLA class II histocompatibility antigen, DRB1-16 beta chain, Rotatin, Histone H2A type 1-B/E, SH3 domain-binding glutamic acid-rich-like protein, WD repeat domain phosphoinositide-interacting protein 3, Lysine-specific demethylase 6B, Poly [ADP-ribose] polymerase 8, Intraflagellar transport protein 25 homolog, Histone-lysine N-methyltransferase setd3, Rho guanine nucleotide exchange factor 12, Cell division cycle protein 16 homolog, ATP-dependent zinc metalloprotease YME1L1, Ubiquitin thioesterase OTUB1, Homeobox-containing protein 1, Protein FAM162A, Group XIIB secretory phospholipase A2-like protein, SH3 domain-binding protein 2, 14-3-3 protein eta, CTTNBP2 N-terminal-like protein, Claspin, ADP-ribosylation factor 4, Geranylgeranyl transferase type-1 subunit beta, Galectin-2, CAAX prenyl protease 1 homolog, Phospholipase D1, DNA-directed RNA polymerase III subunit RPC4, Serine/threonine-protein kinase MARK2, FGFR1 oncogene partner 2, 4F2 cell-surface antigen heavy chain, Bromodomain-containing protein 8, Mitochondrial coenzyme A transporter SLC25A42, Terminal uridylyltransferase 7, Hyccin, Serine/threonine-protein phosphatase 2B catalytic subunit beta isoform, Transcription factor SOX-9, F-box/LRR-repeat protein 6, Adiponectin receptor protein 1, Ribosomal protein S6 kinase beta-1, Zinc finger protein 655, Probable aminopeptidase NPEPL1, Dolichyl-diphosphooligosaccharide-protein glycosyltransferase subunit 1, Nuclear transcription factor Y subunit gamma, COUP transcription factor 2, Chromodomain-helicase-DNA-binding protein 1, Glycogen phosphorylase, brain form, Disintegrin and metalloproteinase domain-containing protein 23, Insulin-like growth factor I, Sentrin-specific protease 2, Actin, alpha cardiac muscle 1, Apoptosis-inducing factor 1, mitochondrial, Denticleless protein homolog, Sarcoplasmic/endoplasmic reticulum calcium ATPase 2, Chromodomain-helicase-DNA-binding protein 3, Histone-lysine N-methyltransferase EHMT1, Mediator of RNA polymerase II transcription subunit 6, Chromatin complexes subunit BAP18, Anaphase-promoting complex subunit 16, Exocyst complex component 6, Dehydrodolichyl diphosphate syntase complex subunit NUS1, Tetratricopeptide repeat protein 27, DNA-directed RNA polymerase II subunit RPB11-b2, Tensin-1, Keratin, type I cytoskeletal 19, UPF0568 protein C14orfi 66, Disheveled-associated activator of morphogenesis 1, Thiopurine S-methyltransferase, Tuftelin, Autophagy-related protein 9A, Serine/threonine-protein phosphatase 6 regulatory ankyrin repeat subunit C, Leucine-rich repeat-containing protein 41, Transmembrane protein 50A, snRNA-activating protein complex subunit 4, Galectin-8, WAS/WASL-interacting protein family member 1, ATP synthase F(0) complex subunit C2, mitochondrial, MIT domain-containing protein 1, 28S ribosomal protein S24, mitochondrial, Glycine-tRNA ligase, Ubiquitin-protein ligase E3A, Bifunctional polynucleotide phosphatase/kinase, Serine/threonine-protein kinase PLK2, Ubiquitin carboxyl-terminal hydrolase 16, Cholesteryl ester transfer protein, Rho GDP-dissociation inhibitor 1, F-box/LRR-repeat protein 19, Interleukin-12 subunit alpha, Tumor necrosis factor receptor superfamily member 19, 2'-deoxynucleoside 5'-phosphate N-hydrolase 1, Protein phosphatase 1 regulatory subunit 15A, Transmembrane protein 140, DNA damage-inducible transcript 4 protein, Tetratricopeptide repeat protein 28, Beta-2-syntrophin, Jouberin, Ribose-phosphate pyrophosphokinase 1, Inactive tyrosine-protein kinase 7, Protein LYRIC, HLA class I histocompatibility antigen, alpha chain G, Transcriptional adapter 2-alpha, Myeloid cell nuclear differentiation antigen, Integrin beta-1, Solute carrier family 25 member 43, UDP-N-acetylglucosamine transporter, Zinc finger protein 573, Ubiquitin-conjugating enzyme E2 E1, All-trans-retinol 13,14-reductase, Laminin subunit gamma-1, Bromodomain and WD repeat-containing protein 1, ATP-dependent RNA helicase DDX51, Cytosolic purine 5'-nucleotidase, Sterol regulatory element-binding protein cleavage-activating protein, Tankyrase-1, Zinc finger protein 609, M-phase inducer phosphatase 2, Uncharacterized protein C8orf59, Intraflagellar transport protein 27 homolog, RNA-binding motif, single-stranded-interacting protein 2, S-phase kinase-associated protein 1, Mitochondrial fission process protein 1, Protein SHQ1 homolog, Carboxypeptidase Q, Serine/threonine-protein kinase 10, Cardiolipin synthase (CMP-forming), Splicing regulatory glutamine/lysine-rich protein 1, ATP-binding cassette sub-family A member 7, AT-rich interactive domain-containing protein 1B, Sodium/potassium-transporting ATPase subunit beta-3, RING finger protein 214, UDP-glucuronosyltransferase 1-10, Developmentally-regulated GTP-binding protein 2, Transcription factor Maf, Serine/threonine-protein kinase 35, GRIP and coiled-coil domain-containing protein 2, Transcription factor IIIB 90 kDa subunit, TAF6-like RNA polymerase II p300/CBP-associated factor-associated factor 65 kDa subunit 6L, Serine/threonine-protein phosphatase 6 regulatory ankyrin repeat subunit B, Ankyrin repeat domain-containing protein 27, Zinc finger protein 148, Glutamate-rich WD repeat-containing protein 1, TBC domain-containing protein kinase-like protein, Enhancer of mRNA-decapping protein 4, Quinone oxidoreductase-like protein 1, Transcription initiation factor TFIID subunit 2, Beta-hexosaminidase subunit beta, Transmembrane protein 234, 28S ribosomal protein S29, mitochondrial, CAS1 domain-containing protein 1, Ubiquitin carboxyl-terminal hydrolase 4, Biogenesis of lysosome-related organelles complex 1 subunit 3, Ankyrin repeat domain-containing protein 11, Zinc fingers and homeoboxes protein 2, Hepatoma-derived growth factor, Cancer/testis antigen 2, Histone deacetylase 6, Conserved oligomeric Golgi complex subunit 7, Striatin-4, Tricarboxylate transport protein, mitochondrial, General transcription factor IIF subunit 2, RNA demethylase ALKBH5, Phosphatidylinositide phosphatase SAC2, tRNA-splicing endonuclease subunit Sen34, WAS/WASL-interacting protein family member 2, Protocadherin gamma-C3, Round spermatid basic protein 1-like protein, Alpha-mannosidase 2C1, Transcription factor p65, Serine protease 23, Splicing factor, arginine/serine-rich 15, Neuropathy target esterase, Tubulin epsilon chain, MICOS complex subunit MIC13, Endonuclease domain-containing 1 protein, Sodium-dependent phosphate transport protein 4, Deubiquitinating protein VCIP135, Kinase D-interacting substrate of 220 kDa, Multivesicular body subunit 12A, Heterogeneous nuclear ribonucleoprotein D-like, Gamma-adducin, Nucleotide exchange factor SIL1, Protein FAM76B, Nuclear mitotic apparatus protein 1, Isoaspartyl peptidase/L-asparaginase, Chromobox protein homolog 2, Cilia- and flagella-associated protein 97, Heme-binding protein 1, SCY1-like protein 2, E3 ubiquitin-protein ligase RNF123, Transcription termination factor 1, COP9 signalosome complex subunit 4, UDP-N-acetylglucosamine-peptide N-acetylglucosaminyltransferase 110 kDa subunit, Conserved oligomeric Golgi complex subunit 2, Rho-associated protein kinase 2, Uncharacterized protein Clorf43, Protein FAM179B, Cyclic AMP-responsive element-binding protein 1, Endothelin-converting enzyme 1, Torsin-1A-interacting protein 1, ATP-binding cassette sub-family E member 1, 5'-3' exoribonuclease 1, MAX gene-associated protein, Protein MAK16 homolog, Arf-GAP with Rho-GAP domain, ANK repeat and PH domain-containing protein 3, Lysine-specific demethylase 5B, Signal recognition particle 9 kDa protein, DnaJ homolog subfamily C member 16, CSC1-like protein 1, 39S ribosomal protein L38, mitochondrial, Golgin subfamily A member 2, N-alpha-acetyltransferase 25, NatB auxiliary subunit, ADP-ribosylation factor-like protein 2, Protein Asterix, Dapper homolog 1, Transmembrane protein 64, Transcription factor EB, Magnesium transporter NIPA2, DnaJ homolog subfamily C member 8, Membrane-bound transcription factor site-2 protease, Coiled-coil domain-containing protein 134, Kynurenine 3-monooxygenase, Peptidyl-prolyl cis-trans isomerase F, mitochondrial, GH3 domain-containing protein, AF4/FMR2 family member 1, Trafficking protein particle complex subunit 9, Calcineurin B homologous protein 1, Poly(ADP-ribose) glycohydrolase ARH3, TERF1-interacting nuclear factor 2, Prefoldin subunit 2, Pumilio homolog 1, Arf-GAP with SH3 domain, ANK repeat and PH domain-containing protein 2, Protein CMSS1, Beta-lactamase-like protein 2, ERO1-like protein alpha, Protein SLX41P, Vacuolar protein sorting-associated protein 8 homolog, RING finger protein 145, Type II inositol 1,4,5-trisphosphate 5-phosphatase, Transmembrane anterior posterior transformation protein 1 homolog, Glutamyl-tRNA(Gln) amidotransferase subunit A, mitochondrial, G1/S-specific cyclin-D2, Transcription termination factor 1, mitochondrial, Sterol 26-hydroxylase, mitochondrial, Alpha/beta hydrolase domain-containing protein 17C, PHD finger protein 10, SNF-related serine/threonine-protein kinase, Transcription initiation factor TFIID subunit 1-like, Shootin-1, Glucocorticoid receptor, Histone H2A deubiquitinase MYSM1, CD9 antigen, Calcium signal-modulating cyclophilin ligand, NADH dehydrogenase [ubiquinone] 1 beta subcomplex subunit 6, Tyrosyl-DNA phosphodiesterase 2, 60 kDa SS-A/Ro ribonucleoprotein, Insulin-degrading enzyme, Cytosolic 5'-nucleotidase 3A, Mediator of RNA polymerase II transcription subunit 26, Ribosomal protein S6 kinase alpha-3, DNA polymerase eta, Glycylpeptide N-tetradecanoyltransferase 1, DNA-directed RNA polymerases I, II, and Ill subunit RPABC1, Volume-regulated anion channel subunit LRRC8D, Peptide-N(4)-(N-acetyl-beta-glucosaminyl)asparagine amidase, GA-binding protein subunit beta-1, Inverted formin-2, Oxysterol-binding protein, Phospholipid hydroperoxide glutathione peroxidase, mitochondrial, Chromatin assembly factor 1 subunit B, Putative heat shock protein HSP 90-alpha A5, Phosphatidylinositol 4,5-bisphosphate 3-kinase catalytic subunit gamma isoform, Rho GTPase-activating protein 4, WD repeat-containing protein 47, Probable ubiquitin carboxyl-terminal hydrolase FAF-X, Endoplasmic reticulum aminopeptidase 1, HEAT repeat-containing protein 1, cAMP-specific 3',5'-cyclic phosphodiesterase 4B, Serine/threonine-protein kinase 11-interacting protein, Atlastin-3, Glycerol-3-phosphate acyltransferase 4, Bifunctional coenzyme A synthase, Arginyl aminopeptidase-like 1, Acidic leucine-rich nuclear phosphoprotein 32 family member A, Mannosyl-oligosaccharide glucosidase, rRNA methyltransferase 1, mitochondrial, tRNA-splicing endonuclease subunit Sen15, Ecto-NOX disulfide-thiol exchanger 1, Zinc finger protein 662, Glutamine-fructose-6-phosphate aminotransferase [isomerizing] 2, Transcription intermediary factor 1-alpha, Nicotinate phosphoribosyltransferase, 5-aminolevulinate synthase, nonspecific, mitochondrial, Actin-binding protein anillin, Putative deoxyribonuclease TATDN3, WD repeat-containing protein 61, Protein SCAF8, MKL/myocardin-like protein 2, TRPM8 channel-associated factor 2, Rapamycin-insensitive companion of mTOR, Nuclear receptor subfamily 2 group C member 2, Lysophospholipid acyltransferase 7, Complex I assembly factor TIMMDC1, mitochondrial, KATNB1-like protein 1, Putative ATP-dependent RNA helicase DHX30, RNA-binding protein 12, Transmembrane protein 214, PHD finger protein 3, COP9 signalosome complex subunit 5, Neutral amino acid transporter A, AP-5 complex subunit beta-1, PX domain-containing protein kinase-like protein, Putative inactive carbonic anhydrase 5B-like protein, Small integral membrane protein 4, DNA cross-link repair 1A protein, Mothers against decapentaplegic homolog 2, TIP41-like protein, Retinol dehydrogenase 10, Hippocampus abundant transcript-like protein 1, N-acetyltransferase 9, MOB kinase activator 3A, Transcriptional repressor protein YY1, Kelch-like protein 6, Squalene synthase, N-alpha-acetyltransferase 38, NatC auxiliary subunit, Dedicator of cytokinesis protein 2, E3 ubiquitin-protein ligase TRIM11, tRNA-specific adenosine deaminase 1, Transmembrane protein 248, E3 ubiquitin-protein ligase RNF167, Uncharacterized protein C20orf196, Polycomb protein EED, Exosome complex component RRP46, Kelch-like protein 11, POTE ankyrin domain family member I, Activity-dependent neuroprotector homeobox protein, DNA-binding protein inhibitor ID-4, Secernin-2, ETS-related transcription factor Elf-1, TCDD-inducible poly [ADP-ribose] polymerase, Proliferation-associated protein 2G4, NudC domain-containing protein 1, ATPase family AAA domain-containing protein 2B, Zinc fingers and homeoboxes protein 3, Methylmalonyl-CoA mutase, mitochondrial, Protein RRNAD1, Phospholipase A-2-activating protein, Glycerol-3-phosphate acyltransferase 3, Protein FAM122B, Uncharacterized protein KIAA1109, Phenylalanine-tRNA ligase, mitochondrial, Serine/threonine-protein phosphatase 2B catalytic subunit alpha isoform, Thioredoxin domain-containing protein 11, Bladder cancer-associated protein, Membrane cofactor protein, Nuclear factor of activated T-cells, cytoplasmic 2, Smith-Magenis syndrome chromosomal region candidate gene 8 protein, Krueppel-like factor 3, CDK5 and ABL1 enzyme substrate 1, 40S ribosomal protein S14, Phosphatidylinositol 4-phosphate 5-kinase type-1 beta, Cyclin-dependent kinase 16, SAP domain-containing ribonucleoprotein, Protein NDRG1, WAS protein family homolog 1, Interferon regulatory factor 4, DNA-directed DNA/RNA polymerase mu, Actin-like protein 6A, Dedicator of cytokinesis protein 4, Protein furry homolog, Telomere-associated protein RIF1, Ras association domain-containing protein 1, Cytochrome P450 2J2, Protein scribble homolog, Proheparin-binding EGF-like growth factor, Cytosolic acyl coenzyme A thioester hydrolase, Cohesin subunit SA-1, Myomegalin, Twinfilin-1, Stromal interaction molecule 1, Probable U3 small nucleolar RNA-associated protein 11, Centromere-associated protein E, Zinc finger C3H1 domain-containing protein, EF-hand domain-containing protein D1, Keratin, type II cytoskeletal 8, Retrotransposon-derived protein PEG10, Cyclin-dependent kinase 2, UBX domain-containing protein 11, Pecanex-like protein 3, Rho guanine nucleotide exchange factor 3, ADP-ribosylation factor-like protein 4C, Ribosome biogenesis protein BOP1, KDEL motif-containing protein 2, Structural maintenance of chromosomes protein 5, La-related protein 4B, Acid ceramidase, Proteasome assembly chaperone 1, Radixin, Retinoblastoma-binding protein 5, Forkhead box protein N2, rRNA-processing protein UTP23 homolog, Src kinase-associated phosphoprotein 2, Volume-regulated anion channel subunit LRRC8C, Acyl-CoA dehydrogenase family member 9, mitochondrial, Beta-synuclein, Short coiled-coil protein, Collagen alpha-2(VI) chain, Ubinuclein-2, Plasmalemma vesicle-associated protein, Mitofusin-2, Small integral membrane protein 20, Stromal interaction molecule 2, Threonylcarbamoyladenosine tRNA methylthiotransferase, Alpha-soluble NSF attachment protein, Putative E3 ubiquitin-protein ligase UBR7, BRCA1-associated ATM activator 1, Group XIIA secretory phospholipase A2, Transcription factor 20, Potassium channel subfamily K member 4, Casein kinase I isoform alpha, Bombesin receptor-activated protein C6orf89, Peripheral plasma membrane protein CASK, Proline-rich protein PRCC, Serine/threonine-protein kinase SIK2, Host cell factor 1, Transducin-like enhancer protein 4, Biogenesis of lysosome-related organelles complex 1 subunit 6, Queuine tRNA-ribosyltransferase subunit QTRTD1, RNA-binding protein 33, Leucine-rich repeat-containing protein 59, Transcription factor Sp3, Eukaryotic initiation factor 4A-III, E3 ubiquitin-protein ligase RNF181, Mediator of RNA polymerase II transcription subunit 7, Transcription elongation factor SPT4, Homeobox protein TGIF2, Carnitine O-palmitoyltransferase 1, liver isoform, cGMP-inhibited 3',5'-cyclic phosphodiesterase B, Polymerase delta-interacting protein 3, Runt-related transcription factor 2, THUMP domain-containing protein 3, Serpin B6, Interleukin-32, Sodium-coupled neutral amino acid transporter 1, Nucleoside diphosphate kinase A, Cytochrome b, Putative uncharacterized protein ZNF436-AS1, Beta-1-syntrophin, Mitotic-spindle organizing protein 2A, Calcium/calmodulin-dependent protein kinase II inhibitor 1, Necdin, FERM domain-containing protein 8, Serine/threonine-protein phosphatase 2A catalytic subunit beta isoform, Transcription factor 4, SHC-transforming protein 4, Dedicator of cytokinesis protein 8, Ankyrin repeat domain-containing protein 54, Transcription factor jun-B, Periodic tryptophan protein 2 homolog, RUS1 family protein C16orf58, Pterin-4-alpha-carbinolamine dehydratase, Tyrosine-protein phosphatase non-receptor type 13, Chloride intracellular channel protein 5, PHD finger protein 20-like protein 1, 55 kDa erythrocyte membrane protein, Tetratricopeptide repeat protein 4, Roundabout homolog 1, Putative methyltransferase NSUN3, Toll-like receptor 9, E3 ubiquitin-protein ligase DTX3L, Arf-GAP with SH3 domain, ANK repeat and PH domain-containing protein 1, GRB2-related adapter protein, Fructosamine-3-kinase, TATA element modulatory factor, Nuclear autoantigen Sp-100, Solute carrier family 41 member 3, Putative Polycomb group protein ASXL2, Protein ZGRF1, Transmembrane emp24 domain-containing protein 5, E3 ubiquitin-protein ligase RNF31, B-cell receptor-associated protein 29, mRNA cap guanine-N7 methyltransferase, Uromodulin, Signal transducer CD24, Integrin alpha-6, NF-kappa-B essential modulator, Kinesin-like protein KIFC1, Translation machinery-associated protein 16, Valine-tRNA ligase, COMM domain-containing protein 9, 28S ribosomal protein S21, mitochondrial, Kalirin, Prostaglandin F2 receptor negative regulator, BTB/POZ domain-containing protein 2, Dol-P-Man:Man(5)GlcNAc(2)-PP-Dol alpha-1,3-mannosyltransferase, tRNA-dihydrouridine(20) synthase [NAD(P)+]-like, Surfeit locus protein 6, Rho GTPase-activating protein 19, Eukaryotic translation initiation factor 4E, C—X—C motif chemokine 14, Engulfment and cell motility protein 1, Collagen alpha-1(XVIII) chain, Isochorismatase domain-containing protein 2, Coatomer subunit gamma-2, DNA-directed RNA polymerase III subunit RPC1, Kazrin, Synaptojanin-2-binding protein, Centrosomal protein of 85 kDa, Transmembrane protein 69, Lariat debranching enzyme, Receptor activity-modifying protein 2, F-box only protein 32, Transcription cofactor vestigial-like protein 4, SH3 domain-binding protein 1, Epsin-2, Mitogen-activated protein kinase 3, Ragulator complex protein LAMTOR2, Mitogen-activated protein kinase 9, Adipocyte plasma membrane-associated protein, [Pyruvate dehydrogenase [acetyl-transferring]]-phosphatase 1, mitochondrial, 28S ribosomal protein S12, mitochondrial, WD repeat and FYVE domain-containing protein 1, Protein disulfide-isomerase A4, Protein DEPP, Antigen peptide transporter 2, CDC42 small effector protein 1, Cyclin-dependent kinase 13, MICOS complex subunit MIC10, Nicastrin, Protein FAM73A, Complement C1q subcomponent subunit C, 28S ribosomal protein S7, mitochondrial, Serine/threonine-protein kinase TAO1, Ras GTPase-activating protein 3, Protein LDOC1L, Cytosolic 10-formyltetrahydrofolate dehydrogenase, Smoothelin, WW domain-binding protein 5, Phosphatidylinositide phosphatase SAC1, 39S ribosomal protein L3, mitochondrial, Inositol-trisphosphate 3-kinase B, Erythrocyte band 7 integral membrane protein, Solute carrier family 35 member E1, Probable 28S rRNA (cytosine(4447)-C(5))-methyltransferase, Y-box-binding protein 3, Proline-, glutamic acid- and leucine-rich protein 1, HCLS1-binding protein 3, Ubiquitin carboxyl-terminal hydrolase 37, Protein-L-isoaspartate(D-aspartate)O-methyltransferase, Transcriptional activator Myb, Abnormal spindle-like microcephaly-associated protein, Exportin-4, GMP reductase 1, Sperm-associated antigen 7, Tyrosine-protein kinase Fer, Coronin-1B, Acidic leucine-rich nuclear phosphoprotein 32 family member B, Schlafen family member 5, Macrophage erythroblast attacher, Histone acetyltransferase KAT2A, Mitotic spindle assembly checkpoint protein MAD2B, RecQ-mediated genome instability protein 1, Up-regulator of cell proliferation, Nucleoside diphosphate kinase, C-myc promoter-binding protein, Molybdate-anion transporter, Integrator complex subunit 5, Centrosomal protein of 170 kDa, Protein CASC5, Ephrin-A4, Tumor suppressor p53-binding protein 1, Proteasomal ATPase-associated factor 1, Gephyrin, Helicase SKI2W, Pleckstrin homology domain-containing family G member 2, Serine/threonine-protein kinase receptor R3, AP-5 complex subunit mu-1, Nuclear receptor subfamily 1 group D member 1, DnaJ homolog subfamily B member 2, Merlin, Ashwin, Transmembrane protein 176A, Synaptotagmin-like protein 2, Serine/threonine-protein kinase R102, AP-3 complex subunit beta-1, Forkhead box protein O1, Protein STON1-GTF2A1 L, Lysine-specific demethylase 7A, Inactive phospholipase C-like protein 2, Transcription factor MafG, Protein TBRG4, Nesprin-1, Type I inositol 1,4,5-trisphosphate 5-phosphatase, Disks large homolog 3, Long-chain-fatty-acid-CoA ligase 5, Trafficking protein particle complex subunit 1, Bromodomain testis-specific protein, Heterochromatin protein 1-binding protein 3, Histone H1.3, Malectin, Glyoxalase domain-containing protein 4, SRSF protein kinase 2, Twinfilin-2, ATPase WRNIP1, Transgelin, Echinoderm microtubule-associated protein-like 3, Histone deacetylase complex subunit SAP18, RE1-silencing transcription factor, Protein tyrosine phosphatase type IVA 1, Phospholipase D3, Microfibrillar-associated protein 1, Putative protein arginine N-methyltransferase 9, Protein NYNRIN, NADH-cytochrome b5 reductase 1, Centrosomal protein POC5, Protrudin, Transcription initiation factor TFIID subunit 8, Motile sperm domain-containing protein 1, Splicing factor, arginine/serine-rich 19, BTB/POZ domain-containing adapter for CUL3-mediated RhoA degradation protein 2, Sentrin-specific protease 3, Interferon regulatory factor 1, 40S ribosomal protein S4, Y isoform 2, Transmembrane protein 147, Transcriptional regulator Kaiso, HCG2043421, isoform CRA_c, WD repeat-containing protein 78, 1,2-dihydroxy-3-keto-5-methylthiopentene dioxygenase, Aldehyde dehydrogenase family 16 member A1, Protein phosphatase 1 D, Caspase-1, CMP-N-acetylneuraminate-beta-galactosamide-alpha-2,3-sialyltransferase 1, Putative 40S ribosomal protein S10-like, Protein DENND6A, N-glycosylase/DNA lyase, Kelch-like protein 5, RNA-binding protein 40, Major prion protein, Fibroblast growth factor receptor substrate 2, Fragile X mental retardation protein 1, Signal recognition particle 14 kDa protein, Sarcolemmal membrane-associated protein, 5-formyltetrahydrofolate cyclo-ligase, 2',5'-phosphodiesterase 12, Receptor-type tyrosine-protein phosphatase U, Translocon-associated protein subunit gamma, Guanine nucleotide-binding protein-like 3, Ran-binding protein 6, Transcription factor Sp4, Histone deacetylase complex subunit SAP130, Adapter protein CIKS, PDZ and LIM domain protein 5, Ankyrin repeat domain-containing protein 40, Uroporphyrinogen decarboxylase, DNA repair protein RAD51 homolog 3, CGG triplet repeat-binding protein 1, Ubiquitin carboxyl-terminal hydrolase BAP1, ATP-dependent DNA helicase Q1, Sorting nexin-8, Syntaxin-binding protein 6, Protein syndesmos, Mitogen-activated protein kinase kinase kinase 6, Gametogenetin-binding protein 2, ATP-dependent 6-phosphofructokinase, muscle type, ADP-ribosylation factor-like protein 6-interacting protein 1, Protein dpy-30 homolog, Ras-like protein family member 11A, Core histone macro-H2A.1, Vacuolar protein sorting-associated protein 16 homolog, ER lumen protein-retaining receptor 2, Ubiquitin-conjugating enzyme E2 L3, Phosphatidate cytidylyltransferase 1, Putative oxidoreductase GLYR1, 39S ribosomal protein L37, mitochondrial, HLA class II histocompatibility antigen, DQ beta 1 chain, Mitogen-activated protein kinase 14, Mitogen-activated protein kinase 7, Endoplasmic reticulum lectin 1, Rho GTPase-activating protein 17, EP300-interacting inhibitor of differentiation 1, Codanin-1, Tetratricopeptide repeat protein 19, mitochondrial, High affinity cationic amino acid transporter 1, Protein strawberry notch homolog 2, Rabankyrin-5, HEAT repeat-containing protein 6, Mitochondrial antiviral-signaling protein, Liprin-alpha-1, Chromodomain-helicase-DNA-binding protein 9, Ras-specific guanine nucleotide-releasing factor RalGPS2, Transmembrane 9 superfamily member 1, Dipeptidyl peptidase 2, Lysophosphatidylcholine acyltransferase 1, E1A-binding protein p400, DNA fragmentation factor subunit alpha, DNA mismatch repair protein Mlhi, Receptor-interacting serine/threonine-protein kinase 4, Alpha-tubulin N-acetyltransferase 1, HLA class I histocompatibility antigen, B-40 alpha chain, RILP-like protein 1, Aminopeptidase B, Protein fem-1 homolog A, DNA polymerase alpha catalytic subunit, Protein DGCR6L, Histone deacetylase 10, DENN domain-containing protein 4B, Transmembrane protein 102, Cell differentiation protein RCD1 homolog, GSK3-beta interaction protein, Multiple inositol polyphosphate phosphatase 1, THAP domain-containing protein 11, Synaptosomal-associated protein 29, Inversin, Small integral membrane protein 10, Kinesin light chain 1, tRNA-splicing endonuclease subunit Sen2, Putative phospholipase B-like 2, AP-1 complex subunit gamma-1, E3 ubiquitin-protein ligase RFWD2, Integrin alpha-X, Chitobiosyldiphosphodolichol beta-mannosyltransferase, Tripartite motif-containing protein 44, Histone H1.4, Liprin-beta-1, Zinc finger HIT domain-containing protein 2, RELT-like protein 1, Rhotekin, Long-chain fatty acid transport protein 1, Coiled-coil domain-containing protein 50, Pumilio homolog 2, Alpha-actinin-1, Vacuolar protein sorting-associated protein 54, Erlin-1, Ubiquitin carboxyl-terminal hydrolase 28, Echinoderm microtubule-associated protein-like 5, GRB2-associated-binding protein 1, Protein BANP, DNA excision repair protein ERCC-1, Zinc finger and BTB domain-containing protein 17, Autophagy-related protein 16-1, Segment polarity protein dishevelled homolog DVL-2, GRIP1-associated protein 1, Circadian clock protein PASD1, Cyclin-J-like protein, Tristetraprolin, Ral GTPase-activating protein subunit alpha-1, DENN domain-containing protein 5B, Caspase recruitment domain-containing protein 19, Eukaryotic translation initiation factor 4 gamma 2, Phospholipase DDHD1, Major facilitator superfamily domain-containing protein 1, Beta-glucuronidase, Putative protein PLEKHA9, Probable ATP-dependent RNA helicase DDX59, Putative histone H2B type 2-D, Osteopetrosis-associated transmembrane protein 1, Structure-specific endonuclease subunit SLX1, Nicalin, E3 ubiquitin-protein ligase XIAP, Rhomboid domain-containing protein 2, Telomere length regulation protein TEL2 homolog, Leucine-rich repeat serine/threonine-protein kinase 2, U3 small nucleolar RNA-associated protein 18 homolog, CAP-Gly domain-containing linker protein 1, Autophagy-related protein 13, WD repeat and FYVE domain-containing protein 3, Transcription initiation factor TFIID subunit 4B, Phosphatidylinositol N-acetylglucosaminyltransferase subunit H, Adiponectin receptor protein 2, Protein GPR107, Tumor protein p53-inducible protein 13, Apoptosis-stimulating of p53 protein 2, Kelch domain-containing protein 3, Leucine-rich repeat and calponin homology domain-containing protein 1, Vascular endothelial growth factor receptor 1, Transcription factor E2-alpha, Pre-mRNA-processing factor 17, Leupaxin, Transmembrane protein 2, Huntingtin-interacting protein 1, NIPA-like protein 3, Glucosamine-6-phosphate isomerase 2, U6 snRNA-associated Sm-like protein LSm8, Copper chaperone for superoxide dismutase, Major facilitator superfamily domain-containing protein 8, Integrator complex subunit 7, Cytoplasmic dynein 1 light intermediate chain 2, Protein angel homolog 1, Protein cramped-like, Transmembrane protein 261, Apoptosis-resistant E3 ubiquitin protein ligase 1, Endonuclease G, mitochondrial, Something about silencing protein 10, Calpain-7, Probable ATP-dependent RNA helicase DDX60, KAT8 regulatory NSL complex subunit 1, Protein NPAT, Rab3 GTPase-activating protein catalytic subunit, Transmembrane protein 223, tRNA wybutosine-synthesizing protein 2 homolog, T-complex protein 11-like protein 2, TATA box-binding protein-associated factor RNA polymerase I subunit B, Rab-like protein 2A, Inactive ubiquitin carboxyl-terminal hydrolase 54, Inner nuclear membrane protein Man1, Ribosomal protein S6 kinase alpha-4, Ligand of Numb protein X 2, DDB1- and CUL4-associated factor 16, HCG2044777, TELO2-interacting protein 2, Bromodomain-containing protein 9, Zinc finger protein 644, Dual specificity protein phosphatase 10, Taxi-binding protein 1, THAP domain-containing protein 4, DNA topoisomerase I, mitochondrial, NFATC2-interacting protein, ATPase family AAA domain-containing protein 1, Protein Hook homolog 1, Polypeptide N-acetylgalactosaminyltransferase 18, Kinesin-like protein KIF1C, Trafficking protein particle complex subunit 11, Cytochrome P450 4V2, NADH dehydrogenase [ubiquinone] iron-sulfur protein 2, mitochondrial, cAMP-dependent protein kinase type II-alpha regulatory subunit, Transmembrane protein 245, Acetyl-CoA acetyltransferase, mitochondrial, AP-1 complex subunit sigma-1A, mRNA export factor, Ski oncogene, Breast cancer type 2 susceptibility protein, E3 UFM1-protein ligase 1, Ribonuclease H2 subunit B, Beta-secretase 2, Growth arrest-specific protein 7, Lethal(2) giant larvae protein homolog 2, Activating signal cointegrator 1 complex subunit 3, Zinc finger protein 532, DNA-directed RNA polymerase II subunit RPB11-a, Ubiquitin/ISG15-conjugating enzyme E2 L6, Kelch-like protein 12, tRNA-dihydrouridine(47) synthase [NAD(P)(+)]-like, Activating molecule in BECN1-regulated autophagy protein 1, Angiomotin-like protein 1, Pleckstrin homology domain-containing family A member 4, Liprin-alpha-3, Fasciculation and elongation protein zeta-2, 5'-nucleotidase domain-containing protein 3, Growth arrest-specific protein 8, SLIT-ROBO Rho GTPase-activating protein 2, DNA dC→dU-editing enzyme APOBEC-3A, N-acetylgalactosamine kinase, U6 snRNA-associated Sm-like protein LSm4, Keratinocyte-associated transmembrane protein 2, E3 ubiquitin-protein ligase UBR1, Riboflavin kinase, TFIIH basal transcription factor complex helicase XPB subunit, GPN-loop GTPase 3, Nitrogen permease regulator 3-like protein, SH3KBP1-binding protein 1, Serine/threonine-protein phosphatase 4 regulatory subunit 3B, Unconventional myosin-XVIIIlla, Ras GTPase-activating-like protein IQGAP3, Protein TRIM6-TRIM34, Calponin-2, Developmentally-regulated GTP-binding protein 1, Transcription initiation factor TFIID subunit 1, Zinc finger BED domain-containing protein 4, Ubiquitin-like modifier-activating enzyme 7, Protein C12orf4, Prefoldin subunit 1, Phosphatidate phosphatase LPIN1, N-acetyllactosaminide beta-1,3-N-acetylglucosaminyltransferase 2, Mitochondrial fission regulator 1, Palladin, Forkhead box protein J3, Tyrosine-protein phosphatase non-receptor type 12, Phospholipase A1 member A, Eyes absent homolog 2, Dual specificity protein phosphatase 6, COMM domain-containing protein 8, Nuclear factor NF-kappa-B p105 subunit, Ketosamine-3-kinase, E3 ubiquitin-protein ligase RLIM, Cyclin-L2, WD repeat domain phosphoinositide-interacting protein 4, DDB1- and CUL4-associated factor 4-like protein 1, Partitioning defective 3 homolog, 3-ketodihydrosphingosine reductase, Upstream-binding protein 1, Xyloside xylosyltransferase 1, Suppressor APC domain-containing protein 2, Translocon-associated protein subunit beta, Vacuolar protein sorting-associated protein 33B, Probable inactive glycosyltransferase 25 family member 3, HMG domain-containing protein 4, Protein orai-3, Copine-3, Myeloid-derived growth factor, BTB/POZ domain-containing adapter for CUL3-mediated RhoA degradation protein 1, Calcium-independent phospholipase A2-gamma, Sperm-specific antigen 2, Glycerol-3-phosphate acyltransferase 1, mitochondrial, Replication initiator 1, Uncharacterized protein C15orf39, Uncharacterized protein C5orf34, FAD synthase, Inhibitor of Bruton tyrosine kinase, Cell growth-regulating nucleolar protein, EF-hand domain-containing protein 1, Centrosome-associated protein CEP250, SH3 domain and tetratricopeptide repeat-containing protein 1, Kelch-like protein 21, Cullin-9, Optineurin, Kelch domain-containing protein 10, Cation channel sperm-associated protein 2, Solute carrier family 35 member C2, Carboxypeptidase D, Peroxisomal biogenesis factor 3, Kinesin-like protein KIF3A, Lysosomal-trafficking regulator, Uncharacterized aarF domain-containing protein kinase 2, Transportin-3, Mediator of RNA polymerase II transcription subunit 24, CAP-Gly domain-containing linker protein 2, Solute carrier family 35 member E4, Sestrin-3, Bromodomain adjacent to zinc finger domain protein 1A, Dehydrogenase/reductase SDR family member 1, Cyclin-dependent-like kinase 5, Heat shock factor protein 2, Serine/threonine-protein kinase TBK1, Ubiquitin conjugation factor E4 B, Band 4.1-like protein 3, ADNP homeobox protein 2, Ubiquitin carboxyl-terminal hydrolase 6, Mediator of DNA damage checkpoint protein 1, Mitochondrial fission factor, PDZ domain-containing protein GIPC1, Serine incorporator 1, Nectin-2, Phosphopantothenate-cysteine ligase, Paraspeckle component 1, Tumor necrosis factor receptor superfamily member 6, Vacuolar protein sorting-associated protein 29, EMILIN-2, Ubiquitin carboxyl-terminal hydrolase 33, Mediator of RNA polymerase II transcription subunit 14, Histone-lysine N-methyltransferase 2B, Coronin, Signal-induced proliferation-associated protein 1, 2-hydroxyacyl-CoA lyase 1, Kelch-like protein 22, Vacuolar protein sorting-associated protein 11 homolog, 1-phosphatidylinositol 4,5-bisphosphate phosphodiesterase gamma-1, Acylglycerol kinase, mitochondrial, Transmembrane protein 9B, Insulin-like growth factor 2 mRNA-binding protein 1, Tartrate-resistant acid phosphatase type 5, Kelch-like protein 18, Glycogen phosphorylase, liver form, Protein Mis18-beta, Guanine nucleotide-binding protein G(i) subunit alpha-1, Disheveled-associated activator of morphogenesis 2, Protein VAC14 homolog, Ubiquitin-like protein 4A, Vesicle-trafficking protein SEC22b, Zinc finger CCCH-type antiviral protein 1, Phosphatidylinositol N-acetylglucosaminyltransferase subunit A, Coiled-coil domain-containing protein 84, Vesicle-associated membrane protein 4, UPF0606 protein KIAA1549L, Phosphatidylglycerophosphatase and protein-tyrosine phosphatase 1, Uncharacterized protein C11orf24, 60S ribosomal protein L32, EF-hand calcium-binding domain-containing protein 7, Glucose-fructose oxidoreductase domain-containing protein 2, Nucleolar protein 6, NAD kinase, Methyltransferase-like protein 9, GTP-binding protein 2, Protocadherin beta-6, Myotubularin-related protein 4, Serine palmitoyltransferase small subunit A, G patch domain-containing protein 11, GRB2-associated-binding protein 2, Copper-transporting ATPase 1, Coiled-coil and C2 domain-containing protein 2A, Helicase ARIP4, Uncharacterized protein C20orf144, Gamma-soluble NSF attachment protein, Lysine-specific demethylase 6A, Protein S100-A6, Collagen alpha-2(VIII) chain, Ephrin type-B receptor 1, Fer-1-like protein 5, Molybdenum cofactor sulfurase, Cysteine-rich protein 2, Interferon-induced protein with tetratricopeptide repeats 2, Fas-binding factor 1, IQ motif and SEC7 domain-containing protein 2, Beta-secretase 1, GDNF family receptor alpha-1, H/ACA ribonucleoprotein complex subunit 2, Rho guanine nucleotide exchange factor 17, Uncharacterized protein C2orf15, Nesprin-3, Ankyrin repeat domain-containing protein 35, Probable ATP-dependent RNA helicase DDX53, DNA-binding protein RFX6, BTB/POZ domain-containing protein KCTD7, Fanconi anemia group M protein, Collagen alpha-4(IV) chain, Complement C4-A, Collagen alpha-1(XIX) chain, Neuronal tyrosine-phosphorylated phosphoinositide-3-kinase adapter 2, Kinesin-like protein KIF27, Meprin A subunit beta, F-box/LRR-repeat protein 4, PHD finger protein 14, Arylsulfatase E, NACHT, LRR and PYD domains-containing protein 9, Kelch-like protein 2, Protein RER1, L-lactate dehydrogenase A-like 6B, Diacylglycerol O-acyltransferase 2, PWWP domain-containing protein 2B, DNA mismatch repair protein MIh3, Cathepsin K, Synaptojanin-1, Zinc finger MYND domain-containing protein 15, Histone H2A type 2-A, D-dopachrome decarboxylase, FAST kinase domain-containing protein 1, F-box only protein 41, Threonine synthase-like 1, Beta-1,4-galactosyltransferase 7, Usherin, Nucleoside diphosphate kinase B, Endoplasmic reticulum aminopeptidase 2, Wiskott-Aldrich syndrome protein, Cartilage intermediate layer protein 1, Probable phosphoglycerate mutase 4, Tumor protein D52, Histidine protein methyltransferase 1 homolog, Glutaredoxin-2, mitochondrial, Polycystin-1, Cilia- and flagella-associated protein 52, Oxysterol-binding protein 2, UV excision repair protein RAD23 homolog B, Protein boule-like, Beta-1,3-galactosyltransferase 6, Sodium-coupled monocarboxylate transporter 2, Rabenosyn-5, Leucine-rich repeat-containing protein 28, NUAK family SNF1-like kinase 2, Laminin subunit alpha-4, Otoferlin, Procollagen-lysine,2-oxoglutarate 5-dioxygenase 1, Galectin-1, Ovochymase-1, Envoplakin, Neuron navigator 2, VIP peptides, Activin receptor type-2A, Serine/threonine-protein phosphatase with EF-hands 1, Kin of IRRE-like protein 3, Ankyrin repeat domain-containing protein 26, Microsomal glutathione S-transferase 1, Gamma-enolase, Matrix-remodeling-associated protein 5, HMG domain-containing protein 3, Selenide, water dikinase 2, Transmembrane glycoprotein NMB, Cytochrome b-245 light chain, Transcription factor 7-like 2, Tumor protein p63-regulated gene 1-like protein, Transmembrane protein 141, Protein FAM188B, Protein TANC1, 5-oxoprolinase, Tryptophan-tRNA ligase, cytoplasmic, Leishmanolysin-like peptidase, Kinesin-like protein KIF7, 40S ribosomal protein S12, Anthrax toxin receptor 1, Actin-related protein 2/3 complex subunit 1A, Nicotinate-nucleotide pyrophosphorylase [carboxylating], Caskin-2, Protein Wnt-5a, Dehydrogenase/reductase SDR family member 4, Fatty acid desaturase 1, RalBP1-associated Eps domain-containing protein 1, Cadherin-5, Mitogen-activated protein kinase kinase kinase MLT, Transcription initiation protein SPT3 homolog, HEAT repeat-containing protein 5A, Solute carrier family 26 member 6, CD109 antigen, Stress-induced-phosphoprotein 1, Nuclear receptor coactivator 7, Liprin-alpha-4, Mesoderm induction early response protein 1, Kynurenine-oxoglutarate transaminase 3, Leucine-zipper-like transcriptional regulator 1, Ubiquitin-like-conjugating enzyme ATG3, Protein shisa-5, Cell adhesion molecule-related/down-regulated by oncogenes, Breast cancer anti-estrogen resistance protein 3, Phosphoacetylglucosamine mutase, Ras-related protein Rab-14, Glutamate receptor ionotropic, kainate 2, DNA-directed RNA polymerase III subunit RPC3, Enhancer of polycomb homolog 1, Nuclear protein 1, Melanoma-associated antigen 11, Inositol polyphosphate multikinase, Sorting nexin-18, Poly [ADP-ribose]polymerase 12, Ubiquitin-conjugating enzyme E2 K, Leucine-rich repeats and immunoglobulin-like domains protein 2, Trifunctional enzyme subunit beta, mitochondrial, Cytoplasmic dynein 2 heavy chain 1, Thimet oligopeptidase, Regulatory-associated protein of mTOR, Protein FAM83H, DDB1- and CUL4-associated factor 12, Creatine kinase M-type, Nestin, ADP-ribosylation factor-binding protein GGA1, DDRGK domain-containing protein 1, Laminin subunit alpha-1, Upstream stimulatory factor 1, Reticulocalbin-3, Low-density lipoprotein receptor-related protein 4, PR domain zinc finger protein 10, Glutathione S-transferase Mu 3, Ribosomal protein S6 kinase alpha-5, Protein CLEC16A, Zinc transporter SLC39A7, Armadillo repeat containing 8, isoform CRA_g, Uncharacterized protein KIAA0355, Caseinolytic peptidase B protein homolog, Hypoxanthine-guanine phosphoribosyltransferase, Receptor-type tyrosine-protein phosphatase F, Rhophilin-2, E3 ubiquitin-protein ligase Arkadia, Dedicator of cytokinesis protein 5, Dynein heavy chain 14, axonemal, U5 small nuclear ribonucleoprotein 40 kDa protein, Progesterone-induced-blocking factor 1, Vesicle-associated membrane protein-associated protein A, Switch-associated protein 70, Prolow-density lipoprotein receptor-related protein 1, Noelin, D-3-phosphoglycerate dehydrogenase, Serine/threonine-protein kinase 24, Serine protease HTRA1, 39S ribosomal protein L12, mitochondrial, Peptidyl-prolyl cis-trans isomerase FKBP9, E3 ubiquitin-protein ligase TRIM21, Wee1-like protein kinase, Hydroxyacylglutathione hydrolase, mitochondrial, Solute carrier family 12 member 4, 1-phosphatidylinositol 4,5-bisphosphate phosphodiesterase gamma-2, USP6 N-terminal-like protein, Collagen alpha-1(XV) chain, Nuclear fragile X mental retardation-interacting protein 2, Protein unc- 119 homolog B, Exocyst complex component 6B, Aminoacylase-1, Kelch domain-containing protein 7B, pre-rRNA processing protein FTSJ3, Ryanodine receptor 1, Nucleobindin-1, Striatin-3, Serine/threonine-protein kinase ULK4, GTP-binding protein Rheb, Probable E3 ubiquitin-protein ligase HERC3, Dedicator of cytokinesis protein 1, Proline-rich protein 11, Sister chromatid cohesion protein PDS5 homolog B, Breast cancer anti-estrogen resistance protein 1, Vitamin K-dependent protein S, POZ-, AT hook-, and zinc finger-containing protein 1, Probable global transcription activator SNF2L1, Hepatocyte growth factor receptor, Leucine-rich repeat-containing protein 42, AMP deaminase 2, Protein phosphatase Slingshot homolog 3, Serine/threonine-protein kinase PLK3, BTB/POZ domain-containing protein 3, General transcription factor IIF subunit 1, Protein SOGA1, Serine/threonine-protein phosphatase 4 catalytic subunit, Zinc finger protein 3, Neurolysin, mitochondrial, T-box transcription factor TBX3, Bardet-Biedl syndrome 10 protein, Inositol-trisphosphate 3-kinase C, Serine/threonine-protein phosphatase 5, Phospholipase DDHD2, Zinc finger protein 530, Phospholysine phosphohistidine inorganic pyrophosphate phosphatase, SPRY domain-containing SOCS box protein 1, Supervillin, UDP-N-acetylglucosamine/UDP-glucose/GDP-mannose transporter, Complement decay-accelerating factor, LIM and calponin homology domains-containing protein 1, Lysosomal Pro-X carboxypeptidase, Putative RNA polymerase II subunit B1 CTD phosphatase RPAP2, Heat shock 70 kDa protein 13, Alpha/beta hydrolase domain-containing protein 14B, Unconventional myosin-X, Mimitin, mitochondrial, Protein TALPID3, Centrosomal protein of 63 kDa, Very-long-chain (3R)-3-hydroxyacyl-CoA dehydratase 3, HAUS augmin-like complex subunit 6, Neural cell adhesion molecule L1, Oxysterol-binding protein-related protein 1, Caspase recruitment domain-containing protein 8, Ras-related protein Rap-2c, Sorting nexin-30, Serine/threonine-protein kinase D3, Progressive ankylosis protein homolog, Bleomycin hydrolase, Trafficking protein particle complex subunit 2, Pyruvate carboxylase, mitochondrial, Peroxisome proliferator-activated receptor gamma coactivator 1-alpha, Cadherin EGF LAG seven-pass G-type receptor 2, Dedicator of cytokinesis protein 9, C-Jun-amino-terminal kinase-interacting protein 4, E3 ubiquitin-protein ligase SHPRH, Alpha-mannosidase 2x, H/ACA ribonucleoprotein complex subunit 1, Zinc finger protein 503, Tubulin polyglutamylase TTLL4, Oxysterol-binding protein-related protein 10, Origin recognition complex subunit 5, Serine/threonine-protein kinase PLK4, Disks large homolog 5, H/ACA ribonucleoprotein complex non-core subunit NAF1, Prolyl 3-hydroxylase 1, Protein FAM46B, Nuclear factor 1 X-type, Multiple PDZ domain protein, Serine/threonine-protein kinase SIK3, Ribonuclease P protein subunit p21, Serine/threonine-protein kinase MRCK beta, Serine/threonine-protein phosphatase 2A 55 kDa regulatory subunit B alpha isoform, snRNA-activating protein complex subunit 1, Rab proteins geranylgeranyltransferase component A 1, Cystine/glutamate transporter, ER degradation-enhancing alpha-mannosidase-like protein 3, RNA pseudouridylate synthase domain-containing protein 2, DENN domain-containing protein 1B, Trimethylguanosine synthase, Catechol O-methyltransferase, E3 ubiquitin-protein ligase DZIP3, Myotubularin-related protein 13, Epoxide hydrolase 1, RNA-binding motif protein, X-linked-like-2, Tyrosine-protein phosphatase non-receptor type 9, Cell cycle checkpoint control protein RAD9A, UHRF1-binding protein 1-like, Plasma membrane calcium-transporting ATPase 4, Aminoacyl tRNA synthase complex-interacting multifunctional protein 1, Neural Wiskott-Aldrich syndrome protein, Collagen alpha-1(VII) chain, Kelch repeat and BTB domain-containing protein 2, Protein FAM63A, RNA-binding protein with multiple splicing 2, Discoidin domain-containing receptor 2, Actin filament-associated protein 1, Protein Smaug homolog 1, Serum paraoxonase/arylesterase 2, Ankyrin repeat and BTB/POZ domain-containing protein 2, Zinc-binding alcohol dehydrogenase domain-containing protein 2, Serine/threonine-protein kinase 3, Actin-related protein 10, Lipoma-preferred partner, Zinc finger protein RFP, Very-long-chain enoyl-CoA reductase, Elongation protein 4 homolog (S. cerevisiae), isoform CRA_b, Dual specificity protein phosphatase 4, Anoctamin-1, Actin-binding LIM protein 3, Kelch-like protein 9, Cytoplasmic aconitate hydratase, Protein FAM178B, Cell cycle control protein 50A, tRNA wybutosine-synthesizing protein 4, Cholinephosphotransferase 1, Glycogen synthase kinase-3 alpha, Tectonic-3, Paired amphipathic helix protein Sin3b, ATP-binding cassette sub-family D member 3, CCR4-NOT transcription complex subunit 4, Mini-chromosome maintenance complex-binding protein, Integral membrane protein 2C, Protein C-ets-2, Interferon-induced 35 kDa protein, RNA-binding protein NOB1, Selenocysteine insertion sequence-binding protein 2, Enoyl-CoA delta isomerase 2, mitochondrial, Receptor tyrosine-protein kinase erbB-3, Partitioning defective 3 homolog B, F-box only protein 42, Brain-specific angiogenesis inhibitor 1-associated protein 2, Hemoglobin subunit gamma-2, Zinc transporter 6, La-related protein 4, Zinc transporter 7, Ribonuclease P protein subunit p30, Tensin-2, Volume-regulated anion channel subunit LRRC8E, Kinesin-like protein KIF3B, Cytochrome c oxidase assembly protein COX11, mitochondrial, Tripartite motif-containing protein 47, Monocarboxylate transporter 1, DDB1- and CUL4-associated factor 4, Kinesin-like protein KIF1A, Kinesin-like protein KIF13A, ATP synthase F(0) complex subunit B1, mitochondrial, LIM domain-containing protein ajuba, UDP-glucose 6-dehydrogenase, Transcriptional enhancer factor TEF-3, Midi-interacting protein 1, Lipase maturation factor 2, Ganglioside-induced differentiation-associated protein 2, BAG family molecular chaperone regulator 4, InaD-like protein, RNA binding protein fox-1 homolog 2, Protein TANC2, Probable E3 ubiquitin-protein ligase HECTD2, Medium-chain specific acyl-CoA dehydrogenase, mitochondrial, Prenylcysteine oxidase 1, Interferon alpha-inducible protein 27-like protein 2, RNA-binding protein 38, Ephrin-A1, Glycine dehydrogenase (decarboxylating), mitochondrial, Protein FAM50A, ELM2 and SANT domain-containing protein 1, UPF0668 protein C10orf76, Synaptonemal complex protein SC65, 5'-AMP-activated protein kinase catalytic subunit alpha-1, Peroxisome assembly protein 26, Thioredoxin domain-containing protein 5, Cell cycle and apoptosis regulator protein 2, X-box-binding protein 1, Protein YIF1A, PAB-dependent poly(A)-specific ribonuclease subunit PAN2, Methionine-R-sulfoxide reductase B1, Calcineurin-binding protein cabin-1, Protein RTF2 homolog, Endoplasmic reticulum-Golgi intermediate compartment protein 2, General transcription factor 3C polypeptide 3, N-acylneuraminate cytidylyltransferase, Zinc finger protein ZXDC, PRKCA-binding protein, Talin-2, SURP and G-patch domain-containing protein 2, Kinesin-1 heavy chain, Syntaxin-8, Galectin-3-binding protein, Ankyrin repeat and zinc finger domain-containing protein 1, E3 ubiquitin-protein ligase NEURL1B, Transcription and mRNA export factor ENY2, V-type proton ATPase 21 kDa proteolipid subunit, Probable RNA-binding protein 19, Selenoprotein O, Zinc finger protein 622, Origin recognition complex subunit 3, Serine/threonine-protein phosphatase 6 regulatory ankyrin repeat subunit A, 39S ribosomal protein L22, mitochondrial, Chromosome transmission fidelity protein 8 homolog isoform 2, Zinc finger protein 574, Ubiquitin-conjugating enzyme E2 T, Anthrax toxin receptor 2, Cilia- and flagella-associated protein 58, Mitogen-activated protein kinase-binding protein 1, Glucosamine 6-phosphate N-acetyltransferase, UPF0472 protein C16orf72, NAD(P) transhydrogenase, mitochondrial, E3 ubiquitin-protein ligase RNF220, Collagen alpha-1(XII) chain, Serine/threonine-protein kinase OSR1, Inositol-pentakisphosphate 2-kinase, General transcription factor IIH subunit 2, Polycomb group RING finger protein 6, Isocitrate dehydrogenase [NAD] subunit alpha, mitochondrial, Protein MMS22-like, HAUS augmin-like complex subunit 7, PIN2/TERF1-interacting telomerase inhibitor 1, Homeobox protein Hox-A13, Tubby-related protein 4, Golgi apparatus membrane protein TVP23 homolog B, Phosphoribosyl pyrophosphate synthase-associated protein 1, Protein phosphatase methylesterase 1, Uncharacterized aarF domain-containing protein kinase 5, Protein canopy homolog 4, Zinc transporter ZIP3, L-xylulose reductase, Protein S 100-A16, Zinc finger SWIM domain-containing protein 8, Charged multivesicular body protein 3, Aspartyl aminopeptidase, TSC22 domain family protein 4, 5'-AMP-activated protein kinase subunit gamma-1, CD99 antigen-like protein 2, CD81 antigen, Inositol 1,4,5-trisphosphate receptor-interacting protein, Ankyrin-2, Leucine-rich repeat protein SHOC-2, Angiomotin-like protein 2, Zinc finger protein 580, Proteasome subunit beta type-10, Torsin-1A-interacting protein 2, Centrosomal protein of 95 kDa, Securin, 26S protease regulatory subunit 8, Nucleoporin NUP53, Nicotinamide/nicotinic acid mononucleotide adenylyltransferase 1, Mediator of RNA polymerase II transcription subunit 13-like, Protein FAM172A, N-acetyl-D-glucosamine kinase, Hsp70-binding protein 1, Ribosomal RNA-processing protein 7 homolog A, Methylmalonic aciduria and homocystinuria type D protein, mitochondrial, Glycerol-3-phosphate dehydrogenase 1-like protein, 3-ketoacyl-CoA thiolase, mitochondrial, COMM domain-containing protein 6, Replication protein A 14 kDa subunit, Peptidyl-prolyl cis-trans isomerase CWC27 homolog, Uncharacterized protein C16orf45, NF-kappa-B inhibitor-interacting Ras-like protein 1, FRAS1-related extracellular matrix protein 2, Semaphorin-3C, Maturin, U11/U12 small nuclear ribonucleoprotein 48 kDa protein, Inactive tyrosine-protein kinase transmembrane receptor ROR1, Vacuolar protein sorting-associated protein 4B, UPF0469 protein KIAA0907, Melanoma-associated antigen D1, HLA class I histocompatibility antigen, alpha chain F, Zinc finger protein 506, Kinesin-like protein KIF22, Phosphatidylinositol 4-phosphate 3-kinase C2 domain-containing subunit alpha, Sarcosine dehydrogenase, mitochondrial, Glutamine and serine-rich protein 1, Alpha-parvin, Transmembrane protein 97, Importin subunit alpha-7, 60S ribosomal protein L11, TBC1 domain family member 22B, Neuronal calcium sensor 1, Glutamyl-tRNA(Gln) amidotransferase subunit C, mitochondrial, E3 ubiquitin-protein ligase RNF187, von Willebrand factor A domain-containing protein 5A, Class E basic helix-loop-helix protein 41, Box C/D snoRNA protein 1, C-terminal-binding protein 1, Acyl-CoA synthetase family member 4, Fos-related antigen 2, Mitofusin-1, Retinoic acid receptor gamma, Uncharacterized protein C17orf85, Very-long-chain (3R)-3-hydroxyacyl-CoA dehydratase 1, Tripartite motif-containing protein 65, Thioredoxin reductase 1, cytoplasmic, Cdc42 effector protein 3, Regulator of chromosome condensation, Glutamine-rich protein 1, Sphingosine-1-phosphate phosphatase 1, WD repeat-containing protein 92, Unconventional myosin-IXa, Biogenesis of lysosome-related organelles complex 1 subunit 4, Neurobeachin-like protein 1, Phosphomannomutase 1, Probable phospholipid-transporting ATPase IIA, Thioredoxin domain-containing protein 9, Inter-alpha-trypsin inhibitor heavy chain H5, E3 ubiquitin-protein ligase CBL, E3 SUMO-protein ligase PIAS1, Tenascin, NADH dehydrogenase [ubiquinone] iron-sulfur protein 6, mitochondrial, Glutathione synthetase, Ectonucleoside triphosphate diphosphohydrolase 4, V-type proton ATPase subunit B, brain isoform, TBC1 domain family member 14, DNA-directed RNA polymerases I and III subunit RPAC2, X-linked retinitis pigmentosa GTPase regulator, PTB domain-containing engulfment adapter protein 1, Protein Churchill, SUN domain-containing protein 1, E3 ubiquitin-protein ligase pellino homolog 3, Synembryn-A, SAP30-binding protein, Zinc finger and BTB domain-containing protein 7B, Ubinuclein-1, Cysteine-tRNA ligase, cytoplasmic, Protein FAM135A, PERQ amino acid-rich with GYF domain-containing protein 1, Cytochrome cl, heme protein, mitochondrial, FUN14 domain-containing protein 1, Isocitrate dehydrogenase [NAD] subunit gamma, mitochondrial, DNA damage-binding protein 2, Integrin beta-5, Histone-lysine N-methyltransferase 2A, KN motif and ankyrin repeat domain-containing protein 1, Small ubiquitin-related modifier 1, Derlin-3, Replication factor C subunit 3, Beta-crystallin B2, Elongator complex protein 6, Kelch domain-containing protein 2, Focadhesin, 26S proteasome non-ATPase regulatory subunit 7, U4/U6.U5 tri-snRNP-associated protein 2, Calpain-5, Cyclin E variant ex7del, BTB/POZ domain-containing protein 10, Beta-soluble NSF attachment protein, SMC5-SMC6 complex localization factor protein 2, WW domain-binding protein 2, F-box/WD repeat-containing protein 8, Ceramide synthase 2, WD repeat-containing protein WRAP73, Transmembrane protein 165, Zinc finger protein AEBP2, Charged multivesicular body protein 4a, Transcriptional adapter 3, Trafficking kinesin-binding protein 2, [Pyruvate dehydrogenase (acetyl-transferring)] kinase isozyme 4, mitochondrial, Cytochrome b-c1 complex subunit Rieske, mitochondrial, Protein bicaudal D homolog 2, Nibrin, SNW domain-containing protein 1, Sperm-associated antigen 5, TSC22 domain family protein 1, Corepressor interacting with RBPJ 1, Kinesin-like protein, General transcription factor II-I repeat domain-containing protein 1, RNA-binding protein PNO1, Vacuolar protein sorting-associated protein 52 homolog, Actin-related protein 5, Ran-binding protein 17, Intermediate filament family orphan 2, Ubiquitin-conjugating enzyme E2 G2, Myeloid leukemia factor 1, Poly(A) polymerase alpha, Protein IMPACT, Proto-oncogene tyrosine-protein kinase receptor Ret, Heat shock factor protein 1, PDZ domain-containing RING finger protein 4, Mothers against decapentaplegic homolog 4, RING finger protein 113A, Neuron navigator 3, Conserved oligomeric Golgi complex subunit 3, CASP8-associated protein 2, Glutathione S-transferase omega-1, BAH and coiled-coil domain-containing protein 1, Dynactin subunit 4, Transcription elongation factor B polypeptide 1, Tight junction-associated protein 1, Anaphase-promoting complex subunit 5, DNA replication ATP-dependent helicase/nuclease DNA2, Integrin alpha-9, Sarcospan, Catenin delta-1, Ankycorbin, Lamina-associated polypeptide 2, isoforms beta/gamma, Intraflagellar transport protein 74 homolog, Actin-related protein 8, Neuron-specific calcium-binding protein hippocalcin, Pre-mRNA-processing factor 40 homolog B, Tumor protein D54, Mitogen-activated protein kinase kinase kinase kinase 4, Myristoylated alanine-rich C-kinase substrate, Kinetochore protein Spc25, B9 domain-containing protein 1, Zinc finger homeobox protein 3, Membrane metallo-endopeptidase-like 1, Vesicle-associated membrane protein-associated protein B/C, Zinc finger CCCH domain-containing protein 11A, 60S ribosomal protein L39-like, Transcription initiation factor TFIID subunit 7, Transforming growth factor beta-1, Max-like protein X, tRNA pseudouridine synthase A, mitochondrial, Asparagine synthetase domain-containing protein 1, mRNA-capping enzyme, Zinc finger protein SNAI2, ETS translocation variant 1, 5'-AMP-activated protein kinase catalytic subunit alpha-2, Kinesin-like protein KIFC3, Cathepsin L1, Aspartyl/asparaginyl beta-hydroxylase, Leucine-rich repeat-containing protein 61, Zinc finger protein 721, Flavin reductase (NADPH), Voltage-dependent anion-selective channel protein 1, KH domain-containing, RNA-binding, signal transduction-associated protein 3, Probable E3 ubiquitin-protein ligase HERC6, ER membrane protein complex subunit 3, Homeobox protein Hox-B7, Zinc finger C2HC domain-containing protein 1A, T-box transcription factor TBX15, Putative zinc finger protein 724, Zinc finger protein 486, Zinc finger protein 675, Prolyl endopeptidase-like, UBX domain-containing protein 8, Gamma-aminobutyric acid receptor subunit pi, ATP-dependent RNA helicase DDX54, Lysine-specific demethylase 4B, Protocadherin-1, Zinc finger protein 490, NKG2D ligand 3, Uncharacterized protein C18orf63, Peptidyl-prolyl cis-trans isomerase B, Plasma alpha-L-fucosidase, Notchless protein homolog 1, Adenosine 3'-phospho 5'-phosphosulfate transporter 1, Nucleus accumbens-associated protein 1, Biorientation of chromosomes in cell division protein 1-like 1, CDK5 and ABL1 enzyme substrate 2, Putative tRNA (cytidine(32)/guanosine(34)-2'-O)-methyltransferase, tRNA-splicing endonuclease subunit Sen54, Beta-galactosidase-1-like protein 2, Protein archease, Formin-binding protein 1-like, Eukaryotic translation initiation factor 2 subunit 2, Centromere/kinetochore protein zwl 0 homolog, Pyridoxal kinase, Tyrosine-protein phosphatase non-receptor type 14, Phosphatidate cytidylyltransferase 2, M-phase phosphoprotein 8, Ribonuclease P/MRP protein subunit POP5, DENN domain-containing protein 5A, Nuclear receptor coactivator 6, UDP-N-acetylhexosamine pyrophosphorylase, Mediator of RNA polymerase II transcription subunit 22, Transcription factor COE2, Niban-like protein 1, GREB1-like protein, Vesicular integral-membrane protein VIP36, Dynactin subunit 6, Sperm-associated antigen 16 protein, Abelson tyrosine-protein kinase 2, Opioid growth factor receptor, Proteasomal ubiquitin receptor ADRM1, Gamma-aminobutyric acid receptor-associated protein, B-cell CLL/lymphoma 9-like protein, Retroviral-like aspartic protease 1, Procollagen-lysine,2-oxoglutarate 5-dioxygenase 3, Bifunctional arginine demethylase and lysyl-hydroxylase JMJD6, Histone-lysine N-methyltransferase SETD7, Ras-associated and pleckstrin homology domains-containing protein 1, Mortality factor 4-like protein 2, Kinesin-like protein KIF15, Pleckstrin homology-like domain family B member 1, Zinc finger protein ubi-d4, KxDL motif-containing protein 1, Transmembrane protein 160, Very long-chain specific acyl-CoA dehydrogenase, mitochondrial, Signal recognition particle receptor subunit beta, Small G protein signaling modulator 3, Sodium-dependent lysophosphatidylcholine symporter 1, DNA-directed RNA polymerase III subunit RPC5, Protein Tob2, UPF0488 protein C8orf33, DNA-directed RNA polymerase Ill subunit RPC2, Protein spire homolog 1, Spectrin beta chain, non-erythrocytic 2, Phosphatidylinositol transfer protein beta isoform, CCAAT/enhancer-binding protein beta, Ras and Rab interactor 2, Histone-lysine N-methyltransferase 2D, ADP-ribose pyrophosphatase, mitochondrial, Peptidyl-prolyl cis-trans isomerase FKBP14, Transcription factor AP-2 alpha (Activating enhancer binding protein 2 alpha), isoform CRA_c, Putative pituitary tumor-transforming gene 3 protein, WW domain-containing transcription regulator protein 1, AP-5 complex subunit sigma-1, Protein EFR3 homolog A, Tubulin polyglutamylase TTLL7, BolA-like protein 3, MORC family CW-type zinc finger protein 3, Cleavage stimulation factor subunit 2 tau variant, Pleckstrin homology domain-containing family A member 5, Coronin-2B, Arpin, Reticulon-1, Centrosomal protein of 41 kDa, NEDD8-conjugating enzyme Ubc12, Protein S100-A13, ATP synthase subunit a, Fibronectin type-III domain-containing protein 3A, Serine/threonine-protein phosphatase 2A 56 kDa regulatory subunit delta isoform, Lipase maturation factor 1, Pituitary tumor-transforming gene 1 protein-interacting protein, GRAM domain-containing protein 1B, DNA topoisomerase 3-alpha, Uncharacterized protein, Dynamin-1, Cell division cycle protein 23 homolog, Pre-mRNA-splicing factor SYF1, Focal adhesion kinase 1, SH2B adapter protein 1, Breast cancer metastasis-suppressor 1-like protein, Putative protein N-methyltransferase FAM86B1, Dual specificity protein kinase CLK1, Non-structural maintenance of chromosomes element 4 homolog A, Nephrocystin-1, Ectonucleoside triphosphate diphosphohydrolase 6, Protein LSM12 homolog, Tubulin-tyrosine ligase-like protein 12, Leucine-rich repeat-containing protein 57, Nuclear factor 1 C-type, Diphosphoinositol polyphosphate phosphohydrolase 3-alpha, Ras and Rab interactor 1, Acyl-CoA dehydrogenase family member 10, Coiled-coil domain-containing protein 115, Serine/threonine-protein kinase B-raf, Arf-GAP with GTPase, ANK repeat and PH domain-containing protein 3, 28S ribosomal protein S15, mitochondrial, E3 ubiquitin-protein ligase NEDD4, Monofunctional C1-tetrahydrofolate synthase, mitochondrial, 3-hydroxybutyrate dehydrogenase type 2, Cysteine-rich with EGF-like domain protein 1, Zinc finger MYM-type protein 1, Exostosin-like 2, LysM and putative peptidoglycan-binding domain-containing protein 2, SLAIN motif-containing protein 2, SWI/SNF complex subunit SMARCC1, Charged multivesicular body protein 1a, Cytochrome c oxidase assembly protein COX14, Uncharacterized protein KIAA1522, Kinesin-like protein KIF2C, Protein-cysteine N-palmitoyltransferase HHAT, Deoxyguanosine kinase, mitochondrial, Potassium voltage-gated channel subfamily G member 1, Thyroid transcription factor 1-associated protein 26, Centrosomal protein of 89 kDa, Leucine zipper putative tumor suppressor 1, Rap guanine nucleotide exchange factor 6, Histone-lysine N-methyltransferase EHMT2, Fanconi anemia group C protein, COBW domain-containing protein 5, MICAL-like protein 2, Zinc finger protein 217, Protein CASC3, GPI-anchor transamidase, Caspase-8, Centrin-1, Ubiquitin carboxyl-terminal hydrolase 43, Protein deglycase DJ-1, Zinc finger and BTB domain-containing protein 2, Dual specificity mitogen-activated protein kinase kinase 1, Rho-related GTP-binding protein RhoE, Reticulon-3, Sialin, Kit ligand, Nuclear receptor coactivator 3, Calmodulin-regulated spectrin-associated protein 2, Wiskott-Aldrich syndrome protein family member 2, Histone H1x, Mothers against decapentaplegic homolog 6, Activating transcription factor 7-interacting protein 2, Uncharacterized protein C17orf112, Leukocyte tyrosine kinase receptor, PRELI domain containing protein 3A, Sugar phosphate exchanger 3, Type I inositol 3,4-bisphosphate 4-phosphatase, E3 ubiquitin-protein ligase TRIM38, DNA primase small subunit, Pleckstrin homology-like domain family B member 2, GDH/6PGL endoplasmic bifunctional protein, D-beta-hydroxybutyrate dehydrogenase, mitochondrial, Ubiquitin carboxyl-terminal hydrolase isozyme L5, Chloride channel CLIC-like protein 1, Zinc finger SWIM domain-containing protein 7, mRNA-decapping enzyme 1A, Centromere protein J, G protein pathway suppressor 2, Protein CYR61, Rho guanine nucleotide exchange factor 35, Integrin alpha-7, Transcriptional coactivator YAP1, Spermatogenesis-associated serine-rich protein 2, Myotubularin-related protein 14, GATS-like protein 2, Oxidative stress-responsive serine-rich protein 1, Tigger transposable element-derived protein 2, Mediator of RNA polymerase II transcription subunit 20, Guanine nucleotide-binding protein G(I)/G(S)/G(O) subunit gamma-12, Mediator of RNA polymerase II transcription subunit 25, Protein FAM84B, Protein FAN, Nitric oxide synthase-interacting protein, Striatin, Phosducin-like protein, Protein fuzzy homolog, Tubby-related protein 3, SEC14 domain and spectrin repeat-containing protein 1, NHS-like protein 1, Lysine-specific demethylase 3A, TGF-beta-activated kinase 1 and MAP3K7-binding protein 2, LON peptidase N-terminal domain and RING finger protein 1, DNA topoisomerase 2-binding protein 1, MAP7 domain-containing protein 3, BRCA1-associated RING domain protein 1, DNA-directed RNA polymerase, mitochondrial, GAS2-like protein 3, Probable 8-oxo-dGTP diphosphatase NUDT15, Transmembrane and TPR repeat-containing protein 2, Selenoprotein N, Zinc finger protein 383, Tumor necrosis factor receptor superfamily member 3, Transmembrane protein 39A, Tetraspanin-10, Serine/threonine-protein kinase LATS2, BRF1 protein, Apoptosis-inducing factor 2, GLTSCR1-like protein, Calmodulin-binding transcription activator 1, Syndecan-3, Uncharacterized protein C1orf198, Cell division cycle protein 20 homolog, SH3 domain-containing protein 19, Ephrin-A5, Synphilin-1, SWI/SNF-related matrix-associated actin-dependent regulator of chromatin subfamily D member 1, Protein FAM204A, Dual specificity mitogen-activated protein kinase kinase 3, Germinal-center associated nuclear protein, Protein transport protein Sec24B, Putative UDP-GlcNAc:betaGal beta-1,3-N-acetylglucosaminyltransferase LOC100288842, Glycogenin-2, EF-hand calcium-binding domain-containing protein 11, ATP-dependent 6-phosphofructokinase, liver type, Hydroxyacylglutathione hydrolase-like protein, StAR-related lipid transfer protein 13, Dynactin subunit 3, Alpha-internexin, Dehydrogenase/reductase SDR family member on chromosome X, Transcription initiation factor IIA subunit 1, Copine-2, Acyl-CoA:lysophosphatidylglycerol acyltransferase 1, Dolichyl-diphosphooligosaccharide-protein glycosyltransferase subunit 4, Fas-activated serine/threonine kinase, Zinc finger CCCH domain-containing protein 7A, Golgin-45, Oxidoreductase HTATIP2, Neuronal regeneration-related protein, E3 ubiquitin-protein ligase TRIM23, Vacuolar protein sorting-associated protein 45, Sulfate anion transporter 1, Uncharacterized protein C5orf42, Small nuclear ribonucleoprotein Sm D3, Selenoprotein K, Bcl-2 homologous antagonist/killer, Mitochondrial peptide methionine sulfoxide reductase, Latent-transforming growth factor beta-binding protein 3, Uncharacterized protein C11orf80, Integrin alpha-11, A-kinase anchor protein 12, Ras-related protein Rab-1B, Acetyl-CoA carboxylase 2, RNA-binding motif protein, X-linked 2, Tubulin-specific chaperone C, Tensin-3, Uncharacterized protein CXorf57, ER lumen protein-retaining receptor 3, Disabled homolog 2-interacting protein, 7-methylguanosine phosphate-specific 5'-nucleotidase, Ataxin-2, Caveolin-2, Calcium-responsive transactivator, Melanophilin, Coiled-coil domain-containing protein 130, Alpha-actinin-3, Serine/threonine-protein kinase ULK3, Myelin expression factor 2, Multifunctional methyltransferase subunit TRM112-like protein, Protein FAM214A, Potassium voltage-gated channel subfamily KQT member 5, Sialate O-acetylesterase, Protein ELFN1, TATA-box-binding protein, Mitogen-activated protein kinase kinase kinase 12, Aurora kinase A-interacting protein, Tetratricopeptide repeat protein 12, Transcription factor E2F4, CAP-Gly domain-containing linker protein 4, Glutamine synthetase, Signal peptide peptidase-like 2A, Glucoside xylosyltransferase 1, GEM-interacting protein, Zinc finger protein 277, Ubiquitin carboxyl-terminal hydrolase 14, Calcium-binding mitochondrial carrier protein Aralar1, N(G),N(G)-dimethylarginine dimethylaminohydrolase 1, GTP-binding protein Rit1, Matrix Gla protein, Cell surface glycoprotein MUC18, Polypeptide N-acetylgalactosaminyltransferase 5, Calcyphosin, PEST proteolytic signal-containing nuclear protein, Serine/threonine-protein kinase Nek7, Calpain-3, Membrane-associated transporter protein, V-type proton ATPase subunit B, kidney isoform, Sialidase-4, Zinc finger protein 552, Colipase-like protein 2, ATP-binding cassette sub-family G member 1, Fumarate hydratase, mitochondrial, Protein phosphatase inhibitor 2, Tyrosine-protein kinase HCK, 2-oxoglutarate dehydrogenase, mitochondrial, Uncharacterized protein ENSP00000382042, Testicular acid phosphatase, Lysosomal acid phosphatase, Protein FAM195A, Nuclear inhibitor of protein phosphatase 1, Exosome complex component CSL4, Sodium-coupled neutral amino acid transporter 5, Protein arginine N-methyltransferase 5, Peptidase M20 domain-containing protein 2, Drebrin, NAD(P)H-hydrate epimerase, 1-phosphatidylinositol 4,5-bisphosphate phosphodiesterase beta-1, DCN1-like protein 2, DnaJ homolog subfamily B member 9, NACHT, LRR and PYD domains-containing protein 7, Cystatin-B, Fatty aldehyde dehydrogenase, D(2) dopamine receptor, Reticulon-2, COBW domain-containing protein 6, Myosin light chain 1/3, skeletal muscle isoform, Zinc finger Ran-binding domain-containing protein 2, Peptidyl-prolyl cis-trans isomerase FKBP1A, Immunoglobulin superfamily member 10, Olfactomedin-like protein 2B, Proteasome activator complex subunit 1, Putative uncharacterized protein C10orf113, Protein disulfide-isomerase TMX3, Plastin-2, Transmembrane protein 14D, Nck-associated protein 1-like, CXXC-type zinc finger protein 1, Guanine nucleotide-binding protein G(s) subunit alpha isoforms XLas, Integrator complex subunit 10, Protein FAM217A, HAUS augmin-like complex subunit 8, Mesoderm development candidate 1, Zinc finger protein 827, DNA-directed RNA polymerase I subunit RPA49, Symplekin, Protein spinster homolog 3, 28S ribosomal protein S9, mitochondrial, Melanocyte-stimulating hormone receptor, Enteropeptidase, Poly(A) polymerase gamma, Ribosomal RNA processing protein 1 homolog A, Disintegrin and metalloproteinase domain-containing protein 15, Activator of basal transcription 1, Ribonuclease K6, Centromere protein N, Olfactory receptor 5K3, N-acetyllactosaminide beta-1,6-N-acetylglucosaminyl-transferase, isoform A, Serine/threonine-protein phosphatase 6 regulatory subunit 1, Leukocyte-associated immunoglobulin-like receptor 1, 39S ribosomal protein L44, mitochondrial, Ig lambda-2 chain C regions, Sialoadhesin, Transmembrane inner ear expressed protein, Tetraspanin-18, Protein-glutamine gamma-glutamyltransferase 4, Endothelin-1 receptor, Protein FAM127A, Period circadian protein homolog 1, Autism susceptibility gene 2 protein, Voltage-dependent T-type calcium channel subunit alpha-1G, Protein Hook homolog 2, Cyclin-Y-like protein 2, BPI fold-containing family A member 2, Solute carrier family 2, facilitated glucose transporter member 2, Peroxidasin-like protein, Mitochondrial import receptor subunit TOM6 homolog, Phosphorylase b kinase gamma catalytic chain, skeletal muscle/heart isoform, Inosine-5'-monophosphate dehydrogenase 1, Proline and serine-rich protein 3, WD repeat-containing protein 54, Protein FAM117A, Carboxylesterase 3, Bardet-Biedl syndrome 7 protein, Exocyst complex component 5, Probable phospholipid-transporting ATPase VA, Pre-B-cell leukemia transcription factor-interacting protein 1, MICAL C-terminal-like protein, Protein transport protein Sec24C, Epiplakin, Inactive ubiquitin carboxyl-terminal hydrolase 17-like protein 4, Kinesin heavy chain isoform 5A, Hyaluronan and proteoglycan link protein 2, Intraflagellar transport protein 46 homolog, Kinesin-like protein KIF21 B, OTU domain-containing protein 6B, C—X—C motif chemokine 9, Uncharacterized protein CXorf23, Centrosomal protein of 170 kDa protein B, Testis-specific Y-encoded-like protein 2, Oxysterols receptor LXR-beta, Williams-Beuren syndrome chromosomal region 16 protein, Zinc finger protein 559, Glutamate-rich protein 3, GLIPR1-like protein 2, Pleckstrin homology domain-containing family G member 3, Putative vomeronasal receptor-like protein 4, Gamma-glutamyltransferase 6, Serine/threonine-protein kinase pim-3, Ribonuclease H2 subunit C, Neurexin-3, Mucin-16, Non-structural maintenance of chromosomes element 1 homolog, E2F-associated phosphoprotein, Actin-binding LIM protein 1, Non-canonical poly(A) RNA polymerase PAPD7, Nuclear receptor-binding factor 2, Gypsy retrotransposon integrase-like protein 1, Monocarboxylate transporter 4, Coiled-coil domain-containing protein 60, Inactive phospholipase D5, Microtubule cross-linking factor 1, ATP synthase subunit delta, mitochondrial, G patch domain-containing protein 2, Protein disulfide-isomerase A2, ATP-binding cassette sub-family A member 9, Unconventional myosin-Ih, Band 4.1-like protein 1, Gigaxonin, Acyl-CoA-binding domain-containing protein 6, Complement receptor type 2, Eukaryotic elongation factor 2 kinase, Large subunit GTPase 1 homolog, tRNA (uracil(54)-C(5))-methyltransferase homolog, Nectin-1, Zinc finger protein 460, Ras association domain-containing protein 2, SLIT-ROBO Rho GTPase-activating protein 3, ETS domain-containing protein Elk-4, Nucleoporin-like protein 2, U2 small nuclear ribonucleoprotein auxiliary factor 35 kDa subunit-related protein 2, Bestrophin-3, Heparan-alpha-glucosaminide N-acetyltransferase, Protein SGT1 homolog, Choline-phosphate cytidylyltransferase B, Fibrillin-3, GPALPP motifs-containing protein 1, Meiosis arrest female protein 1, ETS domain-containing protein Elk-3, Embigin, Protein TFG, Phosphomannomutase 2, V-type proton ATPase subunit G 1, T-box transcription factor TBX20, Beta-1,3-galactosyltransferase 5, Olfactory receptor 12D2, Laminin subunit alpha-5, Forkhead box protein O3, Tumor necrosis factor receptor superfamily member 18, Leukocyte elastase inhibitor, Solute carrier family 22 member 9, Nuclease EXOG, mitochondrial, Leucine-rich repeat LGI family member 4, Anosmin-1, Centrosomal protein of 152 kDa, Selenocysteine-specific elongation factor, Hairy/enhancer-of-split related with YRPW motif protein 1, Scaffold attachment factor B1, Cytochrome b-c1 complex subunit 2, mitochondrial, Tetratricopeptide repeat protein 8, Ubiquitin carboxyl-terminal hydrolase 1, Phospholipid phosphatase 5, Zinc finger protein 623, Zinc finger protein 791, Zinc finger protein with KRAB and SCAN domains 1, Zinc finger protein 397, O-acetyl-ADP-ribose deacetylase MACROD1, Ig lambda chain V-II region BOH, Ig kappa chain V-I region Walker, MYCBP-associated protein, 60S ribosomal protein L36a, Phospholipase ABHD3, TBC1 domain family member 9, Ras GTPase-activating protein 1, Solute carrier family 35 member E2B, Calcium channel flower homolog, T-cell-specific surface glycoprotein CD28, Sterile alpha motif domain-containing protein 9-like, Hydroxysteroid dehydrogenase-like protein 2, Tripartite motif-containing protein 26, Vitamin D 25-hydroxylase, Pre-mRNA-splicing factor SLU7, WD repeat-containing protein 75, Zinc finger protein 213, Zinc finger protein 845, Ras-related protein Rab-6A, Zinc finger protein 264, Estradiol 17-beta-dehydrogenase 8, Dual specificity protein phosphatase 16, Protein lin-7 homolog C, Major vault protein, Interferon-induced protein 44, Golgi pH regulator A, Ethanolamine kinase 1, Phosphatidylinositol 3-kinase regulatory subunit alpha, Protein phosphatase 1K, mitochondrial, Transmembrane protein 222, DC-STAMP domain-containing protein 2, Basic salivary proline-rich protein 4, Ig kappa chain V-I region WAT, Fibronectin, FERM domain-containing protein 3, Zinc finger protein 507, NADH dehydrogenase [ubiquinone] 1 alpha subcomplex subunit 8, Olfactory receptor 812, Dual adapter for phosphotyrosine and 3-phosphotyrosine and 3-phosphoinositide, Splicing factor 3A subunit 2, Dynein heavy chain 6, axonemal, HLA class I histocompatibility antigen, A-30 alpha chain, Tryptophan 2,3-dioxygenase, MKL/myocardin-like protein 1, Rho guanine nucleotide exchange factor 5, Protein phosphatase 2C-like domain-containing protein 1, Histatin-3, 60S ribosomal protein L36a-like, Cancer/testis antigen 47A, Centrosomal protein of 97 kDa, Thyroid hormone receptor-associated protein 3, Beta-galactoside alpha-2,6-sialyltransferase 2, Transcription factor ETV6, Gamma-glutamyltranspeptidase 1, Suppression of tumorigenicity 18 protein, Calpain-12, Neuropeptide FF receptor 1, AP-1 complex subunit gamma-like 2, Uncharacterized protein C2orf16, Programmed cell death protein 10, TBC1 domain family member 2B, Hematopoietic SH2 domain-containing protein, Thrombospondin type-1 domain-containing protein 7B, Paired box protein Pax-9, Mucin-3A, 5-phosphohydroxy-L-lysine phospho-lyase, Extracellular matrix protein FRAS1, Transmembrane protein 201, Monoacylglycerol lipase ABHD12, Low-density lipoprotein receptor-related protein 1 B, DENN domain-containing protein 1A, Basic helix-loop-helix domain-containing protein KIAA2018, Olfactory receptor 5H15, Leucine-rich repeat-containing protein 16A, Calcium/calmodulin-dependent protein kinase type 1, G-protein coupled receptor 98, Tumor suppressor candidate 2, Stress-associated endoplasmic reticulum protein 1, Annexin A7, Tetraspanin-8, 60S ribosomal protein L12, Probable ATP-dependent RNA helicase DDX52, Ribulose-phosphate 3-epimerase, Eukaryotic translation initiation factor 5B, Ubiquitin carboxyl-terminal hydrolase 40, Trace amine-associated receptor 6, Tetrapeptide repeat homeobox protein 1, Serine/threonine-protein phosphatase 4 regulatory subunit 2, Protein capicua homolog, Sphingomyelin phosphodiesterase 3, Sodium channel protein type 5 subunit alpha, Calcineurin subunit B type 2, Methylcrotonoyl-CoA carboxylase subunit alpha, mitochondrial, Kelch repeat and BTB domain-containing protein 12, Titin, NADH dehydrogenase [ubiquinone] 1 beta subcomplex subunit 1, Pre-mRNA-splicing factor SYF2, Zinc finger protein 215, Collagen alpha-6(VI) chain, Zinc finger protein 491, Phosphoenolpyruvate carboxykinase, cytosolic [GTP], Zinc finger protein 726, PDZ domain-containing protein 8, Zinc finger protein 470, Glucose-6-phosphate translocase, Protein bassoon, Ciliogenesis-associated TTC17-interacting protein, Heparan-sulfate 6-O-sulfotransferase 2, Stabilin-2, Desmoglein-2, Tumor necrosis factor ligand superfamily member 11, Arginase-1, Repetin, Potassium-transporting ATPase alpha chain 1, C1GALT1-specific chaperone 1, UPF0729 protein C18orf32, Cholesterol 24-hydroxylase, Spermidine synthase, TRAF-interacting protein with FHA domain-containing protein A, Protein FAM 173B, Leydig cell tumor 10 kDa protein homolog, Brain-specific angiogenesis inhibitor 1-associated protein 2-like protein 1, General transcription factor 3C polypeptide 4, Synaptojanin-2, Protein KIAA2022, Regulatory factor X-associated protein, Prefoldin subunit 3, Poly(ADP-ribose) glycohydrolase, Sorting nexin-29, 3-hydroxyisobutyryl-CoA hydrolase, mitochondrial, Oxysterol-binding protein 1, F-BAR and double SH3 domains protein 2, Remodeling and spacing factor 1, Zymogen granule protein 16 homolog B, Ubiquitin carboxyl-terminal hydrolase 3, Rap guanine nucleotide exchange factor 2, Dynein heavy chain 1, axonemal, Dedicator of cytokinesis protein 3, Nucleoporin p58/p45, MARCKS-related protein, MARVEL domain-containing protein 2, ADP-ribosylation factor-binding protein GGA2, Cancer-related nucleoside-triphosphatase, Unconventional myosin-Vllb, Cyclin-dependent kinase-like 5, Dol-P-Glc:Glc(2)Man(9)GlcNAc(2)-PP-Dol alpha-1,2-glucosyltransferase, Leucine-rich repeat-containing protein 40, Solute carrier family 7 member 13, Aromatase, Thromboxane-A synthase, Hypoxia up-regulated protein 1, Translin, ADP-ribosylation factor-like protein 11, Peptidylprolyl isomerase domain and WD repeat-containing protein 1, Proto-oncogene vav, Protein mab-21-like 3, Suppressor of tumorigenicity 7 protein-like, Apolipoprotein B receptor, Dystrophin-related protein 2, Orexin receptor type 1, Nucleolar protein 16, 60S ribosomal protein L29, Potassium-transporting ATPase alpha chain 2, Sodium-driven chloride bicarbonate exchanger, Uncharacterized protein C9orf171, Ankyrin repeat and LEM domain-containing protein 1, Vasohibin-2, Putative nuclease HARBI1, Hyaluronidase-4, G-protein coupled receptor family C group 6 member A, Nucleoporin Nup43, Delta(14)-sterol reductase, Phospholipid-transporting ATPase ID, GTP-binding protein 1, G patch domain-containing protein 8, IQ motif and SEC7 domain-containing protein 1, Selenoprotein S, DnaJ homolog subfamily C member 13, Leucine-rich repeat and fibronectin type-III domain-containing protein 4, Dynein heavy chain 9, axonemal, Dynein heavy chain 10, axonemal, Echinoderm microtubule-associated protein-like 4, Melatonin receptor type 1A, CTP synthase 2, Ubiquitin-like modifier-activating enzyme ATG7, Carboxy-terminal domain RNA polymerase II polypeptide A small phosphatase 1, Neutrophil cytosol factor 4, Collagen alpha-2(IV) chain, Protein unc-13 homolog C, TBC1 domain family member 4, Acyl-coenzyme A synthetase ACSM5, mitochondrial, FH1/FH2 domain-containing protein 1, FYVE, RhoGEF and PH domain-containing protein 5, Cilia- and flagella-associated protein 54, Alpha-ketoglutarate-dependent dioxygenase alkB homolog 7, mitochondrial, WD repeat-containing protein 7, Transcription factor SOX-30, Cationic amino acid transporter 3, Mitogen-activated protein kinase kinase kinase 10, Glypican-4, Transmembrane protein with metallophosphoesterase domain, Transcription factor SOX-6, 28S ribosomal protein S14, mitochondrial, Steroid 21-hydroxylase, XK-related protein 5, N-acetylated-alpha-linked acidic dipeptidase 2, Mucin-17, Butyrophilin-like protein 8, Zinc finger protein 28, Major facilitator superfamily domain-containing protein 9, Small nuclear ribonucleoprotein-associated protein N, Coiled-coil domain-containing protein 42A, Frizzled-4, Putative tripartite motif-containing protein 49B, C—C chemokine receptor type 9, Centrosomal protein of 72 kDa, Adenosine receptor A2b, Protein CREG1, P2X purinoceptor 7, F-box only protein 44, BEN domain-containing protein 1, Rho guanine nucleotide exchange factor 11, Lethal(3)malignant brain tumor-like protein 3, Metalloreductase STEAP2, CD97 antigen, Putative uncharacterized protein ENSP00000381562, Ubiquitin carboxyl-terminal hydrolase isozyme L3, Transmembrane protein 114, Leucine-twenty homeobox, Protein Tob1, Deoxyribonuclease-1-like 1, Neuronal acetylcholine receptor subunit alpha-4, Lymphocyte antigen 86, Dentin matrix acidic phosphoprotein 1, Striatin-interacting protein 1, Zinc finger protein 425, Inactive phospholipase C-like protein 1, Tyrosine-protein phosphatase non-receptor type 2, SPARC-related modular calcium-binding protein 1, NACHT, LRR and PYD domains-containing protein 4, Olfactory receptor 4K1, BUB3-interacting and GLEBS motif-containing protein ZNF207, Protein SSX4, Putative uncharacterized protein ENSP00000383407, von Willebrand factor A domain-containing protein 5B2, Cytochrome c oxidase subunit 8C, mitochondrial, Retrotransposon gag domain-containing protein 1, Nuclear receptor coactivator 2, Laminin subunit alpha-2, Toll-like receptor 3, Transmembrane channel-like protein 2, Clathrin coat assembly protein AP180, RING finger protein 148, Zinc finger protein ZFPM2, Cerebral dopamine neurotrophic factor, Testis- and ovary-specific PAZ domain-containing protein 1, Vomeronasal type-1 receptor 3, Receptor expression-enhancing protein 2, Secretogranin-1, Protocadherin-19, Protein RMD5 homolog A, Protein dopey-2, Protein FAM193A, Vesicle transport protein SFT2B, C—X—C chemokine receptor type 4, Sialic acid-binding Ig-like lectin 9, Leucine-rich repeat and calponin homology domain-containing protein 2, Dynein regulatory complex protein 1, Gamma-aminobutyric acid receptor subunit delta, Anaphase-promoting complex subunit CDC26, Nuclear transcription factor Y subunit alpha, Unconventional myosin-XV, Olfactory receptor 5D18, Sodium- and chloride-dependent glycine transporter 2, Peroxiredoxin-4, Leucine-rich repeat-containing protein 26, Dystrophia myotonica WD repeat-containing protein, Zinc finger protein 853, Integrin beta-6, AF4/FMR2 family member 2, RAS guanyl-releasing protein 2, Coiled-coil domain-containing protein 8, Cornulin, Metastasis-associated in colon cancer protein 1, Mitochondrial import inner membrane translocase subunit Tim17-B, Protocadherin Fat 4, Transmembrane protein 205, CX3C chemokine receptor 1, Inositol polyphosphate 5-phosphatase K, Torsin-3A, PAX-interacting protein 1, G protein-regulated inducer of neurite outgrowth 3, Class A basic helix-loop-helix protein 15, Glutathione peroxidase 7, N-terminal EF-hand calcium-binding protein 2, Ig heavy chain V-II region MCE, CDGSH iron-sulfur domain-containing protein 3, mitochondrial, Apolipoprotein L6, Synapsin-2, Chloride transport protein 6, dCTP pyrophosphatase 1, Histamine H1 receptor, Pyruvate dehydrogenase protein X component, mitochondrial, Mismatch repair endonuclease PMS2, CD160 antigen, Solute carrier family 15 member 3, tRNA dimethylallyltransferase, mitochondrial, Voltage-dependent L-type calcium channel subunit alpha-1D, Ras-related protein Rab-30, Colorectal mutant cancer protein, Beta-1,4-galactosyltransferase 6, Exophilin-5, Ribosome biogenesis protein TSR3 homolog, Actin filament-associated protein 1-like 2, Eukaryotic peptide chain release factor GTP-binding subunit ERF3B, Cytochrome c oxidase subunit 5A, mitochondrial, Protein ENL, CD2 antigen cytoplasmic tail-binding protein 2, Neurabin-2, von Willebrand factor A domain-containing protein 9, Ubiquitin carboxyl-terminal hydrolase 47, Mitochondrial carrier homolog 2, Max-binding protein MNT, Nuclear pore complex protein Nup85, N-alpha-acetyltransferase 35, NatC auxiliary subunit, Cyclic GMP-AMP synthase, Myosin light chain kinase 2, skeletal/cardiac muscle, C-type lectin domain family 4 member F, Proteasome assembly chaperone 4, Cytochrome c oxidase assembly protein COX15 homolog, R3H domain-containing protein 2, Protein FAM46A, DnaJ homolog subfamily C member 10, Androglobin, Ankyrin repeat domain-containing protein 13C, Eyes absent homolog 1, Histone-lysine N-methyltransferase EZH2, Bystin, Dipeptidyl peptidase 3, Deleted in malignant brain tumors 1 protein, Pleckstrin homology domain-containing family B member 1, Multidrug resistance-associated protein 4, CapZ-interacting protein, Mucin-20, AFG3-like protein 2, Obscurin, Lipase member J, Protein phosphatase 1 regulatory subunit 14B, Kinesin-like protein KIFC2, Sorting nexin-19, Mucin-7, Putative uncharacterized protein FLJ37218, Protein FAM78A, Cytochrome c oxidase subunit 7B, mitochondrial, 39S ribosomal protein L17, mitochondrial, CLOCK-interacting pacemaker, DNA-binding protein RFX7, Protein EVI2B, Copper-transporting ATPase 2, NADH dehydrogenase [ubiquinone] 1 beta subcomplex subunit 8, mitochondrial, Core-binding factor subunit beta, CWF19-like protein 2, E3 ubiquitin-protein ligase RING1, Ubiquitin-conjugating enzyme E2 A, Deoxyribonuclease-2-alpha, Intraflagellar transport protein 80 homolog, Protein yippee-like 3, Calcium-dependent secretion activator 1, Protein YIPF1, 7-dehydrocholesterol reductase, Gamma-tubulin complex component 6, Intraflagellar transport protein 140 homolog, Nuclear pore membrane glycoprotein 210-like, Ribonuclease 3, Protein S100-A7, Protein AF-17, Fanconi anemia group E protein, NEDD8-activating enzyme E1 catalytic subunit, WD repeat-containing protein 97, Hematological and neurological expressed 1 protein, Uncharacterized protein C20orf195, Putative glycosylation-dependent cell adhesion molecule 1, Nucleolar and coiled-body phosphoprotein 1, Intraflagellar transport protein 88 homolog, Syndecan-1, XK-related protein 9, Uncharacterized protein C9orf78, cTAGE family member 5, Glutaryl-CoA dehydrogenase, mitochondrial, BMP/retinoic acid-inducible neural-specific protein 2, Homeodomain-interacting protein kinase 3, Bone marrow stromal antigen 2, Myocyte-specific enhancer factor 2C, Stromal cell-derived factor 2, Lymphoid-restricted membrane protein, Myosin-binding protein H-like, WD repeat-containing protein 5, Disintegrin and metalloproteinase domain-containing protein 17, Cerebral cavernous malformations 2 protein, DNA dC→dU-editing enzyme APOBEC-3C, Protein FAM185A, Far upstream element-binding protein 2, Vacuolar protein sorting-associated protein VTA1 homolog, TBC1 domain family member 30, Intercellular adhesion molecule 1, Vesicular, overexpressed in cancer, prosurvival protein 1, Translocating chain-associated membrane protein 2, Target of Nesh-SH3, Serine/threonine-protein kinase VRK1, Uncharacterized protein DKFZp434B061, Putative coiled-coil-helix-coiled-coil-helix domain-containing protein CHCHD2P9, mitochondrial, Ataxin-7, Eukaryotic translation initiation factor 3 subunit G, Serine/threonine-protein phosphatase 2A 65 kDa regulatory subunit A beta isoform, Exocyst complex component 3, Cathepsin B, G1/S-specific cyclin-E1, Ubiquitin carboxyl-terminal hydrolase 30, Ubiquitin carboxyl-terminal hydrolase 51, Interleukin-1 receptor accessory protein-like 1, Ankyrin-1, Transmembrane protein 106C, Phosphatidylinositol transfer protein alpha isoform, Transportin-2, Polyhomeotic-like protein 3, Charged multivesicular body protein 2b, Ubiquitin D, RING finger protein unkempt homolog, Protein SMG7, E3 ubiquitin-protein ligase RNF144A, Mediator of RNA polymerase II transcription subunit 15, Cytochrome c oxidase subunit 8A, mitochondrial, NADH dehydrogenase [ubiquinone] flavoprotein 3, mitochondrial, Calcipressin-1, Vesicle-fusing ATPase, Putative ATP-dependent RNA helicase DHX33, Alpha-synuclein, Carbonic anhydrase 2, Complement factor H, RalBP1-associated Eps domain-containing protein 2, Semaphorin-3A, Core histone macro-H2A.2, Melanotransferrin, SKI family transcriptional corepressor 2, Collagen alpha-1 (VI) chain, Dachshund homolog 1, Protein BTG1, Cyclin-dependent kinase 18, T-box transcription factor TBX2, IgGFc-binding protein, Voltage-dependent L-type calcium channel subunit alpha-1C, Zinc finger protein 516, Guanine nucleotide-binding protein G(olf) subunit alpha, Melanoma-associated antigen 9, Protocadherin gamma-B2, RING finger protein 112, Transcription factor SOX-10, Peroxisome assembly protein 12, Collagen alpha-1(XI) chain, Tripartite motif-containing protein 67, H(+)/Cl(−) exchange transporter 5, Probable phospholipid-transporting ATPase VB, Aldose reductase, Receptor-type tyrosine-protein phosphatase zeta, Kinesin-like protein KIF2A, Arginyl-tRNA-protein transferase 1, ATP synthase subunit epsilon, mitochondrial, Alpha-protein kinase 2, Putative hexokinase HKDC1, Metastasis-associated protein MTA1, Seizure 6-like protein 2, Chloride channel protein 2, RNA 3'-terminal phosphate cyclase, Poly(rC)-binding protein 4, Oxidation resistance protein 1, Kinesin light chain 4, E3 ubiquitin-protein ligase TRIM33, Receptor-type tyrosine-protein phosphatase gamma, Chromobox protein homolog 8, Cathepsin F, Integrin beta-8, C-type lectin domain family 11 member A, Keratin, type I cytoskeletal 27, Ankyrin repeat and SAM domain-containing protein 1A, Eukaryotic translation initiation factor 2-alpha kinase 4, Transforming growth factor-beta-induced protein ig-h3, Jerky protein homolog, Fucose-1-phosphate guanylyltransferase, ATP-binding cassette sub-family A member 13, Sodium-dependent phosphate transporter 2, Outer dense fiber protein 2-like, G1/S-specific cyclin-D1, Phosphatidylinositol 3-kinase catalytic subunit type 3, Immunity-related GTPase family Q protein, Transmembrane O-methyltransferase, Sulfate transporter, Protein eva-1 homolog A, Putative tyrosine-protein phosphatase auxilin, Ankyrin repeat and SOCS box protein 11, Protein cordon-bleu, Bestrophin-1, Putative ribosome-binding factor A, mitochondrial, Protocadherin gamma-A2, Formin-1, Nuclear receptor subfamily 1 group D member 2, Interleukin-17 receptor D, Rootletin, Serine incorporator 5, Glutamate receptor ionotropic, kainate 3, Plexin-A2, tRNA (uracil-5-)-methyltransferase homolog A, WD repeat-containing protein 60, Hemicentin-1, E3 ubiquitin-protein ligase MIB2, Lysosome-associated membrane glycoprotein 1, Dynein heavy chain domain-containing protein 1, Uncharacterized protein C17orf51, UPF0669 protein C6orf120, La-related protein 7, DNA-binding protein RFX5, Alpha-1-syntrophin, Nance-Horan syndrome protein, Dickkopf-related protein 3, Voltage-dependent T-type calcium channel subunit alpha-1H, HLA class I histocompatibility antigen, A-69 alpha chain, F-box/LRR-repeat protein 18, Arrestin domain-containing protein 1, Membrane-associated guanylate kinase, WW and PDZ domain-containing protein 2, Receptor-type tyrosine-protein phosphatase mu, Thioredoxin domain-containing protein 12, Adhesion G protein-coupled receptor A3, Proline synthase co-transcribed bacterial homolog protein, Solute carrier family 52, riboflavin transporter, member 2, Cystic fibrosis transmembrane conductance regulator, Kinesin-like protein KIF3C, Endothelin B receptor, Sideroflexin-3, Tubulin alpha-3E chain, SH3 domain-containing RING finger protein 3, GTP-binding protein Di-Ras2, Low-density lipoprotein receptor-related protein 2, Pirin, Trinucleotide repeat-containing gene 6C protein, Fanconi anemia group B protein, Coagulation factor VIII, E3 ubiquitin-protein ligase TRIM13, Lysophosphatidic acid receptor 1, Collagen alpha-1(XXII) chain, Low affinity sodium-glucose cotransporter, Density-regulated protein, Uncharacterized protein C15orf52, Zinc finger SWIM domain-containing protein 6, Protocadherin gamma-A12, Importin subunit alpha-3, Cubilin, Putative segment polarity protein dishevelled homolog DVL1P1, Aggrecan core protein, Prohibitin-2, Rho GTPase-activating protein 33, Myotubularin-related protein 3, Phosphorylase b kinase regulatory subunit alpha, skeletal muscle isoform, Biotin-protein ligase, 1-phosphatidylinositol 4,5-bisphosphate phosphodiesterase beta-4, Protein AHNAK2, Inosine triphosphate pyrophosphatase, Cadherin-2, DNA helicase MCM9, Putative signal peptidase complex catalytic subunit SEC11 B, Maestro heat-like repeat-containing protein family member 6, Prolyl 4-hydroxylase subunit alpha-2, Integral membrane protein DGCR2/IDD, Zinc finger protein 469, Sorbin and SH3 domain-containing protein 1, Multidrug resistance-associated protein 5, Down syndrome critical region protein 3, V-set and immunoglobulin domain-containing protein 10-like, Coronin-6, Kinesin-like protein KIF13B, Tribbles homolog 2, STAM-binding protein, Zinc finger E-box-binding homeobox 2, FERM domain-containing protein 5, Tropomodulin-2, Lymphoid enhancer-binding factor 1, General receptor for phosphoinositides 1-associated scaffold protein, Dedicator of cytokinesis protein 10, Protein ITFG3, Heat shock protein beta-8, Secretory phospholipase A2 receptor, FYVE, RhoGEF and PH domain-containing protein 6, Ankyrin repeat domain-containing protein SOWAHB, Nurim, Integral membrane protein GPR137C, Keratin, type II cytoskeletal ib, Netrin receptor UNC5A, Receptor-type tyrosine-protein phosphatase C, UPF0606 protein KIAA1549, RNA-binding protein Nova-1, Zinc finger protein 317, Lysophosphatidylcholine acyltransferase 2, Aspartate aminotransferase, mitochondrial, Histone-lysine N-methyltransferase SETDB1, Frizzled-1, ATP-binding cassette sub-family C member 11, Arf-GAP with SH3 domain, ANK repeat and PH domain-containing protein 3, Sodium-dependent phosphate transport protein 2C, Dynein light chain 4, axonemal, Cyclin-dependent kinase 3, Vitamin K-dependent gamma-carboxylase, BTB/POZ domain-containing protein KCTD15, Cyclin-related protein FAM58A, Tripartite motif-containing protein 2, Calcium/calmodulin-dependent 3',5'-cyclic nucleotide phosphodiesterase 1C, Guanine nucleotide-binding protein subunit beta-4, Ubiquitin-like-conjugating enzyme ATG10, Protein SMG8, Putative bifunctional UDP-N-acetylglucosamine transferase and deubiquitinase ALG13, Protein naked cuticle homolog 1, Protein S100-A1, Paraneoplastic antigen Ma2, Transmembrane protein 106B, Hephaestin, POU domain, class 2, transcription factor 1, Maltase-glucoamylase, intestinal, Kelch domain-containing protein 8B, VWFA and cache domain-containing protein 1, Adenylate kinase isoenzyme 5, BTB/POZ domain-containing protein KCTD9, Ankyrin-3, TBC1 domain family member 8B, Intraflagellar transport protein 56, G-protein coupled receptor 56, Protocadherin Fat 3, Cortactin-binding protein 2, 5,6-dihydroxyindole-2-carboxylic acid oxidase, Multidrug and toxin extrusion protein 1, Peroxisome biogenesis factor 1, NADH dehydrogenase [ubiquinone] 1 alpha subcomplex subunit 9, mitochondrial, Ropporin-1A, Histone deacetylase 11, Collagen alpha-1(VIII) chain, Zinc finger HIT domain-containing protein 1, Citron Rho-interacting kinase, Uncharacterized protein C20orf194, Sodium/potassium/calcium exchanger 1, Paired box protein Pax-1, Homeobox protein TGIF1, Transmembrane 9 superfamily member 4, CUB and sushi domain-containing protein 1, FRAS1-related extracellular matrix protein 1, Leucine-rich repeat protein 1, Protein FAM127B, 2-hydroxyacylsphingosine 1-beta-galactosyltransferase, Glioma tumor suppressor candidate region gene 1 protein, Tectonic-1, Zinc finger protein 618, Palmitoyl-protein thioesterase 1, Serine/threonine-protein kinase 36, Tetratricopeptide repeat protein 31, Neurobeachin, Adenosylhomocysteinase 3, Sickle tail protein homolog, Fibrocystin, Mastermind-like protein 2, Frizzled-8, Vesicle transport protein SFT2C, Pecanex-like protein 2, Suppression of tumorigenicity 5 protein, Zinc finger and BTB domain-containing protein 10, Matrix metalloproteinase-24, Peroxisomal biogenesis factor 19, Protein piccolo, Prostaglandin reductase 1, Electrogenic sodium bicarbonate cotransporter 4, Neuronal PAS domain-containing protein 3, Homeobox even-skipped homolog protein 2, Keratin, type II cytoskeletal 3, Protein Jumonji, Lipoprotein lipase, Interferon alpha-inducible protein 27, mitochondrial, Zinc finger ZZ-type and EF-hand domain-containing protein 1, Mesoderm induction early response protein 3, Equilibrative nucleoside transporter 1, Prominin-2, Zinc finger and BTB domain-containing protein 39, Heat shock 70 kDa protein 12A, Sodium- and chloride-dependent creatine transporter 1, Rho GTPase-activating protein 23, Ciliary neurotrophic factor, Sodium-dependent multivitamin transporter, Elastin, Bifunctional heparan sulfate N-deacetylase/N-sulfotransferase 3, 28 kDa heat- and acid-stable phosphoprotein, Receptor-type tyrosine-protein phosphatase T, Protein farnesyltransferase subunit beta, Contactin-associated protein-like 3B, DnaJ homolog subfamily B member 11, Actin-like protein 6B, G-protein coupled receptor 143, Purine nucleoside phosphorylase, Testis anion transporter 1, Disco-interacting protein 2 homolog C, Zinc transporter ZIP14, RNA pseudouridylate synthase domain-containing protein 1, E3 ubiquitin-protein ligase HERC2, Lysophosphatidic acid phosphatase type 6, Glucocorticoid modulatory element-binding protein 2, Complement receptor type 1, Fibrillin-2, Tyrosine-protein phosphatase non-receptor type substrate 1, Myosin-Illb, Collagen alpha-2(XI) chain, Collagen alpha-1(Ill) chain, Collagen alpha-3(IV) chain, REST corepressor 2, Collagen alpha-1(V) chain, Tyrosine-protein phosphatase non-receptor type 21, FH2 domain-containing protein 1, CDK-activating kinase assembly factor MAT1, Alpha-1,3-mannosyl-glycoprotein 4-beta-N-acetylglucosaminyltransferase B, Protein-methionine sulfoxide oxidase MICAL1, A-kinase anchor protein 8, Ribosomal protein S6 kinase alpha-6, Keratin, type II cytoskeletal 71, PH-interacting protein, Polyadenylate-binding protein 2, Hemicentin-2, Complement C3, Biotinidase, T-cell immunomodulatory protein, Zinc finger CCCH domain-containing protein 14, Neuronal cell adhesion molecule, Ropporin-1B, Centrosomal protein C10orf90, Growth/differentiation factor 15, Sex comb on midleg-like protein 2, Echinoderm microtubule-associated protein-like 6, Fibrocystin-L, DIS3-like exonuclease 1, Carbonic anhydrase 14, Vesicle-trafficking protein SEC22c, Leucine-rich repeat-containing protein C10orf11, Zinc finger protein 879, UDP-galactose translocator, Alpha/beta hydrolase domain-containing protein 13, Protein EURL homolog, Porphobilinogen deaminase, Microtubule-associated proteins 1A/1B light chain 3B, Melanoma-derived growth regulatory protein, Platelet-derived growth factor D, Probable dimethyladenosine transferase, Ras association domain-containing protein 5, Consortin, Transcription factor Sp1, Derlin-2, Solute carrier family 25 member 35, Inositol 1,4,5-trisphosphate receptor type 2, Mannose-6-phosphate isomerase, RNA-binding Raly-like protein, Syntaxin-7, Exonuclease 3'-5' domain-containing protein 2, Globoside alpha-1,3-N-acetylgalactosaminyltransferase 1, Acyl-CoA synthetase short-chain family member 3, mitochondrial, Pleckstrin homology domain-containing family H member 1, Mitochondrial tRNA-specific 2-thiouridylase 1, UDP-glucose 4-epimerase, Voltage-dependent calcium channel subunit alpha-2/delta-2, Kinesin-like protein KIF1B, Carbonic anhydrase-related protein, Tribbles homolog 1, Lecithin retinol acyltransferase, Tissue-type plasminogen activator, Laminin subunit beta-1, Zinc finger protein basonuclin-1, T-lymphoma invasion and metastasis-inducing protein 1, Adipocyte enhancer-binding protein 1, Estradiol 17-beta-dehydrogenase 11, LINE-1 retrotransposable element ORF2 protein, Zinc finger and SCAN domain-containing protein 25, AP2-associated protein kinase 1, Fibrous sheath-interacting protein 2, Heat shock factor protein 4, Leucine-rich repeat-containing G-protein coupled receptor 6, Interferon-induced transmembrane protein 10, E3 ubiquitin-protein ligase RNF13, Potassium/sodium hyperpolarization-activated cyclic nucleotide-gated channel 4, Protein wntless homolog, Integrin-alpha FG-GAP repeat-containing protein 2, Neprilysin, Leucine-rich repeat-containing protein 34, Armadillo repeat-containing X-linked protein 2, G protein-coupled receptor kinase 4, G protein-coupled receptor kinase 6, T-cell surface glycoprotein CD8 beta chain, Sorting nexin-13, Methylcrotonoyl-CoA carboxylase beta chain, mitochondrial, Elongator complex protein 4, Mitochondrial calcium uniporter regulator 1, Zinc finger protein 382, Ubiquitin-conjugating enzyme E2 N, Diacylglycerol kinase zeta, Protein unc-119 homolog A, Alpha-2-macroglobulin, Sprouty-related, EVH1 domain-containing protein 1, Zinc finger protein castor homolog 1, Protein-methionine sulfoxide oxidase MICAL3, Phosphorylase b kinase regulatory subunit beta, Tubulin alpha-1A chain, Multidrug resistance-associated protein 7, B-cell CLL/lymphoma 9 protein, Collagen alpha-1(IV) chain, Nebulin, Serine/arginine-rich splicing factor 4, Unconventional myosin-Vlla, Calcium-binding mitochondrial carrier protein SCaMC-2, 28S ribosomal protein S2, mitochondrial, Upstream stimulatory factor 2, Sodium/potassium/calcium exchanger 5, Protein sidekick-1, Melanoma-associated antigen 6, Vesicle transport protein USE1, SLIT-ROBO Rho GTPase-activating protein 2C, Plexin-A3, E3 ubiquitin-protein ligase RNF139, Probable ATP-dependent RNA helicase DHX58, Serine/threonine-protein kinase Sgk3, Kin of IRRE-like protein 1, Lactoperoxidase, SH3 domain-binding protein 4, Centromere protein R, Pleckstrin homology domain-containing family M member 2, Atrial natriuretic peptide receptor 2, Laminin subunit beta-2, Zinc finger protein ZIC 1, Puratrophin-1, High affinity cAMP-specific and IBMX-insensitive 3',5'-cyclic phosphodiesterase 8B, Threonine synthase-like 2, Interleukin-24, Phosphatidylinositol 4,5-bisphosphate 3-kinase catalytic subunit beta isoform, Neuron navigator 1, KDEL motif-containing protein 1, Ceramide synthase 1, COX assembly mitochondrial protein homolog, DnaJ homolog subfamily A member 4, Anion exchange protein 3, Adenylate cyclase type 1, Plexin-D1, Procollagen galactosyltransferase 1, Insulin-like growth factor 1 receptor, Transcriptional protein SWT1, Copine-9, Protein HEG homolog 1, Transmembrane protein 98, Zinc finger protein ZIC 2, RAC-gamma serine/threonine-protein kinase, Protein FAM184A, Transcription factor Dp-2, Non-receptor tyrosine-protein kinase TNK1, GPI mannosyltransferase 1, Solute carrier family 41 member 2, RNA-binding motif protein, X chromosome, Alpha-fetoprotein, Membrane progestin receptor alpha, Centrosomal protein of 135 kDa, Melanoma-associated antigen B1, Protein lifeguard 4, Zinc finger protein ZFAT, Zinc finger protein 92, Zinc finger protein 708, Digestive organ expansion factor homolog, Protein shisa-4, Alpha-2-macroglobulin-like protein 1, Collagen alpha-1(XX) chain, Mitochondrial dicarboxylate carrier, Voltage-dependent calcium channel subunit alpha-2/delta-1, Thioredoxin domain-containing protein 15, Calpain-2 catalytic subunit, Protein-glutamine gamma-glutamyltransferase 5, CCR4-NOT transcription complex subunit 3, Putative RNA exonuclease NEF-sp, Torsin-1B, General transcription factor IIH subunit 3, RWD domain-containing protein 1, N-terminal kinase-like protein, Transmembrane and coiled-coil domain-containing protein 3, Contactin-associated protein-like 4, Armadillo repeat protein deleted in velo-cardio-facial syndrome, RNA-binding protein 20, Coiled-coil domain-containing protein 180, Protein Bop, Serine/threonine-protein kinase MRCK gamma, Probable palmitoyltransferase ZDHHC24, Zinc finger X-linked protein ZXDA, Zinc transporter ZIP1, Tastin, Mitochondrial dynamics protein MID49, Transmembrane protein 132B, Ephrin type-B receptor 3, Glypican-6, F-box only protein 46, Probable E3 SUMO-protein ligase RNF212, Matrix metalloproteinase-17, Serine/threonine-protein kinase 32A, Adhesion G-protein coupled receptor F3, Sorting nexin-10, BTB/POZ domain-containing protein 1, Phosphatidylinositol 5-phosphate 4-kinase type-2 beta, Constitutive coactivator of PPAR-gamma-like protein 2, Potassium/sodium hyperpolarization-activated cyclic nucleotide-gated channel 3, AT-hook-containing transcription factor, Legumain, Retinoic acid receptor RXR-beta, Mucin-19, Ubiquitin domain-containing protein UBFD1, Ras-related protein Rab-38, Bromodomain-containing protein 4, Cap-specific mRNA (nucleoside-2'-O-)-methyltransferase 1, Ubiquitin-associated protein 1, Periaxin, Protein O-mannosyl-transferase 1, Metallophosphoesterase MPPED2, NAD-dependent protein deacetylase sirtuin-2, NAD-dependent protein deacetylase sirtuin-3, mitochondrial, Peroxisome proliferator-activated receptor gamma coactivator-related protein 1, Zinc finger homeobox protein 2, Proline-rich transmembrane protein 3, Zinc transporter ZIP12, Phosphorylase b kinase regulatory subunit alpha, liver isoform, Caprin-2, Zinc finger with UFM1-specific peptidase domain protein, Protocadherin-15, POU domain, class 6, transcription factor 2, Insulin-like growth factor-binding protein complex acid labile subunit, Adenomatous polyposis coli protein 2, Thioredoxin reductase 2, mitochondrial, Kelch-like protein 29, DNA-binding protein RFXANK, GPI mannosyltransferase 2, Cleavage and polyadenylation specificity factor subunit 6, Myotubularin-related protein 12, SUN domain-containing ossification factor, Solute carrier family 25 member 34, NTF2-related export protein 2, Protein CLN8, Beta-galactosidase-1-like protein, Mitogen-activated protein kinase 1, EH domain-containing protein 3, 6.8 kDa mitochondrial proteolipid, Death-associated protein kinase 1, RB1-inducible coiled-coil protein 1, Exostosin-like 1, Nuclear factor related to kappa-B-binding protein, Zinc finger protein 512B, Dihydropyrimidinase-related protein 3, Inactive ubiquitin carboxyl-terminal hydrolase 53, Neuronal membrane glycoprotein M6-a, DNA-binding protein SATB1, Forkhead box protein C1, Serine/threonine-protein phosphatase 2A regulatory subunit B" subunit alpha, RNA-binding motif, single-stranded-interacting protein 3, Protocadherin gamma-A9, RNA-binding protein Nova-2, Glyceraldehyde-3-phosphate dehydrogenase, testis-specific, CMP-sialic acid transporter, GPI ethanolamine phosphate transferase 3, Protein EFR3 homolog B, CUB and sushi domain-containing protein 3, Krueppel-like factor 15, Receptor-type tyrosine-protein phosphatase kappa, Sodium-dependent proline transporter, Protein phosphatase Slingshot homolog 1, Beta-Ala-His dipeptidase, Sushi repeat-containing protein SRPX, Calmodulin-regulated spectrin-associated protein 3, Tissue factor pathway inhibitor 2, Phosphoinositide 3-kinase regulatory subunit 5, SH3 and multiple ankyrin repeat domains protein 1, Homeobox protein SIX5, Putative exonuclease GOR, Uncharacterized protein KIAA0556, Transmembrane and TPR repeat-containing protein 1, SH2 domain-containing protein 3A, Shadow of prion protein, Mucin-5B, ATP synthase subunit d, mitochondrial, Transforming acidic coiled-coil-containing protein 2, Transmembrane protein 238, Serine/threonine-protein kinase WNK2, Acrosin, Disintegrin and metalloproteinase domain-containing protein 18, BAll-associated protein 3, Serine/threonine-protein kinase ICK, Doublesex- and mab-3-related transcription factor A2, UPF0609 protein C4orf27, Single-stranded DNA-binding protein 3, Enolase-like protein ENO4, Dedicator of cytokinesis protein 6, Nuclear distribution protein nudE-like 1, Glycogenin-1, Scavenger receptor cysteine-rich type 1 protein M160, Stathmin-3, Mitogen-activated protein kinase kinase kinase kinase 5, Protein transport protein Sec24D, Proprotein convertase subtilisin/kexin type 7, Serine/threonine-protein phosphatase 1 regulatory subunit 10, Dynein heavy chain 8, axonemal, Dehydrogenase/reductase SDR family member 2, mitochondrial, Complement factor I, E3 ubiquitin-protein ligase TRIM63, Liprin-alpha-2, Protein Shroom4, Potassium voltage-gated channel subfamily H member 2, Rho GTPase-activating protein 31, Tetratricopeptide repeat protein 37, Interphotoreceptor matrix proteoglycan 1, Nodal modulator 1, Receptor-type tyrosine-protein phosphatase delta, Ribosome maturation protein SBDS, ATP-binding cassette sub-family A member 2, Zinc finger protein 423, Transcription factor SOX-5, Forkhead box protein D3, Protein NipSnap homolog 2, Uncharacterized protein C11orf96, Collagen alpha-2(V) chain, Alpha-globin transcription factor CP2, Ellis-van Creveld syndrome protein, EMILIN-1, Keratin, type I cytoskeletal 24, Apolipoprotein E, Cysteine and glycine-rich protein 2, Protein fantom, Homeobox protein Hox-B9, Apolipoprotein C-III, Regulator of G-protein signaling 12, WD repeat-containing protein 90, YrdC domain-containing protein, mitochondrial, Zinc finger BED domain-containing protein 6, Desumoylating isopeptidase 1, Protein asteroid homolog 1, Mitochondrial 2-oxoglutarate/malate carrier protein, Glycosylated lysosomal membrane protein, Chondroitin sulfate synthase 2, 6-phosphofructo-2-kinase/fructose-2,6-bisphosphatase 2, VPS10 domain-containing receptor SorCS1, UPF0524 protein C3orf70, Thiosulfate sulfurtransferase/rhodanese-like domain-containing protein 2, Mannosyl-oligosaccharide 1,2-alpha-mannosidase IB, PDZ domain-containing protein 2, Growth arrest-specific protein 6, Homeobox protein Hox-A4, ETS homologous factor, DBIRD complex subunit ZNF326, Cyclin-dependent kinase 5 activator 1, Signal peptidase complex subunit 3, Protein Hook homolog 3, TGF-beta receptor type-1, Phosphatidylserine synthase 1, HLA class II histocompatibility antigen, DM beta chain, Solute carrier family 22 member 6, Mucolipin-1, Rab 1 family-interacting protein 5, Translation initiation factor eIF-2B subunit alpha, Ribosomal RNA-processing protein 8, Nidogen-2, Polycomb group RING finger protein 1, Major centromere autoantigen B, Transmembrane protein 121, F-box/LRR-repeat protein 7, HLA class I histocompatibility antigen, Cw-17 alpha chain, Zinc finger and BTB domain-containing protein 11, Heterogeneous nuclear ribonucleoprotein H2, FTS and Hook-interacting protein, Leucine-rich repeat LGI family member 3, Zinc finger protein 45, Leucine-rich repeat transmembrane neuronal protein 3, Ubiquitin carboxyl-terminal hydrolase 13, Motor neuron and pancreas homeobox protein 1, Transcription factor MafF, PR domain zinc finger protein 8, Armadillo repeat-containing protein 1, Phosphoglucomutase-1, Serine/threonine-protein phosphatase 2A regulatory subunit B" subunit gamma, Microtubule-associated protein 9, Immunoglobulin superfamily member 3, Sal-like protein 1, Homeobox protein Hox-D9, Zinc finger protein 175, ATP-dependent RNA helicase DDX39A, Protein phosphatase 1J, Plasma protease C1 inhibitor, Protein phosphatase 1 regulatory subunit 3F, Transmembrane channel-like protein 4, Adenylate kinase 9, Raftlin-2, Cyclic AMP-dependent transcription factor ATF-6 alpha, Sestrin-2, Growth factor receptor-bound protein 10, Regulator of G-protein signaling 20, Cytokine receptor common subunit beta, Mannosyl-oligosaccharide 1,2-alpha-mannosidase IA, Uracil phosphoribosyltransferase homolog, Caspase-4, Vesicular glutamate transporter 2, Probable phospholipid-transporting ATPase IH, Protein LMBR1L, Metallophosphoesterase 1, Delphilin, Oxysterol-binding protein-related protein 5, Matrix metalloproteinase-14, Ethanolamine kinase 2, Protein phosphatase 1 regulatory subunit 21, Alpha-ketoglutarate-dependent dioxygenase alkB homolog 3, Coiled-coil domain-containing protein 91, Centrosomal protein of 290 kDa, Transcription factor HIVEP3, Transcription factor AP-2-epsilon, Arylsulfatase B, Membrane magnesium transporter 1, Protein YIPF4, Glutaminyl-peptide cyclotransferase, Zinc finger protein 160, Serine palmitoyltransferase 3, Aldehyde dehydrogenase, mitochondrial, Rho guanine nucleotide exchange factor 26, Sodium-dependent neutral amino acid transporter B(0)AT2, Immunoglobulin superfamily member 11, Collagen triple helix repeat-containing protein 1, Delta-like protein 3, RPA-interacting protein, Rho GTPase-activating protein 32, Zinc finger CCHC domain-containing protein 24, Very large A-kinase anchor protein, Ras-associating and dilute domain-containing protein, B-cell lymphoma 6 protein, Vasorin, Alpha-1D adrenergic receptor, Cyclin-dependent kinase-like 3, Neutrophil collagenase, Transducin-like enhancer protein 3, Protein LZIC, CXXC-type zinc finger protein 5, Zinc finger CCHC domain-containing protein 3, Zinc finger protein 518B, GDNF-inducible zinc finger protein 1, Phospholipase B-like 1, Glutathione reductase, mitochondrial, Histone-lysine N-methyltransferase SETD1B, Dimethyladenosine transferase 1, mitochondrial, PR domain zinc finger protein 2, Suppressor of tumorigenicity 7 protein, Semaphorin-3D, Retrotransposon gag domain-containing protein 4, E3 ubiquitin-protein ligase TRIM58, Triokinase/FMN cyclase, Alpha-1,6-mannosylglycoprotein 6-beta-N-acetylglucosaminyltransferase A, Guanine nucleotide exchange factor for Rab-3A, Large neutral amino acids transporter small subunit 1, SH3 domain-binding protein 5, NHL repeat-containing protein 2, Telomeric repeat-binding factor 1, Zinc finger protein 480, Zinc finger protein 98, Histone-lysine N-methyltransferase, H3 lysine-36 and H4 lysine-20 specific, Vascular endothelial growth factor receptor 2, Transmembrane protease serine 9, Ethanolaminephosphotransferase 1, WD repeat-containing protein 73, Calcium-dependent secretion activator 2, RING finger protein 150, Proteinase-activated receptor 1, Peptidyl-tRNA hydrolase 2, mitochondrial, Ethanolamine-phosphate phospholyase, Essential MCU regulator, mitochondrial, Vacuolar protein-sorting-associated protein 25, Histone acetyltransferase KAT2B, Uveal autoantigen with coiled-coil domains and ankyrin repeats, Serine/threonine-protein kinase ULK2, WD repeat-containing protein 5B, Bifunctional lysine-specific demethylase and histidyl-hydroxylase NO66, Ubiquitin-conjugating enzyme E2 G1, Cytoplasmic polyadenylation element-binding protein 2, Gamma-aminobutyric acid receptor subunit beta-2, Zinc finger protein 354B, E3 ubiquitin-protein ligase RNF169, Galactose-3-O-sulfotransferase 4, Myosin-IIIa, Mitogen-activated protein kinase kinase kinase 14, Signal-induced proliferation-associated 1-like protein 3, Runt-related transcription factor 1, Transmembrane protein 9, DNA annealing helicase and endonuclease ZRANB3, Ryanodine receptor 2, Diamine acetyltransferase 1, Transmembrane protein 231, Cartilage acidic protein 1, UPF0415 protein C7orf25, Protein NLRC3, Immunoglobulin superfamily DCC subclass member 4, Multidrug resistance-associated protein 6, Dynein heavy chain 17, axonemal, Protein phosphatase 1 regulatory subunit 12B, Small conductance calcium-activated potassium channel protein 2, Protein FAM13B, Serine/arginine-rich splicing factor 2, Probable tRNA methyltransferase 9-like protein, COP9 signalosome complex subunit 7b, Zinc finger protein 518A, Urocortin-2, Probable cytosolic iron-sulfur protein assembly protein CIAO1, Transmembrane protein 94, Protein-associating with the carboxyl-terminal domain of ezrin, Protein misato homolog 1, Protocadherin beta-8, Slit homolog 3 protein, Slit homolog 2 protein, Xylosyltransferase 1, Nectin-3, Endoglin, Solute carrier family 2, facilitated glucose transporter member 14, COMM domain-containing protein 7, Diacylglycerol O-acyltransferase 1, F-box/WD repeat-containing protein 9, Spectrin beta chain, non-erythrocytic 5, Mitochondrial pyruvate carrier 1, Anion exchange protein, Microtubule-associated protein, Large neutral amino acids transporter small subunit 2, Adhesion G protein-coupled receptor F5, Heat shock transcription factor, X-linked, Solute carrier family 26 member 10, ABCB9 protein, Cancer/testis antigen 55, Calcium-binding mitochondrial carrier protein SCaMC-1, N-acylglucosamine 2-epimerase, UBX domain-containing protein 6, Tripartite motif-containing protein 55, Polycystic kidney disease 2-like 1 protein, Zinc finger protein 529, Polynucleotide 5'-hydroxyl-kinase NOL9, Kidney mitochondrial carrier protein 1, Sprouty-related, EVH1 domain-containing protein 2, Leptin receptor gene-related protein, GDP-fucose protein O-fucosyltransferase 1, Solute carrier family 12 member 2, Coiled-coil domain-containing protein 34, MAGUK p55 subfamily member 5, Protein SSX5, ATP-binding cassette sub-family C member 8, Tyrosine-protein kinase receptor, Inositol-trisphosphate 3-kinase A, Thioredoxin domain-containing protein 16, Electroneutral sodium bicarbonate exchanger 1, E3 ubiquitin-protein ligase TRIM36, Maestro heat-like repeat-containing protein family member 7, Protein dopey-1, Serine/threonine-protein kinase A-Raf, Probable G-protein coupled receptor 158, PHD finger protein 20, Exportin-7, TBC1 domain family member 16, Homeodomain-interacting protein kinase 4, SLIT and NTRK-like protein 2, Bromo adjacent homology domain-containing 1 protein, Protocadherin Fat 2, HLA class I histocompatibility antigen, B-49 alpha chain, CASP8 and FADD-like apoptosis regulator, Neuroligin-3, Katanin p60 ATPase-containing subunit A1, Protein FAM72C, Nuclear receptor coactivator 1, Mediator of RNA polymerase II transcription subunit 8, Paired box protein Pax-2, Glutamyl aminopeptidase, Egl nine homolog 3, Protein-lysine 6-oxidase, Insulin-like growth factor-binding protein 3, Thrombospondin-1, Thrombospondin-2, Matrilysin, Thioredoxin-related transmembrane protein 4, ATP synthase subunit gamma, mitochondrial, Guanylate kinase, Calcium-binding mitochondrial carrier protein Aralar2, Iroquois-class homeodomain protein IRX-2, Bcl-2-binding component 3, Protein Shroom2, LRRN4 C-terminal-like protein, Neuronal pentraxin receptor, UBA-like domain-containing protein 1, Macrophage-capping protein, Malate dehydrogenase, cytoplasmic, Numb-like protein, Vesicle transport through interaction with t-SNAREs homolog 1B, Protein SFI1 homolog, Metalloproteinase inhibitor 2, ALK tyrosine kinase receptor, MAD2L1-binding protein, Ewing's tumor-associated antigen 1, Rho-related GTP-binding protein RhoQ, Serine dehydratase-like, Kv channel-interacting protein 2, Phosphatidylinositol 3-kinase regulatory subunit beta, Tropomodulin-1, Beta-1,4-glucuronyltransferase 1, 17-beta-hydroxysteroid dehydrogenase 14, TATA box-binding protein-like protein 1, Ribonuclease pancreatic, NADPH oxidase 5, Spliceosome-associated protein CWC15 homolog, Serine/threonine-protein kinase PRP4 homolog, Cytoglobin, Homer protein homolog 3, Metastasis suppressor protein 1, 1-acyl-sn-glycerol-3-phosphate acyltransferase gamma, Neuralized-like protein 4, Coiled-coil domain-containing protein 154, HRAS-like suppressor 3, Neuroblastoma breakpoint family member 6, Separin, Fucose mutarotase, Ankyrin repeat domain-containing protein SOWAHC, Protein AAR2 homolog, Atherin, Patatin-like phospholipase domain-containing protein 7, CD276 antigen, Cytoplasmic polyadenylation element-binding protein 1, E3 ubiquitin-protein ligase MSL2, Transient receptor potential cation channel subfamily M member 1, Suppressor of IKBKE 1, Centrosomal protein of 68 kDa, Amino-terminal enhancer of split, SH2B adapter protein 3, Protein argonaute-1, Oxidative stress-induced growth inhibitor 1, Apolipoprotein D, Semaphorin-5A, Nephrocystin-3, F-BAR domain only protein 2, Vacuolar-sorting protein SNF8, Septin-4, Eukaryotic translation initiation factor 3 subunit J, RanBP-type and C3HC4-type zinc finger-containing protein 1, Mitochondrial import inner membrane translocase subunit Tim13, cDNA FLJ78342, Armadillo repeat-containing X-linked protein 5, Adenosine 3'-phospho 5'-phosphosulfate transporter 2, RING finger protein 37, Zinc finger protein 28 homolog, Proline-rich protein 13, Interleukin-1 receptor accessory protein, Glutamate receptor ionotropic, NMDA 2A, Pleckstrin homology domain-containing family A member 1, Hyaluronidase-2, 72 kDa type IV collagenase, Calcineurin subunit B type 1, Protein phosphatase 1 B, Delta-1-pyrroline-5-carboxylate synthase, 28S ribosomal protein S22, mitochondrial, Probable ATP-dependent RNA helicase DDX58, Trimethyllysine dioxygenase, mitochondrial, Pantothenate kinase 2, mitochondrial, R3H and coiled-coil domain-containing protein 1, CUGBP Elav-like family member 5, Probable fibrosin-1, Microtubule-associated serine/threonine-protein kinase 4, Calcium/calmodulin-dependent protein kinase kinase 2, Glycogen [starch] synthase, muscle, EPM2A-interacting protein 1, Coiled-coil domain-containing protein 22, Zinc finger protein 1 homolog, KAT8 regulatory NSL complex subunit 2, GTPase KRas, Cyclin-G1, Regulator of nonsense transcripts 3B, Telomerase-binding protein EST1A, Nuclear factor of activated T-cells, cytoplasmic 3, Nucleolar protein 4-like, Gamma-glutamylaminecyclotransferase, Bcl-2-like protein 12, Methyltransferase-like protein 13, Methylthioribose-1-phosphate isomerase, Apoptogenic protein 1, mitochondrial, UTP-glucose-1-phosphate uridylyltransferase, G-protein coupled receptor 126, Zinc finger CCCH-type with G patch domain-containing protein, C2 domain-containing protein 5, Cytoplasmic polyadenylation element-binding protein 4, UPF0489 protein C5orf22, Intermediate filament family orphan 1, Nuclear receptor subfamily 4 group A member 2, Peptidyl-glycine alpha-amidating monooxygenase, Ethanolamine-phosphate cytidylyltransferase, Zinc finger CCCH domain-containing protein 13, Putative GTP-binding protein 6, WD repeat domain-containing protein 83, DNA excision repair protein ERCC-8, Serine/threonine-protein kinase N3, MOB kinase activator 2, Ankyrin repeat and BTB/POZ domain-containing protein 1, Kaptin, Caveolin-1, Death effector domain-containing protein, Spindle and kinetochore-associated protein 1, Elongation factor G, mitochondrial, Coenzyme Q-binding protein COQ10 homolog B, mitochondrial, Transmembrane protein 168, PRKR-interacting protein 1, RIB43A-like with coiled-coils protein 2, TATA box-binding protein-associated factor RNA polymerase I subunit C, DCN1-like protein 4, Peptidyl-prolyl cis-trans isomerase H, Glypican-1, Cat eye syndrome critical region protein 5, Cystathionine gamma-lyase, Protein GREB1, ATP-dependent DNA helicase Q4, Metal transporter CNNM3, Nucleoside diphosphate kinase, mitochondrial, Small integral membrane protein 8, N-lysine methyltransferase SMYD2, E3 ubiquitin-protein ligase Praja-1, TNF receptor-associated factor 5, LIX1-like protein, Renalase, Trafficking protein particle complex subunit 12, Protein mago nashi homolog 2, Transmembrane protein 150C, NADH dehydrogenase [ubiquinone] 1 alpha subcomplex subunit 11, Alpha- and gamma-adaptin-binding protein p34, Ribosome-releasing factor 2, mitochondrial, Zinc finger protein 322, AF4/FMR2 family member 3, Shugoshin-like 2, NEDD4-binding protein 1, Arf-GAP with Rho-GAP domain, ANK repeat and PH domain-containing protein 2, Peroxisomal NADH pyrophosphatase NUDT12, Mixed lineage kinase domain-like protein, MRG/MORF4L-binding protein, Tyrosine-protein phosphatase non-receptor type 3, Prostacyclin synthase, Protein FAM46D, Transcriptional repressor NF-X1, Oligodendrocyte transcription factor 2, FYVE and coiled-coil domain-containing protein 1, Tripartite motif-containing protein 42, Centrosomal protein of 112 kDa, THO complex subunit 3, Uncharacterized protein C20orf96, LisH domain-containing protein FOPNL, Cyclin-dependent kinase 17, Histone-lysine N-methyltransferase SUV420H1, Serine/threonine-protein kinase Nek2, RNA polymerase II elongation factor ELL2, Serine/threonine-protein kinase TAO3, F-box only protein 34, DNA replication complex GINS protein PSF2, Kinetochore-associated protein DSN1 homolog, Inositol-3-phosphate synthase 1, 15-hydroxyprostaglandin dehydrogenase [NAD(+)], Mitogen-activated protein kinase 8, THO complex subunit 1, Dual specificity protein phosphatase 19, Protein fem-1 homolog B, Prolyl endopeptidase FAP, 28S ribosomal protein S18b, mitochondrial, Serine/threonine-protein kinase Nek3, Cell division cycle-associated protein 7, Dual specificity protein kinase TTK, ER degradation-enhancing alpha-mannosidase-like protein 2, GATA zinc finger domain-containing protein 1, Ceramide synthase 4, Leucine-rich repeat-containing protein 9, Cytochrome b5 domain-containing protein 1, Coiled-coil domain-containing protein 158, Transcriptional enhancer factor TEF-1, OTU domain-containing protein 7B, Exonuclease 1, Lactosylceramide alpha-2,3-sialyltransferase, HLA class I histocompatibility antigen, A-66 alpha chain, YLP motif-containing protein 1, Alpha-1,3-mannosyl-glycoprotein 2-beta-N-acetylglucosaminyltransferase, Exocyst complex component 8, Tudor domain-containing protein 7, Putative pre-mRNA-splicing factor ATP-dependent RNA helicase DHX32, Dephospho-CoA kinase domain-containing protein, Telomeric repeat-binding factor 2, Uncharacterized protein C7orf43, Nucleoside diphosphate kinase homolog 5, Alpha-aminoadipic semialdehyde synthase, mitochondrial, TBC1 domain family member 10A, GRIP and coiled-coil domain-containing protein 1, Mitochondrial Rho GTPase 1, Vacuolar protein-sorting-associated protein 36, Transmembrane protein 260, HAUS augmin-like complex subunit 2, dTDP-D-glucose 4,6-dehydratase, S-phase kinase-associated protein 2, DNA repair protein complementing XP-A cells, Protein LTV1 homolog, UPF0462 protein C4orf33, Alpha-centractin, LIM domain-binding protein 3, Transient receptor potential cation channel subfamily M member 7, ETS-related transcription factor Elf-2, Ribosome-recycling factor, mitochondrial, Carnitine O-acetyltransferase, Serine-tRNA ligase, mitochondrial, E3 ubiquitin-protein ligase RFWD3, Rho GTPase-activating protein 26, Pre-mRNA-splicing regulator WTAP, Uncharacterized protein C1orf112, 28S ribosomal protein S23, mitochondrial, Phosphoprotein associated with glycosphingolipid-enriched microdomains 1, Peroxisome proliferator-activated receptor delta, Trafficking kinesin-binding protein 1, Nuclear receptor 2C2-associated protein, Exocyst complex component 7, C—C motif chemokine 28, Myotonin-protein kinase, Condensin complex subunit 2, Protein phosphatase 1H, 5'-nucleotidase, cDNA FLJ60317, highly similar to Aminoacylase-1 (EC 3.5.1.14), Endophilin-B2, FAST kinase domain-containing protein 5, Zinc finger and SCAN domain-containing protein 30, Coiled-coil domain-containing protein 136, RCC1 and BTB domain-containing protein 2, Phosphatase and actin regulator 1, Aryl hydrocarbon receptor nuclear translocator 2, 2-methoxy-6-polyprenyl-1,4-benzoquinol methylase, mitochondrial, Alpha/beta hydrolase domain-containing protein 17A, SH3 and PX domain-containing protein 2A, Mitochondrial ribonuclease P protein 3, SH3 and PX domain-containing protein 2B, Protein phosphatase 1 regulatory subunit 37, Protein TMEPAI, Mitogen-activated protein kinase kinase kinase 11, Exosome complex component RRP43, Cofilin-2, Protein FRA10AC1, Protein CIP2A, CREB3 regulatory factor, Pseudopodium-enriched atypical kinase 1, ATP-binding cassette sub-family A member 5, Phospholipid scramblase 2, Translation initiation factor eIF-2B subunit gamma, Ras association domain-containing protein 8, Ras-related GTP-binding protein D, Pachytene checkpoint protein 2 homolog, Estradiol 17-beta-dehydrogenase 1, Ubiquitin-associated protein 1-like, MAGEC3 protein, Protein FAM118A, Procollagen C-endopeptidase enhancer 2, mRNA turnover protein 4 homolog, Protein NATD1, Protein FAM135B, Meckel syndrome type 1 protein, Lactadherin, Putative butyrophilin subfamily 2 member A3, Butyrophilin subfamily 2 member A1, Interleukin-1 receptor-associated kinase 4, Protein FAM111 B, NADH-ubiquinone oxidoreductase 75 kDa subunit, mitochondrial, Proton myo-inositol cotransporter, Transcription factor TFIIIB component B" homolog, Xenotropic and polytropic retrovirus receptor 1, Prostaglandin E synthase 2, Ribonucleoprotein PTB-binding 2, Teneurin-4, EH domain-binding protein 1-like protein 1, Formin-binding protein 4, NGFI-A-binding protein 1, Glutamate decarboxylase 1, Putative ATP-dependent RNA helicase TDRD9, DCN1-like protein 5, 3 beta-hydroxysteroid dehydrogenase type 7, Tetratricopeptide repeat protein 5, Diacylglycerol kinase theta, 39S ribosomal protein L21, mitochondrial, Radial spoke head 10 homolog B2, Transcription factor SOX-13, Unconventional myosin-IXb, DDB1- and CUL4-associated factor 7, Tyrosine-protein kinase ABL1, Muscular LMNA-interacting protein, rRNA methyltransferase 2, mitochondrial, Nucleoside diphosphate kinase 7, Kinesin-like protein KIF14, Melanoma-associated antigen C1, Phosphatidylinositol 3,4,5-trisphosphate 3-phosphatase and dual-specificity protein phosphatase PTEN, Apolipoprotein B-100, Probable tRNA (uracil-O(2)-)-methyltransferase, Polyphosphoinositide phosphatase, Protein argonaute-3, Protein FAM102B, Probable guanine nucleotide exchange factor MCF2L2, Tubulin polyglutamylase complex subunit 1, Nephrocystin-4, Cleft lip and palate transmembrane protein 1-like protein, TNF receptor-associated factor 4, FAD-dependent oxidoreductase domain-containing protein 2, Zinc finger and BTB domain-containing protein 7A, WD repeat-containing protein 89, Calcium-transporting ATPase type 2C member 1, Complement factor H-related protein 2, Leucine zipper putative tumor suppressor 2, Probable N-acetyltransferase 16, Ornithine aminotransferase, mitochondrial, Polypeptide N-acetylgalactosaminyltransferase 16, 2'-5'-oligoadenylate synthase-like protein, Solute carrier family 25 member 33, U7 snRNA-associated Sm-like protein LSm10, Autophagy-related protein 2 homolog A, BMP and activin membrane-bound inhibitor homolog, Bifunctional lysine-specific demethylase and histidyl-hydroxylase MINA, Uncharacterized protein KIAA1841, Stromal membrane-associated protein 2, Protein FAM98A, CAP-Gly domain-containing linker protein 3, Protein SCAI, Anoctamin-4, HLA class I histocompatibility antigen, B-50 alpha chain, Phytanoyl-CoA dioxygenase, peroxisomal, Dyslexia-associated protein KIAAO319-like protein, 28S ribosomal protein S16, mitochondrial, Retinol dehydrogenase 8, 39S ribosomal protein L41, mitochondrial, Mitochondrial intermediate peptidase, Protein FAM83D, MpV17 transgene, murine homolog, glomerulosclerosis, isoform CRA_f, Sorcin, Putative germ cell-less protein-like 1-like, Protein-glutamine gamma-glutamyltransferase 6, Transforming growth factor-beta receptor-associated protein 1, Sex comb on midleg-like protein 4, Insulin-like growth factor-binding protein 7, Putative RNA-binding protein Luc7-like 1, Monocarboxylate transporter 5, Cadherin-19, Putative heat shock protein HSP 90-beta-3, G protein-coupled receptor kinase 5, Retinol dehydrogenase 14, UBX domain-containing protein 2A, Histone H3-like centromeric protein A, UPF0536 protein C12orf66, Putative ATP-dependent RNA helicase TDRD12, NADH-ubiquinone oxidoreductase chain 4, Thiamin pyrophosphokinase 1, Sulfotransferase 1 C2, Zinc finger SWIM domain-containing protein 3, Catenin delta-2, Transient receptor potential cation channel subfamily A member 1, Alstrom syndrome protein 1, Tubulin alpha-3C/D chain, 40S ribosomal protein S20, Adenine DNA glycosylase, Protein O-linked-mannose beta-1,2-N-acetylglucosaminyltransferase 1, CD63 antigen, Zinc finger protein DZIP1, Discoidin, CUB and LCCL domain-containing protein 1, Protein pelota homolog, Tubulin polyglutamylase TTLL5, S-methyl-5'-thioadenosine phosphorylase, Serologically defined colon cancer antigen 8, Cytoplasmic protein NCK2, Alpha-1,6-mannosylglycoprotein 6-beta-N-acetylglucosaminyltransferase B, Iroquois-class homeodomain protein IRX-5, Succinate dehydrogenase [ubiquinone] flavoprotein subunit, mitochondrial, Tetratricopeptide repeat protein 38, Aprataxin, Sodium-dependent phosphate transporter 1, Oxidoreductase-like domain-containing protein 1, P protein, Protein bicaudal C homolog 1, Voltage-gated potassium channel subunit beta-1, Regulator of telomere elongation helicase 1, Probable phospholipid-transporting ATPase IIB, Sideroflexin-1, Phosphoribosylformylglycinamidine synthase, Tetratricopeptide repeat protein 39B, Uncharacterized protein KIAA1210, N-acyl-aromatic-L-amino acid amidohydrolase (carboxylate-forming), Transforming growth factor beta receptor type 3, Metalloproteinase inhibitor 4, Beta-adrenergic receptor kinase 2, Dipeptidyl peptidase 4, Protein SMG5, P antigen family member 5, Carbohydrate sulfotransferase 9, Zinc finger and SCAN domain-containing protein 21, Zinc finger protein 7, Zinc finger protein 430, Xaa-Pro dipeptidase, Protein ECT2, Protein FAM161A, NF-kappa-B inhibitor zeta, Zinc finger protein 860, Rho guanine nucleotide exchange factor 40, Ras-related protein Ral-A, Ras-related protein Rab-17, Loss of heterozygosity 12 chromosomal region 1 protein, Ras-related protein Rab-13, Ras-related protein Rab-34, Filamin A-interacting protein 1-like, Nuclear receptor subfamily 4 group A member 3, Armadillo repeat-containing X-linked protein 1, CD302 antigen, Zinc finger protein 141, Tudor domain-containing protein 3, RanBP2-like and GRIP domain-containing protein 3, Creatine kinase S-type, mitochondrial, Dynein heavy chain 5, axonemal, E3 ubiquitin-protein ligase UBR3, WD repeat and HMG-box DNA-binding protein 1, Retinaldehyde-binding protein 1, Ubiquitin-conjugating enzyme E2 Q1, S-adenosylmethionine decarboxylase proenzyme, RUN and FYVE domain-containing protein 2, Bardet-Biedl syndrome 5 protein, Treslin, Gap junction alpha-3 protein, Dual specificity tyrosine-phosphorylation-regulated kinase 3, Transient receptor potential cation channel subfamily M member 2, MICAL-like protein 1, Aryl hydrocarbon receptor nuclear translocator, 5-demethoxyubiquinone hydroxylase, mitochondrial, Round spermatid basic protein 1, Glutathione S-transferase theta-2B, EF-hand calcium-binding domain-containing protein 14, DnaJ homolog subfamily C member 4, Protein Simiate, 60S ribosomal protein L35a, LON peptidase N-terminal domain and RING finger protein 2, Bifunctional UDP-N-acetylglucosamine 2-epimerase/N-acetylmannosamine kinase, Alternative protein MKKS, TBC1 domain family member 15, PHD finger-like domain-containing protein 5A, Tumor necrosis factor receptor superfamily member 14, Protein PRR5-ARHGAP8, Mitochondrial inner membrane protease ATP23 homolog, Huntingtin-interacting protein 1-related protein, Proteasome subunit alpha type-1, Transcription factor IIIA, Poly(A)-specific ribonuclease PARN-like domain-containing protein 1, Myosin regulatory light chain 10, Serine/threonine-protein phosphatase 2A activator, Caspase-2, SLIT-ROBO Rho GTPase-activating protein 1, B-cell CLL/lymphoma 7 protein family member B, Uncharacterized protein C10orf88, 39S ribosomal protein L51, mitochondrial, Zinc finger CCHC-type and RNA-binding motif-containing protein 1, DNA helicase MCM8, Fc receptor-like protein 3, Tripartite motif-containing protein 35, Rho GTPase-activating protein 11B, Ribosomal protein S6 kinase alpha-2, Dual specificity protein phosphatase 3, Transmembrane protein 8A, Serine protease 56, Connector enhancer of kinase suppressor of ras 3, Protein FAM167B, Coiled-coil domain-containing protein 77, Hydrocephalus-inducing protein homolog, Serine beta-lactamase-like protein LACTB, mitochondrial, Solute carrier family 40 member 1, Lysosomal-associated transmembrane protein 4B, Histone deacetylase complex subunit SAP30L, Lipoxygenase homology domain-containing protein 1, Alpha-1-antichymotrypsin, Granulocyte-macrophage colony-stimulating factor receptor subunit alpha, Probable serine carboxypeptidase CPVL, Teashirt homolog 3, Interleukin-13 receptor subunit alpha-2, Sorting nexin-21, Torsin-1A-interacting protein 2, isoform IFRG15, DST protein, Carboxypeptidase N catalytic chain, Aspartate beta-hydroxylase domain-containing protein 1, Protein FAM69B, Ectonucleotide pyrophosphatase/phosphodiesterase family member 1, Coiled-coil domain-containing protein 13, Zinc finger protein 703, Low affinity immunoglobulin gamma Fc region receptor II-b, Putative stereocilin-like protein, EF-hand calcium-binding domain-containing protein 6, Zinc finger and BTB domain-containing protein 34, Glutathione S-transferase theta-1, Amphoterin-induced protein 1, Delta and Notch-like epidermal growth factor-related receptor, Synaptosomal-associated protein 23, Inactive rhomboid protein 2, Thymidine phosphorylase, Olfactory receptor 4M2, Protein mago nashi homolog, Nidogen-1, Prostate tumor-overexpressed gene 1 protein, ADP-ribosylation factor-like protein 5B, TBC1 domain family member 7, SEC14-like protein 2, ATP synthase subunit e, mitochondrial, NGFI-A- binding protein 2, Peptidase inhibitor 15, Small glutamine-rich tetratricopeptide repeat-containing protein alpha, Leucine-rich repeat-containing protein 4C, RNA polymerase-associated protein RTF1 homolog, Transcription initiation factor IIA subunit 2, Pseudouridine-5'-phosphatase, Zinc finger protein 583, Zinc finger protein 280D, DNA-directed RNA polymerase III subunit RPC10, Phenylalanine-tRNA ligase beta subunit, Fructose-bisphosphate aldolase C, Short/branched chain specific acyl-CoA dehydrogenase, mitochondrial, Geranylgeranyl transferase type-2 subunit beta, tRNA (guanine(37)-N1)-methyltransferase, Probable crossover junction endonuclease EME2, Neuronal acetylcholine receptor subunit alpha-3, Carbohydrate sulfotransferase 5, Tyrosine-protein phosphatase non-receptor type 20, Leucine-rich repeat-containing protein 15, Methyltransferase-like protein 25, Histone-lysine N-methyltransferase SUV39H1, PH and SEC7 domain-containing protein 3, Zinc finger and BTB domain-containing protein 37, Chromosome-associated kinesin KIF4A, Voltage-gated potassium channel subunit beta-2, Sodium/myo-inositol cotransporter, Kelch-like protein 42, Putative E3 ubiquitin-protein ligase UNKL, Interleukin-13 receptor subunit alpha-1, Centrosomal protein of 295 kDa, Sec1 family domain-containing protein 2, Xylulose kinase, Uncharacterized protein KIAA0930, Guanine nucleotide exchange factor DBS, ALX homeobox protein 1, Vacuolar protein sorting-associated protein 72 homolog, Beta-citrylglutamate synthase B, 60S ribosomal protein L3-like, Protein orai-2, B-cell lymphoma 3 protein, Serine/threonine-protein kinase Nek9, Protein lin-9 homolog, N-alpha-acetyltransferase 11, Intersectin-2, Ras-responsive element-binding protein 1, Cytoplasmic dynein 1 intermediate chain 1, Dexamethasone-induced Ras-related protein 1, Transmembrane channel-like protein 6, Rab-like protein 3, DNA mismatch repair protein Msh3, POM121 and ZP3 fusion protein, Transmembrane protein 230, Serine/threonine-protein phosphatase 2A regulatory subunit B" subunit beta, Peroxisome biogenesis factor 10, Actin filament-associated protein 1-like 1, Choline kinase alpha, Uncharacterized protein C1orf21, Synaptonemal complex central element protein 1, Ribosomal protein 63, mitochondrial, RNA-binding E3 ubiquitin-protein ligase MEX3C, Ankyrin repeat and SOCS box protein 4, Long-chain fatty acid transport protein 3, Nuclear RNA export factor 1, Potassium voltage-gated channel subfamily G member 3, Coiled-coil domain-containing protein 138, Uncharacterized protein C19orf60, Homeobox protein cut-like 1, Armadillo repeat-containing protein 2, 28S ribosomal protein S5, mitochondrial, Chromatin assembly factor 1 subunit A, Rho guanine nucleotide exchange factor 39, Transcription factor SPT20 homolog, E3 ubiquitin-protein ligase RNF14, Glioma tumor suppressor candidate region gene 2 protein, Dehydrodolichyl diphosphate syntase complex subunit DHDDS, Nuclear receptor-interacting protein 3, Beta-1,3-N-acetylglucosaminyltransferase radical fringe, Transmembrane protein 51, Scavenger receptor class A member 5, Protein FAM167A, Protogenin, EF-hand domain-containing protein D2, Coiled-coil domain-containing protein 144A, Cryptochrome-2, ADP-ribosylation factor-like protein 4D, Partitioning defective 6 homolog beta, HCG2002594, isoform CRA_c, Leucine-rich repeat and WD repeat-containing protein 1, 60S ribosomal protein L39, Meiotic nuclear division protein 1 homolog, cDNA FLJ57726, highly similar to Heterogeneous nuclear ribonucleoprotein H3, Mesencephalic astrocyte-derived neurotrophic factor, Arginine/serine-rich coiled-coil protein 2, Cytochrome P450 2U1, THAP domain-containing protein 1, Hom s 2, Protein CREG2, FLYWCH-type zinc finger-containing protein 1, Rhomboid-like protein, Serine/threonine-protein kinase VRK2, Acyl-coenzyme A thioesterase THEM4, UHRF1-binding protein 1, EWS RNA-binding protein variant 6, Testis-specific Y-encoded protein 1, Butyrophilin subfamily 2 member A2, CDKN2AIP N-terminal-like protein, HIRA-interacting protein 3, Protein FAM199X, Multivesicular body subunit 12B, Spindle and centriole-associated protein 1, COBW domain-containing protein 2, Glycerol kinase, (E3-independent) E2 ubiquitin-conjugating enzyme, Uncharacterized protein KIAA1211, Histone-lysine N-methyltransferase SETMAR, Arginine vasopressin-induced protein 1, Chondroitin sulfate synthase 3, Caspase-9, SHC-transforming protein 3, Tumor protein D53, ENTH domain-containing protein 1, Uncharacterized protein C19orf52, 14-3-3 protein sigma, B-cell CLL/lymphoma 7 protein family member A, ATPase family AAA domain-containing protein 3A, Charged multivesicular body protein 1 b, Platelet-activating factor acetylhydrolase 2, cytoplasmic, ADP-ribosylation factor GTPase-activating protein 1, NADH dehydrogenase [ubiquinone] 1 alpha subcomplex subunit 6, Methyltransferase-like protein 8, Follistatin-related protein 5, ATP-binding cassette sub-family B member 6, mitochondrial, Protein fem-1 homolog C, Ankyrin repeat domain-containing protein 20B, Ventricular zone-expressed PH domain-containing protein homolog 1, Gap junction beta-1 protein, Vitamin K epoxide reductase complex subunit 1, Frataxin, mitochondrial, E3 ubiquitin-protein ligase TRIM32, Protein maestro, Receptor-interacting serine/threonine-protein kinase 1, 2'-5'-oligoadenylate synthase 2, Regulator of nonsense transcripts 2, ATP-sensitive inward rectifier potassium channel 10, Microtubule-associated tumor suppressor 1, Metalloproteinase inhibitor 3, Homeobox protein SEBOX, Nuclear receptor subfamily 4 group A member 1, Carboxypeptidase M, Small glutamine-rich tetratricopeptide repeat-containing protein beta, Alpha-aminoadipic semialdehyde dehydrogenase, Cysteine protease ATG4C, IL6ST nirs variant 1, 60S ribosomal protein L38, Transcription cofactor HES-6, Uncharacterized protein C17orf98, RING finger protein 10, Alpha-crystallin B chain, Probable ATP-dependent RNA helicase DHX40, Transcobalamin-1, Protein argonaute-2, Protein argonaute-4, Pleckstrin homology-like domain family A member 2, Arginine/serine-rich protein 1, Tubulin-specific chaperone E, ELL-associated factor 1, Phosphatase and actin regulator, F-box-like/WD repeat-containing protein TBL1XR1, Osteopontin, Carbohydrate sulfotransferase 11, Olfactory receptor 52E1, HBS1-like protein, Zinc finger protein 43, COMM domain-containing protein 10, Complement component 1 Q subcomponent-binding protein, mitochondrial, Transcription initiation factor TFIID subunit 6, Transcription initiation factor TFIID subunit 7-like, Latent-transforming growth factor beta-binding protein 2, Zinc finger protein 280B, N-acetylglucosamine-1-phosphodiester alpha-N-acetylglucosaminidase, Myb-related protein B, Zinc finger protein 212, Calcium uptake protein 1, mitochondrial, E3 ubiquitin-protein ligase ZNRF1, Phosphomevalonate kinase, Mitochondrial basic amino acids transporter, Protein tweety homolog 2, BMP-2-inducible protein kinase, Histone acetyltransferase KAT7, Ras-related protein Rab-6B, BTB/POZ domain-containing protein 9, Lipid phosphate phosphatase-related protein type 3, Fanconi anemia group A protein, Ran-specific GTPase-activating protein, 39S ribosomal protein L48, mitochondrial, CTP synthase 1, Zinc finger MYM-type protein 6, Protein tweety homolog 3, Interleukin-1 receptor-associated kinase 1, Nuclear distribution protein nudE homolog 1, Krueppel-like factor 5, Bcl-2-related protein A1, CDC42 small effector protein 2, GRAM domain-containing protein 1A, Centrosomal protein of 131 kDa, Inositol hexakisphosphate and diphosphoinositol-pentakisphosphate kinase 2, Presequence protease, mitochondrial, Uncharacterized membrane protein C19orf24, MAM and LDL-receptor class A domain-containing protein 1, NADH-ubiquinone oxidoreductase chain 2, DBH-like monooxygenase protein 1, Biliverdin reductase A, Tetraspanin-14, NADH-ubiquinone oxidoreductase chain 4L, Calcium permeable stress-gated cation channel 1, 60S ribosomal protein L14, WW domain-containing adapter protein with coiled-coil, Poly [ADP-ribose] polymerase 11, KN motif and ankyrin repeat domain-containing protein 4, Methyl-CpG-binding domain protein 6, IQ domain-containing protein G, Glutamate receptor ionotropic, kainate 5, Apoptosis-stimulating of p53 protein 1, Transformer-2 protein homolog beta, Succinyl-CoA ligase [ADP/GDP-forming] subunit alpha, mitochondrial, Neurofilament light polypeptide, Aminoacyl tRNA synthase complex-interacting multifunctional protein 2, Protein FAM73B, Volume-regulated anion channel subunit LRRC8B, Olfactory receptor 51G2, Ubiquitin carboxyl-terminal hydrolase 24, Integrin alpha-2, DnaJ homolog subfamily B member 1, Prostaglandin E2 receptor EP4 subtype, Transmembrane protein 186, RNA-binding protein Musashi homolog 2, Phosphatidylinositol 3,4,5-trisphosphate 5-phosphatase 2, Sodium/iodide cotransporter, Protocadherin-18, Trafficking protein particle complex subunit 8, Protocadherin alpha-1, NF-kappa-B inhibitor epsilon, Peroxisomal trans-2-enoyl-CoA reductase, Protein GPR108, ADP/ATP translocase 1, Uncharacterized protein C4orf36, MAM domain-containing glycosylphosphatidylinositol anchor protein 1, Natriuretic peptides A, PAB-dependent poly(A)-specific ribonuclease subunit PAN3, Zinc finger protein with KRAB and SCAN domains 2, Uncharacterized protein C11orf63, Short-chain-specific acyl-CoA dehydrogenase, mitochondrial, Tyrosine-protein kinase TXK, Lymphocyte antigen 6E, Pappalysin-1, Thiosulfate sulfurtransferase, Threonine-tRNA ligase, mitochondrial, Zinc finger protein 362, Beta-catenin-interacting protein 1, Lysyl oxidase homolog 4, HLA class I histocompatibility antigen, Cw-8 alpha chain, Unconventional myosin-Vb, Unconventional myosin-XIX, GPI inositol-deacylase, Methyl-CpG-binding domain protein 4, PDZ and LIM domain protein 2, Sphingosine-1-phosphate lyase 1, CBP80/20-dependent translation initiation factor, Nuclear receptor ROR-beta, Sulfhydryl oxidase 2, Partner of Y14 and mago, Plexin-A1, Sialomucin core protein 24, Neural cell adhesion molecule L1-like protein, Lysosome membrane protein 2, ATP-binding cassette subfamily A member 1, Signal-regulatory protein delta.

According to preferred embodiments, the at least one antigenic peptide or protein encoded by the at least one coding region of the artificial nucleic acid molecule, preferably RNA, of the invention, may be derived from a mutated tumor antigen selected from ZFHX3 (R1893G), XPO1 (E571K), VHL (S111N; S65*; S68*), VHL (L89H), UBR5 (E2121K), U2AF1 (S34F), TSC2 (splice variant), TRRAP (S722F), TP53 (A159P; A159V; A161 T; C135F; C135Y; C141Y; C176F; C176Y; C229Y; C238F; C238Y; C242A; C242F; C275F; C275Y; C277F; D259Y; D281N; D281Y; E198*; E204*; E221*; E224D; E271K; E285*; E285K; E286K; E294*; E298*; E56*; F134L; G154A; G244C; G244D; G244S; G245C; G245D; G245S; G245V; G262V; G266*; G266E; G266R; G266V; H179L; H179R; H179Y; H193L; H193P; H193R; H193Y; H214R; I195T; I255F; K132E; K132N; K132R; L130F; L194R; M237I; N239*; N239S; P151H; P151S; P152L; P177R; P250L; P278A; P278L; P278R; P278S; P27L; Q104*; Q136*; Q144*; Q167*; Q192*; Q317*; Q331*; R110L; R156P; R158G; R158H; R158L; R175G; R175H; R196*; R196P; R213*; R213Q; R248Q; R248W; R249G; R249M; R249S; R249W; R267P; R273C; R273H; R273L; R273P; R280G; R280I; R280K; R280T; R282W; R306*; R337C; R337L; R342*; S127F; S127Y; S183*; S215I; S215R; S241F; T125T; T155N; T155P; V122D; V157F; V173L; V173M; V216M; V272M; V274A; V73W; W146*; W91*; Y163C; Y205C; Y220C; Y234C; Y236C), STK11 (splice variant), STIP1 (splice variant), STAG2 (splice variant), SPOP (F133L), SPEN (R806T), SOX17 (S403I), SMO (L412F), SMARCA4 (G1232S; R1135W; T910M), SMARCA1 (splice variant), SMAD4 (R361C; R361H; R445*), SF3B1 (G742D; K700E), SETD2 (splice variant), SCAI (Q155H), RUNX1 (R201*), RRAS2 (Q72L), RQCD1 (P131L), RPSAP58 (Q111E), RNF43 (G659V), RHOA (E40Q), RHEB (Y35N), RB1 (R579*), RAC1 (P29S), PTPRB (D1778N), PTPN11 (G503V; T468M), PTEN (A328Q; P248T; Q298*; R130*; R130G; R130L; R130P; R130Q; R233*; R335*; S170N; T319*; Y27D), PPP6C (R301C; S307L), PPP2R1A (P179R; R183W), POLE (splice variant), PIK3R1 (G376R; K567E; N564D), PIK3CA (C420R; C901F; D350G; E110delE; E453K; E542K; E545A; E545G; E545K; E726K; E81K; G1049R; G118D; H1047L; H1047R; K111 E; K111N; M1043I; M1043V; N1044K; N345K; Q546K; Q546P; Q546R; R108H; R38H; R88Q; R93Q; V344G; V344M), PBRM1 (splice variant), PABPC3 (A313R), NRAS (G12C; G12D; G13D; G13R; Q61H; Q61K; Q61L; Q61R), NPM1 (Q289S; W288L), NOTCH1 (E2515V), NFE2L2 (D29H; E79Q; R34G), NF1 (K1661G; R440*), NCOR1 (splice variant), MYD88 (L265P), MYCN (P44L), MUC4 (H4205Q), MLL3 (splice variant), MLL2 (splice variant), MGA (R2435Q), MED12 (L1224F), MAX (H28R; R60Q), MAP2K4 (S184L), MAP2K1 (E203K; P124S), LRPPRC (splice variant), KRAS (A146T; G12A; G12C; G12D; G12F; G12R; G12S; G12V; G13C; G13D; K117N; Q61H; Q61K; Q61L; Q61R), KIT (D816V), KDR (S1100F), KDM6A (Q555*), ING1 (R339*), IDH2 (R140Q; R172K), IDH1 (R132C; R132G; R132H; R132S), HRAS (G12D; G13V; Q61K; Q61R), HIST1H3B (E74K), HERC2 (splice variant), GNAS (R201C), GATA3 (P409A), FRG1 (E176*), FLT3 (D835Y), FGFR3 (S249C), FGFR2 (N550K; S252W), FBXW7 (G423V; R465C; R465H; R479Q; R505C; R505G), FAT1 (splice variant), FANCD2 (splice variant), ERBB4 (R711C), ERBB3 (D297Y; V104L; V104M), ERBB2 (D769Y; L755S; R678Q; S31 OF; V8421), EP300 (D1399N), EIF2AK3 (R911E), EGFR (A289T; A289V; G598V; L858R; L861Q; R108K; R222C), EEF1B2 (S43G), DNMT3A (R882C; R882H), CUL3 (splice variant), CUL1 (E485K), CTNNB1 (D32N; D32Y; G34E; G34R; S33C; S33F; S33Y; S37A; S37C; S37F; S37Y; S45F; T41A; T41I), CTCF (R448*), CSNK2A1 (H236R), CREBBP (R1446C), CR1 (E2220*; R2194*), CNOT3 (E20K), CLOCK (L123*), CLCC1 (P406Q), CLASP2 (M965W), CIC (R215W), CHD8 (splice variant), CHD4 (R 162W; R975H), CEP290 (1556N), CDKN2A (D84N; E120*; E88*; H83Y; P114L; P48L; Q50*; R58*; R80*; W110*), CDH1 (splice variant), CARM1 (A202V), BRAF (G466V; K601E; N581S; V600E; V600K), BAP1 (splice variant), B2M (L15F), ATRX (R1426*), ATM (splice variant), ARID2 (S297F), ARID1A (R1276*; R1335*; R1989*; R2158*; R693*, ARFGAP3 (N299M), APC (E1374*; F1491L; Q1367*; Q1378*; R1114*; R1450*; R213*; R216*; R302*; R564*; R805*; R876*; S1346*; T1556N), ALK (F1174L; R1275Q), AKT1 (E17K), ACVR2A (K437R), Prostate-specific antigen precursor, Kita-kyushu lung cancer antigen 1, Trophoblast glycoprotein, Cyclin-dependent kinase inhibitor 2A, Cyclin-dependent kinase inhibitor 2A, isoforms 1/2/3, multiple tumor suppressor 1/cyclin-dependent kinase 4 inhibitor p16, GTPase NRas or a fragment, variant or derivative of any one of said mutated tumor antigens, or any combination thereof. (Sequence changes at protein level with an asterix are described as amino acid deletion introducing an immediate translation stop codon).

According to preferred embodiments, the artificial nucleic acid molecule according to the invention may encode in its at least one encoding region at least one antigenic peptide or protein comprising or consisting of an amino acid sequence according to any one of SEQ ID NOs: 3719-27945; 76420-76439, 76440-76474 or a fragment, variant or derivative of any one of said sequences, preferably comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably at least 90% and most preferably of at least 95% or even 97%, sequence identity to any of these sequences.

According to preferred embodiments, artificial nucleic acid molecule according to the invention may encode in its at least one coding region at least one antigenic pepide or protein comprising or consisting of an amino acid sequence according to SEQ ID NOs: 1-504 in patent application WO2017182634 (as listed in Table 1) or a fragment, variant or derivative of any one of said sequences, preferably comprising or consisting of an amino acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

Accordingly, the coding region of the artificial nucleic acid molecule according to the invention may preferably comprise a nucleic acid sequence according to any one of SEQ ID NOs: 27946-52172; 76495-76514, 52173-76399; 76570-76589, 76515-76549, 76590-76624 or a fragment, variant or derivative of any one of said sequences, preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

According to preferred embodiments, the artificial nucleic acid molecule according to the invention may comprise in its at least one coding region at least one nucleic acid sequence according to SEQ ID NOs: 505-4536 in patent application WO2017182634 (as listed in Table 1) or a fragment, variant or derivative of any one of said sequences, preferably comprising or consisting of a nucleic acid sequence having, in increasing order of preference, at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

According to particularly preferred embodiments, the artificial nucleic acid molecule, preferably RNA, of the invention may encode in its at least one coding region an antigenic peptide or protein derived from a tumor antigen selected from BRAF, PIK3CA, KRAS, IDH1, TP53, NRAS, AKTI, SF3B1, CDKN2A, RPSAP58, EGFR, NY-ESO1, MUC-1, 5T4, Her2, MAGE-A3, LY6K, CEACAM6, CEA, MCAK, KK-LC1, Gastrin, VEGFR2, MMP-7, MPHOSPH1, MAGE-A4, MAGE-A1, MAGE-C1, PRAME, Survivin, MAGE-A9, MAGE-C2, FGFR2, WT1, PSA, PSMA, Prostate-specific antigen precursor, Kita-kyushu lung cancer antigen 1, Trophoblast glycoprotein, Cyclin-dependent kinase inhibitor 2A, Cyclin-dependent kinase inhibitor 2A, isoforms 1/2/3, multiple tumor suppressor 1/cyclin-dependent kinase 4 inhibitor p16, GTPase NRas, or a fragment, variant or derivative of any one of said tumor antigens, or any combination thereof.

Bacterial, Viral, Protozoal, Fungal Antigens

According to further preferred embodiments, the artificial nuclei acid molecule, preferably RNA, according to the invention encodes, in its at least one coding region, at least one antigenic peptide or protein derived from a bacterial, viral, protozoal or fungal antigen.

Preferably, said at least one antigenic peptide or protein encoded by the at least one coding region of the artificial nucleic acid molecule, preferably RNA, of the invention, may be derived from a bacterial, viral, protozoal or fungal antigen derived from *Agrobacterium tumefaciens, Ajellomyces dermatitidis* ATCC 60636, Alphapapillomavirus 10, Andes orthohantavirus, Andes virus CHI-7913, *Aspergillus terreus* NIH2624, Avian hepatitis E virus, *Babesia microti, Bacillus anthracis*, Bacteria, Betacoronavirus England 1, *Blattella germanica, Bordetella pertussis*, Borna disease virus Giessen strain He/80, *Borrelia burgdorferi* B31, *Borrelia burgdorferi* CA12, *Borrelia burgdorferi* N40, *Borrelia burgdorferi* ZS7, *Borrelia garinii* IP90, *Borrelia hermsii, Borreliella afzelii, Borreliella burgdorferi, Borreliella garinii, Bos taurus, Brucella melitensis, Brugia malayi, Bundibugyo ebolavirus, Burkholderia pseudomallei, Burkholderia pseudomallei* K96243, *Campylobacter jejuni, Campylobacter upsaliensis, Candida albicans, Cavia porcellus*, Chikungunya virus, Chikungunya virus MY/08/065, Chikungunya virus Singapore/11/2008, Chikungunya virus strain LR2006_OPY1 IMT/Reunion Island/2006, Chikungunya virus strain S27-African prototype, *Chlamydia pneumoniae, Chlamydia trachomatis, Chlamydia trachomatis* Serovar D, Chlamydiae, Clostridioides *difficile, Clostridium difficile* BI/NAP1/027, *Clostridium tetani*, Convict Creek 107 virus, *Corynebacterium diphtheriae*, Cowpox virus (Brighton Red) White-pock, Coxsackievirus A16, Coxsackievirus A9, Coxsackievirus B1, Coxsackievirus B2, Coxsackievirus B3, Coxsackievirus B4, Crimean-Congo hemorrhagic fever orthonairovirus, *Cryptosporidium parvum*, Dengue virus, Dengue virus 1, Dengue virus 1 Nauru/West Pac/1974, Dengue virus 1 PVP159, Dengue virus 1 Singapore/S275/1990, Dengue virus 2, Dengue virus 2 D2/SG/05K4155DK1/2005, Dengue virus 2 Jamaica/i 1409/1983, Dengue virus 2 Puerto Rico/PR159-S1/1969, Dengue virus 2 strain 43, Dengue virus 2 Thailand/16681/84, Dengue virus 2 Thailand/NGS-C/1944, Dengue virus 3, Dengue virus 4, Dengue virus 4 Dominica/814669/1981, Dengue virus 4 Thailand/0348/1991, Dengue virus type 1 Hawaii, Ebola virus—Mayinga, Zaire, 1976, Ebolavirus, *Echinococcus granulosus, Echinococcus multilocularis*, Echovirus E11, Echovirus E9, *Ehrlichia canis* str. Jake, *Ehrlichia chaffeensis, Ehrlichia chaffeensis* str. Arkansas, *Entamoeba histolytica, Entamoeba histolytica* YS-27, *Enterococcus fae-*

*cium*, Enterovirus A, Enterovirus A71, Enterovirus C, *Escherichia coli, Fasciola gigantica, Fasciola hepatica*, Four Corners hantavirus, *Francisella tularensis, Francisella tularensis* subsp. holarctica LVS, *Francisella tularensis* subsp. *tularensis* SCHU S4, Gambierdiscus toxicus, GB virus C, *Glossina morsitans morsitans, Gnathostoma* binucleatum, Gp160, H1N1 subtype, H5N1 subtype, *Haemophilus influenzae* NTHi 1128, *Haemophilus influenzae* Serotype B, *Haemophilus influenzae* Subtype 1H, Hantaan orthohantavirus, Hantaan virus 76-118, HBV genotype D, *Helicobacter pylori, Helicobacter pylori* 26695, Heligmosomoides polygyrus, Hepatitis B virus, Hepatitis B virus adr4, Hepatitis B virus ayw/France/Tiollais/1979, Hepatitis B virus genotype D, Hepatitis B virus subtype adr, Hepatitis B virus subtype adw, Hepatitis B virus subtype adw2, Hepatitis B virus subtype adyw, Hepatitis B virus subtype AYR, Hepatitis B virus subtype ayw, Hepatitis C virus, Hepatitis C virus (isolate 1), Hepatitis C virus (isolate BK), Hepatitis C virus (isolate Conl), Hepatitis C virus (isolate Glasgow), Hepatitis C virus (isolate H), Hepatitis C virus (isolate H77), Hepatitis C virus (isolate HC-G9), Hepatitis C virus (isolate HCV-K3a/650), Hepatitis C virus (isolate Japanese), Hepatitis C virus (isolate JK049), Hepatitis C virus (isolate NZL1), Hepatitis C virus (isolate Taiwan), Hepatitis C virus genotype 1, Hepatitis C virus genotype 2, Hepatitis C virus genotype 3, Hepatitis C virus genotype 4, Hepatitis C virus genotype 5, Hepatitis C virus genotype 6, Hepatitis C virus HCT18, Hepatitis C virus HCV-KF, Hepatitis C virus isolate HC-J1, Hepatitis C virus isolate HC-J6, Hepatitis C virus isolate HC-J8, Hepatitis C virus JFH-1, Hepatitis C virus subtype 1a, Hepatitis C virus subtype 1a Chiron Corp., Hepatitis C virus subtype 1 b, Hepatitis C virus subtype 1b AD78, Hepatitis C virus subtype 1b isolate BE-11, Hepatitis C virus subtype 1b JK1, Hepatitis C virus subtype 2a, Hepatitis C virus subtype 2b, Hepatitis C virus subtype 3a, Hepatitis C virus subtype 5a, Hepatitis C virus subtype 6a, Hepatitis delta virus, Hepatitis delta virus TW2667, Hepatitis E virus, Hepatitis E virus (strain Burma), Hepatitis E virus (strain Mexico), Hepatitis E virus SAR-55, Hepatitis E virus type 3 Kernow-C1, Hepatitis E virus type 4 JAK-Sai, Hepatovirus A, Heron hepatitis B virus, Herpes simplex virus (type 1/strain 17), Herpesviridae, HIV-1 CRF01_AE, HIV-1 group O, HIV-1 M:A, HIV-1 M:B, HIV-1 M:B_89.6, HIV-1 M:B_HXB2R, HIV-1 M:B_MN, HIV-1 M:C, HIV-1 M:CRF01_AE, HIV-1 M:G, HIV-1 O_ANT70, Human adenovirus 11, Human adenovirus 2, Human adenovirus 40, Human adenovirus 5, Human alphaherpesvirus 1, Human alphaherpesvirus 2, Human alphaherpesvirus 3, Human betaherpesvirus 5, Human betaherpesvirus 6B, Human bocavirus 1, Human bocavirus 2, Human bocavirus 3, Human coronavirus 229E, Human coronavirus OC43, Human endogenous retrovirus, Human endogenous retrovirus H, Human endogenous retrovirus K, Human enterovirus 71 Subgenogroup C4, Human gammaherpesvirus 4, Human gammaherpesvirus 8, Human hepatitis A virus Hu/Australia/HM175/1976, Human herpesvirus 1 strain KOS, Human herpesvirus 2 strain 333, Human herpesvirus 2 strain HG52, Human herpesvirus 3H-551, Human herpesvirus 3 strain Oka vaccine, Human herpesvirus 4 strain B95-8, Human herpesvirus 4 type 1, Human herpesvirus 4 type 2, Human herpesvirus 5 strain AD169, Human herpesvirus 5 strain Towne, Human herpesvirus 6 (strain Uganda-1102), Human herpesvirus 7 strain JI, Human immunodeficiency virus 1, Human immunodeficiency virus 2, Human immunodeficiency virus type 1 (isolate YU2), Human immunodeficiency virus type 1 (JRCSF ISOLATE), Human immunodeficiency virus type 1 (NEW YORK-5 ISOLATE), Human immunodeficiency virus type 1 (SF162 ISOLATE), Human immunodeficiency virus type 1 (SF33 ISOLATE), Human immunodeficiency virus type 1 BH10, Human metapneumovirus, Human orthopneumovirus, Human papillomavirus, Human papillomavirus type 11, Human papillomavirus type 16, Human papillomavirus type 18, Human papillomavirus type 29, Human papillomavirus type 31, Human papillomavirus type 33, Human papillomavirus type 35, Human papillomavirus type 39, Human papillomavirus type 44, Human papillomavirus type 45, Human papillomavirus type 51, Human papillomavirus type 52, Human papillomavirus type 58, Human papillomavirus type 59, Human papillomavirus type 6, Human papillomavirus type 68, Human papillomavirus type 6b, Human papillomavirus type 73, Human parainfluenza 3 virus (strain NIH 47885), Human parechovirus 1, Human parvovirus 4, Human parvovirus B19, Human poliovirus 1, Human poliovirus 1 Mahoney, Human poliovirus 3, Human polyomavirus 1, Human respiratory syncytial virus (strain RSB1734), Human respiratory syncytial virus (strain RSB6190), Human respiratory syncytial virus (strain RSB6256), Human respiratory syncytial virus (strain RSB642), Human respiratory syncytial virus (subgroup B/strain 18537), Human respiratory syncytial virus A, Human respiratory syncytial virus A strain Long, Human respiratory syncytial virus A2, Human respiratory syncytial virus S2, Human respirovirus 3, Human rhinovirus A89, Human rotavirus A, Human T-cell lymphotrophic virus type 1 (Caribbean isolate), Human T-cell lymphotrophic virus type 1 (isolate MT-2), Human T-cell lymphotrophic virus type 1 (strain ATK), Human T-cell lymphotropic virus type 1 (african isolate), Human T-lymphotropic virus 1, Human T-lymphotropic virus 2, Influenza A virus, Influenza A virus (A/Anhui/1/2005(H5N1)), Influenza A virus (A/Anhui/PA-1/2013 (H7N9)), Influenza A virus (A/Argentina/3779/94(H3N2)), Influenza A virus (A/Auckland/1/2009(H1N1)), Influenza A virus (A/Bar-headed Goose/Qinghai/61/05(H5N1)), Influenza A virus (A/Brevig Mission/1/1918(H1N1)), Influenza A virus (A/California/04/2009(H1N1)), Influenza A virus (A/California/07/2009(H1N1)), Influenza A virus (A/California/08/2009(H1N1)), Influenza A virus (A/California/10/1978(H1N1)), Influenza A virus (A/Christchurch/2/1988 (H3N2)), Influenza A virus (A/Cordoba/3278/96(H3N2)), Influenza A virus (A/France/75/97(H3N2)), Influenza A virus (A/Fujian/411/2002(H3N2)), Influenza A virus (A/Hong Kong/01/2009(H1N1)), Influenza A virus (A/Hong Kong/1/1968(H3N2)), Influenza A virus (A/Indonesia/CDC699/2006(H5N1)), Influenza A virus (A/lran/1/1957 (H2N2)), Influenza A virus (A/Memphis/13/1978(H1N1)), Influenza A virus (A/Memphis/4/1980(H3N2)), Influenza A virus (A/Nanchang/58/1993(H3N2)), Influenza A virus (A/New York/232/2004(H3N2)), Influenza A virus (A/New_York/15/94(H3N2)), Influenza A virus (A/New_York/17/94(H3N2)), Influenza A virus (A/Ohio/3/95(H3N2)), Influenza A virus (A/Otago/5/2005(H1N1)), Influenza A virus (A/Puerto Rico/8/1934(H1N1)), Influenza A virus (A/Shangdong/5/94(H3N2)), Influenza A virus (A/Solomon Islands/3/2006 (Egg passage)(H1N1)), Influenza A virus (A/South Carolina/1/1918(H1N1)), Influenza A virus (A/swine/Hong Kong/126/1982(H3N2)), Influenza A virus (A/swine/Ilowa/15/1930(H1N1)), Influenza A virus (A/Sydney/05/97-like(H3N2)), Influenza A virus (A/Texas/1/1977 (H3N2)), Influenza A virus (A/Udorn/307/1972(H3N2)), Influenza A virus (A/Uruguay/716/2007(H3N2)), Influenza A virus (A/USSR/26/1985(H3N2)), Influenza A virus (ANiet Nam/1203/2004(H5N1)), Influenza A virus (A/Vietnam/1194/2004(H5N1)), Influenza A virus (A/Wellington/

75/2006(H1N1)), Influenza A virus (A/Wilson-Smith/1933 (H1N1)), Influenza A virus (A/Wuhan/359/1995(H3N2)), Influenza A virus (STRAIN A/EQUINE/NEW MARKET/76), Influenza B virus, Japanese encephalitis virus, Japanese encephalitis virus strain Nakayama, Japanese encephalitis virus Vellore P20778, JC polyomavirus, *Junin mammarenavirus, Klebsiella pneumoniae*, Kumlinge virus, Lake Victoria marburgvirus—Popp, Lassa mammarenavirus, Lassa virus Josiah, *Leishmania, Leishmania aethiopica, Leishmania braziliensis, Leishmania braziliensis* MHOM/BR/75/M2904, *Leishmania chagasi, Leishmania donovani, Leishmania infantum, Leishmania major, Leishmania major* strain Friedlin, *Leishmania panamensis, Leishmania pifanoi, Leptospira interrogans, Leptospira interrogans* serovar *Australis, Leptospira interrogans* serovar Copenhageni, *Leptospira interrogans* serovar Copenhageni str. Fiocruz L1-130, *Leptospira interrogans* serovar Lai, *Leptospira interrogans* serovar Lai str. HY-1, *Leptospira interrogans* serovar Pomona, Little cherry virus 1, Lymphocytic choriomeningitis mammarenavirus, Measles morbillivirus, Measles virus strain Edmonston, Merkel cell polyomavirus, Mobala mammarenavirus, Modified Vaccinia Ankara virus, *Moraxella catarrhalis* 035E, Mupapillomavirus 1, *Mus musculus, Mycobacterium, Mycobacterium abscessus, Mycobacterium avium, Mycobacterium avium* serovar 8, *Mycobacterium avium* subsp. paratuberculosis, *Mycobacterium bovis* AN5, *Mycobacterium bovis* BCG, *Mycobacterium bovis* BCG str. Pasteur 1173P2, *Mycobacterium fortuitum* subsp. *fortuitum, Mycobacterium gilvum, Mycobacterium intracellulare, Mycobacterium kansasii, Mycobacterium leprae, Mycobacterium leprae* TN, *Mycobacterium marinum, Mycobacterium neoaurum, Mycobacterium phlei, Mycobacterium smegmatis, Mycobacterium tuberculosis, Mycobacterium tuberculosis* CDC1551, *Mycobacterium tuberculosis* H37Ra, *Mycobacterium tuberculosis* H37Rv, *Mycobacterium ulcerans, Mycoplasma pneumoniae, Mycoplasma pneumoniae* FH, *Mycoplasma pneumoniae* M129, *Necator americanus, Neisseria gonorrhoeae, Neisseria meningitidis* serogroup B H44/76, Nipah henipavirus, Norovirus genogroup 2 Camberwell 1890, *Onchocerca volvulus, Orientia tsutsugamushi, Oryctolagus cuniculus*, Pan troglodytes, *Paracoccidioides brasiliensis, Paracoccidioides brasiliensis* B339, *Plasmodium falciparum, Plasmodium falciparum* 3D7, *Plasmodium falciparum* 7G8, *Plasmodium falciparum* FC27/Papua New Guinea, *Plasmodium falciparum* FCR-3/Gambia, *Plasmodium falciparum* isolate WELLCOME, *Plasmodium falciparum* K1, *Plasmodium falciparum* LE5, *Plasmodium falciparum* Mad20/Papua New Guinea, *Plasmodium falciparum* NF54, *Plasmodium falciparum* Palo Alto/Uganda, *Plasmodium falciparum* RO-33, *Plasmodium reichenowi, Plasmodium vivax, Plasmodium vivax* NK, *Plasmodium vivax* Sal-1, *Plasmodium vivax* strain Belem, *Plasmodium vivax*-like sp., *Porphyromonas gingivalis, Porphyromonas gingivalis* 381, *Porphyromonas gingivalis* OMZ 409, *Prevotella* sp. oral taxon 472 str. F0295, *Pseudomonas aeruginosa*, Puumala orthohantavirus, Puumala virus (strain Umea/hu), Puumala virus sotkamo/v-2969/81, *Pythium insidiosum*, Ravn virus—Ravn, Kenya, 1987, Respiratory syncytial virus, *Rhodococcus fascians, Rhodococcus hoagii*, Rubella virus, Rubella virus strain M33, Rubella virus strain Therien, Rubella virus vaccine strain RA27/3, *Saccharomyces cerevisiae*, Saimiriine gammaherpesvirus 2, *Salmonella enterica* subsp. *enterica* serovar *Typhi, Salmonella* 'group A', *Salmonella* 'group D', *Salmonella* sp. 'group B', Sapporo rat virus, SARS coronavirus, SARS coronavirus BJ01, SARS coronavirus TJF, SARS coronavirus Tor2, SARS coronavirus Urbani, *Schistosoma, Schistosoma japonicum, Schistosoma mansoni, Schistosoma mansoni* Puerto Rico, Sin Nombre orthohantavirus, Sindbis virus, *Staphylococcus aureus, Staphylococcus aureus* subsp. *aureus* COL, *Staphylococcus aureus* subsp. *aureus* MRSA252, *Streptococcus, Streptococcus mutans, Streptococcus mutans* MT 8148, *Streptococcus oralis, Streptococcus pneumoniae, Streptococcus pyogenes, Streptococcus pyogenes* serotype M24, *Streptococcus pyogenes* serotype M3 D58, *Streptococcus pyogenes* serotype M5, *Streptococcus pyogenes* serotype M6, *Streptococcus* sp. 'group A', *Taenia crassiceps, Taenia saginata, Taenia solium*, Tick-borne encephalitis virus, *Toxocara canis, Toxoplasma gondii, Toxoplasma gondii* ME49, *Toxoplasma gondii* RH, *Toxoplasma gondii* type I, *Toxoplasma gondii* type II, *Toxoplasma gondii* type III, *Toxoplasma gondii* VEG, *Treponema pallidum, Treponema pallidum* subsp. *pallidum* str. Nichols, *Trichomonas vaginalis, Triticum aestivum, Trypanosoma brucei brucei, Trypanosoma brucei* gambiense, *Trypanosoma cruzi, Trypanosoma cruzi* Dm28c, *Trypanosoma cruzi* strain CL Brener, Vaccinia virus, Vesicular stomatitis virus, *Vibrio cholerae*, West Nile virus, West Nile virus NY-99, *Wuchereria bancrofti*, Yellow fever virus 17D/Tiantan, *Yersinia enterocolitica*, Zaire ebolavirus, Zika virus, or a fragment, variant or derivative of any one of said bacterial, viral, protozoal, fungal antigens, or any combination thereof.

Allogeneic Antigens

According to further preferred embodiments, the artificial nuclei acid molecule, preferably RNA, according to the invention encodes, in its at least one coding region, at least one antigenic peptide or protein derived from an allogeneic antigen.

An "allogeneic antigen" or "alloantigen" or "isoantigen" is an antigen existing in alternative (allelic) forms in a species, and can therefore induce alloimmunity (or isoimmunity) in members of the same species, e.g. upon blood transfusion, tissue or organ transplantation, or sometimes pregnancy. Typical allogeneic antigens include histocompatibility antigens and blood group antigens. In the context of the present invention, allogeneic antigens are preferably of human origin. The provision of an artificial nucleic acid, preferably RNA, encoding an antigenic protein or peptide derived from an allogeneic antigen can, for instance, be used to induce immune tolerance towards said allogeneic antigen.

Preferably, the at least one antigenic peptide or protein encoded by the at least one coding region of the artificial nucleic acid molecule, preferably RNA, of the invention, may be derived from an allogeneic antigen derived or selected from UDP-glucuronosyltransferase 2B17 precursor, MHC class I antigen HLA-A2, Coagulation factor VIII precursor, coagulation factor VIII, Thrombopoietin precursor (Megakaryocyte colony-stimulating factor) (Myeloproliferative leukemia virus oncogene ligand) (C-mpl ligand) (ML) (Megakaryocyte growth and development factor) (MGDF), Integrin beta-3, histocompatibility (minor) HA-1, SMCY, thymosin beta-4, Y-chromosomal, Histone demethylase UTY, HLA class II histocompatibility antigen, DP(W2) beta chain, lysine-specific demethylase 5D isoform 1, myosin-lg, Probable ubiquitin carboxyl-terminal hydrolase FAF-Y, Pro-cathepsin H, DRB1, MHC DR beta DRw13 variant, HLA class II histocompatibility antigen, DRB1-15 beta chain, HLA class II histocompatibility antigen, DRB1-1 beta chain precursor, Minor histocompatibility protein HMSD variant form, HLA-DR3, Chain B, Hla-Drl (Dra, Drb10101) Human Class Iii Histocompatibility Protein (Extracellular Domain) Complexed With Endogenous Peptide, MHC classII HLA-DRB1, MHC class I HLA-A, human leukocyte antigen B, RAS protein activator like-3, anoctamin-9, ATP-dependent RNA helicase DDX3Y, Protocadherin-11 Y-linked, KIAA0020, platelet glycoprotein IIIa leucine-33 form-specific antibody light chain variable region, dead box, Y isoform, ATP-dependent RNA helicase DDX3X isoform 2, HLA-DRB1 protein, truncated integrin beta 3, glycoprotein IIIa, platelet membrane glycoprotein IIb, Carbonic anhydrase 1, HLA class I histocompatibility antigen, A-11 alpha chain precursor, HLA-A11 antigen A11.2, HLA class I histocompatibility antigen, A-68 alpha chain, MHC HLA-B51, MHC class I antigen HLA-A30, HLA class I histocompatibility antigen, A-1 alpha chain precursor variant, HLA class I histocompatibility antigen B-57, MHC class I antigen, MHC class II antigen, MHC HLA-DR-beta cell surface glycoprotein, DR7 beta-chain glycoprotein, MHC DR-beta, lymphocyte antigen, collagen type V alpha 1, collagen alpha-2(V) chain preproprotein, sp 10 nuclear body protein isoform d, integrin, alpha 2b (platelet glycoprotein IIb of IIb/IIIa complex, antigen CD41), isoform CRA_c, 40S ribosomal protein S4, Y isoform 1, uncharacterized protein KIAA1551, factor VIII, UDP-glucuronosyltransferase 2B17, HLA class I histocompatibility antigen, A-2 alpha chain, Thrombopoietin, Minor histocompatibility protein HA-1, Lysine-specific demethylase 5D, HLA class II histocompatibility antigen, DP beta 1 chain, Unconventional myosin-lg, HLA class II histocompatibility antigen, DRB1-13 beta chain, HLA class II histocompatibility antigen, DRB1-1 beta chain, HLA class II histocompatibility antigen, DRB1-3 chain, HLA class I histocompatibility antigen, B-46 alpha chain, Pumilio homolog 3, ATP-dependent RNA helicase DDX3X, Integrin alpha-11b, HLA class I histocompatibility antigen, A-11 alpha chain, HLA class I histocompatibility antigen, B-51 alpha chain, HLA class I histocompatibility antigen, A-30 alpha chain, HLA class I histocompatibility antigen, A-1 alpha chain, HLA class I histocompatibility antigen, B-57 alpha chain, HLA class I histocompatibility antigen, B-40 alpha chain, HLA class II histocompatibility antigen, DRB1-7 beta chain, HLA class II histocompatibility antigen, DRB1-12 beta chain, Collagen alpha-1(V) chain, Collagen alpha-2(V) chain, Sp110 nuclear body protein, or a fragment, variant or derivative of any one of said allogeneic antigens, or any combination thereof.

Autoantigens

According to further preferred embodiments, the artificial nuclei acid molecule, preferably RNA, according to the invention encodes, in its at least one coding region, at least one antigenic peptide or protein derived from an autoantigen.

An "autoantigen" an endogenous "self-" antigen that-despite being a normal body constituent-induces an autoimmune reaction in the host. In the context of the present invention, autoantigens are preferably of human origin. The provision of an artificial nucleic acid, preferably RNA, encoding an antigenic protein or peptide derived from an autoantigen can, for instance, be used to induce immune tolerance towards said autoantigen.

Preferably, the at least one antigenic peptide or protein encoded by the at least one coding region of the artificial nucleic acid molecule, preferably RNA, of the invention, may encode an antigenic peptide or protein derived from an autoantigen derived or selected from 60 kDa chaperonin 2, Lipoprotein LpqH, Melanoma antigen recognized by T-cells 1, MHC class I polypeptide-related sequence A, Parent Protein, Structural polyprotein, Tyrosinase, Myelin proteolipid protein, Epstein-Barr nuclear antigen 1, Envelope glycoprotein GP350, Genome polyprotein, Collagen alpha-1(II) chain, Aggrecan core protein, Melanocyte-stimulating hormone receptor, Acetylcholine receptor subunit alpha, 60 kDa heat shock protein, mitochondrial, Histone H4, Myosin-11, Glutamate decarboxylase 2, 60 kDa chaperonin, PqqC-like protein, Thymosin beta-10, Myelin basic protein, Epstein-Barr nuclear antigen 4, Melanocyte protein PMEL, HLA class II histocompatibility antigen, DQ beta 1 chain, Latent membrane protein 2, Integrin beta-3, Nucleoprotein, 60S ribosomal protein L10, Protein BOLF1, 60S acidic ribosomal protein P2, Latent membrane protein 1, Collagen alpha-2(VI) chain, Exodeoxyribonuclease V, Gamma, Trans-activator protein BZLF1, S-arrestin, HLA class I histocompatibility antigen, A-3 alpha chain, Protein CT_579, Matrin-3, Envelope glycoprotein B, ATP-dependent zinc metalloprotease FtsH, U1 small nuclear ribonucleoprotein 70 kDa, CD48 antigen, Tubulin beta chain, Actin, cytoplasmic 1, Epstein-Barr nuclear antigen 3, NEDD4 family-interacting protein 1, 60S ribosomal protein L28, Immediate-early protein 2, Insulin, isoform 2, Keratin, type II cytoskeletal 3, Matrix protein 1, Histone H2A.Z, mRNA export factor ICP27 homolog, Small nuclear ribonucleoprotein-associated proteins B and B', Large cysteine-rich periplasmic protein OmcB, Smoothelin, Small nuclear ribonucleoprotein Sm D1, Acetylcholine receptor subunit epsilon, Invasin repeat family phosphatase, Alpha-crystallin B chain, HLA class II histocompatibility antigen, DRB1-13 beta chain, HLA class II histocompatibility antigen, DRB1-4 beta chain, Dihydrolipoyllysine-residue acetyltransferase component of pyruvate dehydrogenase complex, mitochondrial, Keratin, type I cytoskeletal 18, Epstein-Barr nuclear antigen 6, Protein Tax-1, Vimentin, Keratin, type I cytoskeletal 16, Keratin, type I cytoskeletal 10, HLA class I histocompatibility antigen, B-27 alpha chain, Thyroglobulin, Acetylcholine receptor subunit gamma, Chaperone protein DnaK, Protein U24, Na(+)-translocating NADH-quinone reductase subunit A, 65 kDa phosphoprotein, Probable ATP-dependent Clp protease ATP-binding subunit, Probable outer membrane protein PmpC, Heat shock 70 kDa protein 1B, Hemagglutinin, Tetanus toxin, Enolase, Ras-associated and pleckstrin homology domains-containing protein 1, Keratin, type II cytoskeletal 7, Myosin-9, Histone H1-like protein Hcl, Envelope glycoprotein gp160, Urease subunit beta, Vasoactive intestinal polypeptide receptor 1, Viral interleukin-10 homolog, Histone H3.3, Replication protein A 32 kDa subunit, Probable outer membrane protein PmpD, Insulin-2, L-dopachrome tautomerase, Keratin, type I cytoskeletal 9, Envelope glycoprotein H, DNA polymerase catalytic subunit, Beta-2-glycoprotein 1, Envelope glycoprotein gp62, Serum albumin, Major DNA-binding protein, HLA class I histocompatibility antigen, A-2 alpha chain, Myeloblastin, POTE ankyrin domain family member I, Protein E7, Predicted Efflux Protein, Replication and transcription activator, Gag-Pro-Pol polyprotein, Capsid protein VP26, Major capsid protein, Apoptosis regulator BHRF1, Epstein-Barr nuclear antigen 2, HLA class I histocompatibility antigen, B-7 alpha chain, Calreticulin, Gamma-secretase C-terminal fragment 59, Insulin, Glucose-6-phosphatase 2, Islet amyloid polypeptide, Receptor-type tyrosine-protein phosphatase N2, Receptor-type tyrosine-protein phosphatase-like N, Islet cell autoantigen 1, Bos d 6, Glutamate decarboxylase 1, 60S ribosomal protein L29, 28S ribosomal protein 531, mitochondrial, HLA class II histocompatibility antigen, DRB1-16 beta chain, Collagen alpha-3(IV) chain, Glucose-6-phosphatase, Glucose-6-phosphatase 3, Collagen alpha-5(IV) chain, Protein Nef, Glial fibrillary acidic protein, Fibrillin-1, Tenascin, Stromelysin-1, Interstitial collagenase, Calpain-2 catalytic subunit, Chondroitin sulfate proteoglycan 4, Fibrinogen beta chain, Chaperone protein DnaJ, Chitinase-3-like protein 1, Matrix metalloproteinase-16, DNA topoisomerase 1, Follistatin-related protein 1, Ig gamma-1 chain C region, Ig gamma-3 chain C region, Collagen alpha-2(XI) chain, Desmoglein-3, Fibrinogen alpha chain, Filaggrin, T-cell receptor beta chain V region CTL-L17, T-cell receptor beta-1 chain C region, Ig heavy chain V-I region EU, Collagen alpha-1(IV) chain, HLA class I histocompatibility antigen, Cw-7 alpha chain, HLA class I histocompatibility antigen, B-35 alpha chain, HLA class I histocompatibility antigen, B-38 alpha chain, High mobility group protein B2, Ig heavy chain V-III region ARH-77, HLA class II histocompatibility antigen, DR beta 4 chain, Ig kappa chain C region, Alpha-enolase, Lysosomal-associated transmembrane protein 5, HLA class I histocompatibility antigen, B-52 alpha chain, Heterogeneous nuclear ribonucleoproteins A2/B1, T-cell receptor beta chain V region YT35, Ig gamma-4 chain C region, T-cell receptor beta-2 chain C region, DnaJ homolog subfamily B member 2, DnaJ homolog subfamily A member 1, Ig kappa chain V-IV region Len, Ig heavy chain V-III region OU, Ig kappa chain V-IV region B17, 2',3'-cyclic-nucleotide 3'-phosphodiesterase, Ig heavy chain V-III region MCE, Ig kappa chain V-III region HIC, Ig heavy chain V-III region COR, Myelin-oligodendrocyte glycoprotein, Ig kappa chain V-III region RPMI 6410, Ig kappa chain V-III region GM607, Immunoglobulin lambda-like polypeptide 5, Ig heavy chain V-III region WAH, Biotin-protein ligase, Oligodendrocyte-myelin glycoprotein, Transaldolase, DNA helicase/primase complex-associated protein, Interferon beta, Myelin-associated oligodendrocyte basic protein, Myelin-associated glycoprotein, Fusion glycoprotein F0, Myelin protein P0, Ig lambda chain V-II region MGC, DNA primase, Minor capsid protein L2, Myelin P2 protein, Peripheral myelin protein 22, Retinol-binding protein 3, Butyrophilin subfamily 1 member A1, Alkaline nuclease, Claudin-11, N-acetylmuramoyl-L-alanine amidase CwlH, GTPase Der, Possible transposase, ABC transporter, ATP-binding protein, putative, Collagen alpha-2(IV) chain, Calpastatin, Ig kappa chain V-III region SIE, E3 ubiquitin-protein ligase TRIM68, Glutamate receptor ionotropic, NMDA 2A, Spectrin alpha chain, non-erythrocytic 1, Lupus La protein, Complement C1q subcomponent subunit A, U1 small nuclear ribonucleoprotein A, 60 kDa SS-A/Ro ribonucleoprotein, DNA repair protein XRCC4, Histone H3-like centromeric protein A, Histone H1.4, Putative HTLV-1-related endogenous sequence, HLA class II histocompatibility antigen, DRB1-3 chain, HLA class II histocompatibility antigen, DRB1-1 beta chain, Small nuclear ribonucleoprotein Sm D3, Tumor necrosis factor receptor superfamily member 6, Phosphomannomutase/phosphoglucomutase, Tripartite terminase subunit UL15, Proteasome subunit beta type-3, Proliferating cell nuclear antigen, Inner capsid protein sigma-2, Histone H2B type 1, E3 ubiquitin-protein ligase TRIM21, DNA-directed RNA polymerase II subunit RPB1, X-ray repair cross-complementing protein 6, U1 small nuclear ribonucleoprotein C, Caspase-8, 60S ribosomal protein L7, 5-hydroxytryptamine receptor 4, Small nuclear ribonucleoprotein-associated protein N, Exportin-1, 60S acidic ribosomal protein P0, Neurofilament heavy polypeptide, putative env, T-cell receptor alpha chain C region, T-cell receptor alpha chain V region CTL-L17, RNA polymerase sigma factor SigA, Small nuclear ribonucleoprotein Sm D2, Immunoglobulin iota chain, Ig kappa chain V-III region WOL, Histone H2B type 1-F/J/L, High mobility group protein B1, X-ray repair cross-complementing protein 5, Muscarinic acetylcholine receptor M3, Major viral transcription factor ICP4, Voltage-dependent P/Q-type calcium channel subunit alpha-1A, Heat shock protein HSP 90-beta, DNA topoisomerase 2-beta, Histone H3.1, Tumor necrosis factor ligand superfamily member 6, Phospho-N-acetylmuramoyl-pentapeptide-transferase, Hemoglobin subunit alpha, Apolipoprotein E, CD99 antigen, ATP synthase subunit beta, mitochondrial, Acetylcholine receptor subunit delta, Acyl-CoA dehydrogenase family member 10, KN motif and ankyrin repeat domain-containing protein 3, SAM and SH3 domain-containing protein 1, Elongation factor 1-alpha 1, GTP-binding nuclear protein Ran, Myosin-7, Sal-like protein 1, IgGFc-binding protein, E3 ubiquitin-protein ligase SIAH1, Muscleblind-like protein 2, Annexin A1, Protein PET117 homolog, mitochondrial, Nuclear ubiquitous casein and cyclin-dependent kinase substrate 1, Pleiotropic regulator 1, NADH dehydrogenase [ubiquinone] 1 alpha subcomplex subunit 3, Guanine nucleotide-binding protein G(o) subunit alpha, Microtubule-associated protein 1B, L-serine dehydratase/L-threonine deaminase, Centromere protein J, SH3 and multiple ankyrin repeat domains protein 3, Fumarate hydratase, mitochondrial, Cofilin-1, Rho GTPase-activating protein 9, Phosphatidate cytidylyltransferase 1, Neurofilament light polypeptide, Calsyntenin-1, GPI transamidase component PIG-T, Perilipin-3, Protein unc-13 homolog D, WD40 repeat-containing protein SMU1, Neurofilament medium polypeptide, Protein S100-B, Carboxypeptidase E, Neurexin-2-beta, NAD-dependent protein deacetylase sirtuin-2, Tripartite motif-containing protein 40, Neurexin-1-beta, Annexin A11, Hemoglobin subunit beta, Glyceraldehyde-3-phosphate dehydrogenase, Histidine triad nucleotide-binding protein 3, ATP synthase subunit e, mitochondrial, 10 kDa heat shock protein, mitochondrial, Cellular tumor antigen p53, Leukocyte-associated immunoglobulin-like receptor 1, Tubulin alpha-1B chain, Splicing factor, proline- and glutamine-rich, Olfactory receptor 10A4, Histone H2B type 2-F, Calmodulin, RNA-binding protein Raly, Phosphoinositide-3-kinase-interacting protein 1, Alpha-2-macroglobulin, Glycogen phosphorylase, brain form, THO complex subunit 4, Neuroblast differentiation-associated protein AHNAK, Phosphoserine aminotransferase, Mitochondrial folate transporter/carrier, Sentrin-specific protease 3, Cytosolic Fe—S cluster assembly factor NUBP2, Histone deacetylase 7, Serine/threonine-protein phosphatase 2A 55 kDa regulatory subunit B alpha isoform, Serine/threonine-protein phosphatase 2A regulatory subunit B" subunit alpha, Gelsolin, Insulin-like growth factor II, Tight junction protein ZO-1, Hsc70-interacting protein, FXYD domain-containing ion transport regulator 6, AP-1 complex subunit mu-1, Syntenin-1, NADH dehydrogenase [ubiquinone] iron-sulfur protein 7, mitochondrial, Low-density lipoprotein receptor, LIM domain transcription factor LMO4, Spectrin beta chain, non-erythrocytic 1, ATP-binding cassette sub-family A member 2, NADH dehydrogenase [ubiquinone] 1 subunit C2, SPARC-like protein 1, Electron transfer flavoprotein subunit alpha, mitochondrial, Glutamate dehydrogenase 1, mitochondrial, Complexin-2, Protein-serine O-palmitoleoyltransferase porcupine, Plexin domain-containing protein 2, Threonine synthase-like 2, Testican-2, C—X—C chemokine receptor type 1, Arachidonate 5-lipoxygenase-activating protein, Neuroguidin, Fatty acid 2-hydroxylase, Nuclear factor 1 X-type, LanC-like protein 1, Glutamine synthetase, Lysosome-associated membrane glycoprotein 1, Apolipoprotein A-I, Alpha-adducin, Guanine nucleotide-binding protein G(I)/G(S)/G(T) subunit beta-3, Integral membrane protein GPR137B, Ubiquilin-1, Aldose reductase, Clathrin light chain B, V-type proton ATPase subunit F, Apolipoprotein D, 40S ribosomal protein SA, Bcl-2-associated transcription factor 1, Phosphatidate cytidylyltransferase 2, ATP synthase-coupling factor 6, mitochondrial, Receptor tyrosine-protein kinase erbB-2, Echinoderm microtubule-associated protein-like 5, Phosphatidylethanolamine-binding protein 1, Myc box-dependent-interacting protein 1, Membrane-associated phosphatidylinositol transfer protein 1, 40S ribosomal protein S29, Small acidic protein, Galectin-3-binding protein, Fatty acid synthase, Baculoviral IAP repeat-containing protein 5, Septin-2, cAMP-dependent protein kinase type II-alpha regulatory subunit, Reelin, Apoptosis facilitator Bcl-2-like protein 14, Staphylococcal nuclease domain-containing protein 1, Methyl-CpG-binding domain protein 2, Transformation/transcription domain-associated protein, Transcription factor HES-1, Protein transport protein Sec23B, Paralemmin-2, C—C motif chemokine 15, Sodium/potassium-transporting ATPase subunit alpha-1, Stathmin, Heterogeneous nuclear ribonucleoprotein L-like, Nodal modulator 3, Interferon-induced GTP-binding protein Mx2, Integrin alpha-D, Low-density lipoprotein receptor-related protein 5-like protein, Macrophage migration inhibitory factor, Ferritin light chain, Dihydropyrimidinase-related protein 2, Neuronal membrane glycoprotein M6-b, ATP-binding cassette subfamily A member 5, Synaptosomal-associated protein 25, Insulin-like growth factor I, Ankyrin repeat domain-containing protein 29, Protein spinster homolog 3, Peflin, Contactin-1, Microfibril-associated glycoprotein 3, von Willebrand factor, Small nuclear ribonucleoprotein G, Interleukin-12 receptor subunit beta-1, Epoxide hydrolase 1, Cytochrome b-c1 complex subunit 10, Monoglyceride lipase, Serotransferrin, Alpha-synuclein, Cytosolic non-specific dipeptidase, Transgelin-2, Testisin, Fms-related tyrosine kinase 3 ligand, Noelin-2, Serine/threonine-protein kinase DCLK1, Interferon alpha-2, Acetylcholine receptor subunit beta, Histone H2A type 1, Beta-2 adrenergic receptor, Putrescine aminotransferase, Interferon alpha-1/13, Protein NEDD1, DnaJ homolog subfamily B member 1, Tubulin beta-6 chain, Non-histone chromosomal protein HMG-17, Polyprotein, Exosome component 10, Natural cytotoxicity triggering receptor 3 ligand 1, Gag polyprotein, Band 3 anion transport protein, Protease, Histidine-tRNA ligase, cytoplasmic, Collagen alpha-1(XVII) chain, Envoplakin, Histone H2B type 1-C/E/F/G/I, Diaminopimelate decarboxylase, Histone H2B type 2-E, Cytochrome P450 2D6, Dihydrolipoyllysine-residue succinyltransferase component of 2-oxoglutarate dehydrogenase complex, Histone H2B type 1-H, Thyroid peroxidase, Proline-rich transmembrane protein 2, Periplakin, Integrin alpha-6, Dystonin, Desmoplakin, Histone H2B type 1-J, Histone H2B type 1-B, 6,7-dimethyl-8-ribityllumazine synthase, Thyrotropin receptor, Integrin alpha-11b, Nuclear pore membrane glycoprotein 210, Protein U2, DST protein, Plectin, S110397 protein, Bos d 10, Outer capsid protein VP4, 5,6-dihydroxyindole-2-carboxylic acid oxidase, O-phosphoseryl-tRNA(Sec) selenium transferase, ATP-dependent Clp protease proteolytic subunit, Lymphocyte activation gene 3 protein, Phosphoprotein 85, L1 protein, Actin, alpha skeletal muscle, Dihydrolipoyl dehydrogenase, Dihydrolipoyllysine-residue succinyltransferase component of 2-oxoglutarate dehydrogenase complex, mitochondrial, Liver carboxylesterase 1, Dihydrolipoyllysine-residue acetyltransferase component of pyruvate dehydrogenase complex, Acetyltransferase component of pyruvate dehydrogenase complex, Pyruvate dehydrogenase protein X component, mitochondrial, Dihydrolipoamide acetyltransferase, Protein disulfide-isomerase A3, Flotillin-2, Beta-galactosidase, TSHR protein, Lipoamide acyltransferase component of branched-chain alpha-keto acid dehydrogenase complex, mitochondrial, Nuclear autoantigen Sp-100, Desmoglein-1, Glucagon receptor, Membrane glycoprotein US8, Sodium/iodide cotransporter, ORF2, Capsid protein, Uncharacterized protein LF3, Formimidoyltransferase-cyclodeaminase, Core-capsid bridging protein, Neurovirulence factor ICP34.5, Probable RNA-binding protein, Cholesterol side-chain cleavage enzyme, mitochondrial, Histone H1.0, Non-histone chromosomal protein HMG-14, Histone H5, 60S acidic ribosomal protein P1, Pyruvate dehydrogenase E1 component subunit alpha, somatic form, mitochondrial, Leiomodin-1, Uncharacterized protein RP382, Uncharacterized protein U95, (Type IV) pilus assembly protein PilIB, 2-succinylbenzoate-CoA ligase, TAZ protein, Tafazzin, Putative lactose-specific phosphotransferase system (PTS), IIBC component, Claudin-17, Pericentriolar material 1 protein, Yop proteins translocation protein L, Laminin subunit alpha-1, A disintegrin and metalloproteinase with thrombospondin motifs 13, Keratin, type I cytoskeletal 14, Coagulation factor VIII, Keratin, type I cytoskeletal 17, Neutrophil defensin 1, Ig alpha-1 chain C region, BRCA1-associated RING domain protein 1, Trinucleotide repeat-containing gene 6A protein, Thrombopoietin, Plasminogen-binding protein PgbA, Steroid 17-alpha-hydroxylase/17,20 lyase, Nucleolar RNA helicase 2, Histone H2B type 1-N, Steroid 21-hydroxylase, UreB, Melanin-concentrating hormone receptor 1, Blood group Rh(CE) polypeptide, HLA class II histocompatibility antigen, DP beta 1 chain, Platelet glycoprotein 1b alpha chain, Muscarinic acetylcholine receptor M1, Outer capsid glycoprotein VP7, Fibronectin, HLA class I histocompatibility antigen, B-8 alpha chain, AhpC, Cytoskeleton-associated protein 5, Sucrase-isomaltase, intestinal, Leukotriene B4 receptor 2, Glutathione peroxidase 2, Collagen alpha-1(VII) chain, Nucleosome assembly protein 1-like 4, Alanine-tRNA ligase, cytoplasmic, Extracellular calcium-sensing receptor, Major centromere autoantigen B, Large tegument protein deneddylase, Blood group Rh(D) polypeptide, Kininogen-1, Peroxiredoxin-2, Ezrin, DNA replication and repair protein RecF, Keratin, type II cytoskeletal 6C, Trigger factor, Serpin B5, Heat shock protein beta-1, Protein-arginine deiminase type-4, Potassium-transporting ATPase alpha chain 1, Potassium-transporting ATPase subunit beta, Forkhead box protein E3, Condensin-2 complex subunit D3, Myotonin-protein kinase, Zinc transporter 8, ABC transporter, substrate-binding protein, putative, Aquaporin-4, Cartilage intermediate layer protein 1, HLA class II histocompatibility antigen, DR beta 5 chain, Small nuclear ribonucleoprotein F, Small nuclear ribonucleoprotein E, Ig kappa chain V-V region L7, Ig heavy chain Mem5, Ig heavy chain V-III region J606, Hemoglobin subunit delta, Collagen alpha-1 (XV) chain, 78 kDa glucose-regulated protein, 60S ribosomal protein L22, Alpha-1-acid glycoprotein 1, Malate dehydrogenase, mitochondrial, 60S ribosomal protein L8, Serine protease HTRA2, mitochondrial, 60S ribosomal protein L23a, Complement C3, Collagen alpha-1(XII) chain, Angiotensinogen, Protein S100-A9, Annexin A2, Alpha-actinin-4, HLA class II histocompatibility antigen, DQ alpha 1 chain, Apolipoprotein A-IV, Actin, aortic smooth muscle, HLA class II histocompatibility antigen, DP alpha 1 chain, Creatine kinase B-type, HLA class II histocompatibility antigen, DR beta 3 chain, Histone H1x, Heterogeneous nuclear ribonucleoprotein U-like protein 2, Basement membrane-specific heparan sulfate proteoglycan core protein, Cadherin-5, 40S ribosomal protein S13, Alpha-1-antitrypsin, Multimerin-2, Centromere protein F, 40S ribosomal protein S18, 40S ribosomal protein S25, Na(+)/H(+) exchange regulatory cofactor NHE-RF1, Actin, cytoplasmic 2, Hemoglobin subunit gamma-1, Hemoglobin subunit gamma-2, Protein NipSnap homolog 3A, Cathepsin D, 1-phosphatidylinositol 4,5-bisphosphate phosphodiesterase epsilon-1, 40S ribosomal protein S17, Apolipoprotein B-100, Histone H2B type 1-K, Collagen alpha-1(I) chain, Collagen alpha-2(I) chain, 3-hydroxyacyl-CoA dehydrogenase type-2, 60S ribosomal protein L27, Histone H1.2, Nidogen-2, Cadherin-1, 60S ribosomal protein L27a, HLA class II histocompatibility antigen, DR alpha chain, Dipeptidyl peptidase 1, Ubiquitin-40S ribosomal protein S27a, Citrate synthase, mitochondrial, Taxi-binding protein 1, Myeloperoxidase, Plexin domain-containing protein 1, Glycogen synthase, [Pyruvate dehydrogenase [acetyl-transferring]]-phosphatase 1, mitochondrial, Phorbol-12-myristate-13-acetate-induced protein 1, Peroxiredoxin-5, mitochondrial, 14-3-3 protein zeta/delta, ATP synthase subunit d, mitochondrial, Vitronectin, Lipopolysaccharide-binding protein, Ig heavy chain V-III region GAL, Protein CREG1, 60S ribosomal protein L6, Stabilin-1, Plasma protease C1 inhibitor, Ig kappa chain V-III region VG, Inter-alpha-trypsin inhibitor heavy chain H4, Alpha-1B-glycoprotein, Tartrate-resistant acid phosphatase type 5, Sulfhydryl oxidase 1, Complement component C6, Glycogen phosphorylase, muscle form, SH3 domain-binding glutamic acid-rich-like protein 3, Transforming protein RhoA, Albumin, isoform CRA_k, V-type proton ATPase subunit G 1, Flavin reductase (NADPH), Heat shock cognate 71 kDa protein, Lipoprotein lipase, Plasminogen, Annexin, Syntaxin-7, Transmembrane glycoprotein NMB, Coagulation factor XIII A chain, Apolipoprotein A-II, N-acetylglucosamine-6-sulfatase, Complement C1q subcomponent subunit B, Protein S100-A10, Microfibril-associated glycoprotein 4, 72 kDa type IV collagenase, Collagen alpha-1(XI) chain, Cathepsin B, Palmitoyl-protein thioesterase 1, Macrosialin, Histone H1.1, Histone H1.5, Fibromodulin, Thrombospondin-1, Rho GDP-dissociation inhibitor 2, Alpha-galactosidase A, Superoxide dismutase [Cu—Zn], HLA class I histocompatibility antigen, alpha chain E, Phosphatidylcholine-sterol acyltransferase, Legumain, Low affinity immunoglobulin gamma Fc region receptor II-c, Fructose-bisphosphate aldolase A, Cytochrome c oxidase subunit 8A, mitochondrial, Pyruvate kinase PKM, Endoglin, Target of Nesh-SH3, Cytochrome c oxidase subunit 5A, mitochondrial, EGF-containing fibulin-like extracellular matrix protein 2, Epididymal secretory protein E1, Cathepsin S, Annexin A5, Allograft inflammatory factor 1, Decorin, Complement C1s subcomponent, Low affinity immunoglobulin gamma Fc region receptor II-b, Leucine-rich alpha-2-glycoprotein, Lysosomal alpha-glucosidase, Disintegrin and metalloproteinase domain-containing protein 9, Transthyretin, Malate dehydrogenase, cytoplasmic, Filamin-A, Retinoic acid receptor responder protein 1, T-cell surface glycoprotein CD4, Procollagen-lysine,2-oxoglutarate 5-dioxygenase 1, Fibrinogen gamma chain, Collagen alpha-2(V) chain, Cystatin-B, Lysosomal protective protein, Granulins, Collagen alpha-1(XIV) chain, C-reactive protein, Beta-1,4-galactosyltransferase 1, Prolow-density lipoprotein receptor-related protein 1, Ig heavy chain V-III region 23, Phosphoglycerate kinase 1, Alpha-2-antiplasmin, V-set and immunoglobulin domain-containing protein 4, Probable serine carboxypeptidase CPVL, NEDD8, Ganglioside GM2 activator, Clusterin, Alpha-2-HS-glycoprotein, HLA class I histocompatibility antigen, B-37 alpha chain, Adenosine deaminase CECR1, HLA class II histocompatibility antigen, DRB1-11 beta chain, Monocyte differentiation antigen CD14, Erythrocyte band 7 integral membrane protein, Profilin-1, E3 ubiquitin-protein ligase TRIM9, Tripartite motif-containing protein 67, TNF receptor-associated factor 1, Alpha-crystallin A chain, Mitotic checkpoint serine/threonine-protein kinase BUB1, TATA-binding protein-associated factor 2N, Cyclin-F, Centromere protein C, Apoptosis regulator Bcl-2, 2-oxoisovalerate dehydrogenase subunit beta, mitochondrial, Coilin, Nucleoplasmin-3, Homeobox protein Hox-A1, Serine/threonine-protein kinase Chk1, Mitotic checkpoint protein BUB3, Deoxyribonuclease-1, rRNA 2'-O-methyltransferase fibrillarin, Histone H1.3, DNA-directed RNA polymerase Ill subunit RPC1, DNA-directed RNA polymerase Ill subunit RPC2, Centromere-associated protein E, Kinesin-like protein KIF11, Histone H4-like protein type G, Tyrosine 3-monooxygenase, ABC transporter, permease/ATP-binding protein, Translation initiation factor IF-1, Protein FAN, Reticulon-4 receptor, Myeloid cell nuclear differentiation antigen, Glucose-6-phosphate isomerase, High affinity immunoglobulin gamma Fc receptor I, Tryptophan 5-hydroxylase 1, Tryptophan 5-hydroxylase 2, Secretory phospholipase A2 receptor, Aquaporin TIP4-1, Histone H2B type F-S, Histone H2AX, Histone H2A type 1-C, ATP-sensitive inward rectifier potassium channel 10, pVII, hypothetical protein TTV27_gp4, hypothetical protein TTV25_gp2, Alpha-1D adrenergic receptor, Alpha-1B adrenergic receptor, Packaging protein 3, hypothetical protein TTV14_gp2, KRR1 small subunit processome component homolog, Bestrophin-4, Alpha-2C adrenergic receptor, Uncharacterized ORF3 protein, Retinoic acid receptor beta, Retinoic acid receptor alpha, B-cell lymphoma 3 protein, Carbohydrate sulfotransferase 8, Harmonin, Prolactin-releasing peptide receptor, Sphingosine 1-phosphate receptor 1, Acyl-CoA-binding domain-containing protein 5, ORF1, hypothetical protein TTMV3_gp2, Mitochondrial import inner membrane translocase subunit Tim17-B, hypothetical protein TTV2_gp2, Absent in melanoma 1 protein, hypothetical protein TTV28_gp1, hypothetical protein TTV26_gp2, hypothetical protein TTV4_gp2, hypothetical protein TTV28_gp4, Mesencephalic astrocyte-derived neurotrophic factor, hypothetical protein TTMV7_gp2, hypothetical protein TTV19_gp2, pORF1, Pre-histone-like nucleoprotein, hypothetical protein TTV8_gp4, hypothetical protein TTV16_gp2, hypothetical protein TTV15_gp2, ORF2/4 protein, P2X purinoceptor 2, membrane glycoprotein E3 CR1-beta, D(2) dopamine receptor, Toll-like receptor 9, Phosphatidylcholine transfer protein, Transcription factor HIVEP2, Probable peptidylarginine deiminase, 60S ribosomal protein L9, Integrin beta-4, Keratin, type II cytoskeletal 1, Chromogranin-A, Histone H3.1t, Voltage-dependent L-type calcium channel subunit alpha-1D, Heat shock 70 kDa protein 1-like, ABC transporter related, UDP-N-acetylglucosamine pyrophosphorylase, Protein GREB1, Aldo/keto reductase, Component of the TOM (Translocase of outer membrane) complex, Excinuclease ABC C subunit domain protein, Phosphoenolpyruvate carboxylase, Arylacetamide deacetylase-like 4, Dynein heavy chain 10, axonemal, Putative Uracil-DNA glycosylase, Spore germination protein PE, Teneurin-1, Putative dehydrogenase, Polysaccharide biosynthesis protein, VCBS, Glutamate/aspartate transport system permease protein GltK, Noggin, Sclerostin, HLA class I histocompatibility antigen, A-30 alpha chain, HLA class I histocompatibility antigen, A-69 alpha chain, HLA class I histocompatibility antigen, B-15 alpha chain, Glutamate receptor ionotropic, NMDA 1, NarH, 40S ribosomal protein S21, Ceruloplasmin, 3-hydroxy-3-methylglutaryl-coenzyme A reductase, 60S ribosomal protein L30, HLA class II histocompatibility antigen gamma chain, HLA class I histocompatibility antigen, Cw-6 alpha chain, HLA class I histocompatibility antigen, Cw-16 alpha chain, Lysosomal alpha-mannosidase, Heat shock protein HSP 90-alpha, Histone H3.2, Histone H2A.J, Voltage-dependent T-type calcium channel subunit alpha-1G, Syncytin-1, Cathelicidin antimicrobial peptide, Tubulin beta-3 chain, Stress-70 protein, mitochondrial, Probable 1,4-alpha-glucan branching enzyme Rv3031, Nuclease-sensitive element-binding protein 1, Complement factor H-related protein 1, Glutaredoxin-1, Gamma-enolase, Platelet-derived growth factor receptor alpha, Collagen alpha-1(VIII) chain, Matrix metalloproteinase-25, Interferon regulatory factor 5, Cytochrome c oxidase subunit 7C, mitochondrial, Heat shock-related 70 kDa protein 2, Cysteine-rich protein 1, NADH dehydrogenase [ubiquinone] flavoprotein 2, mitochondrial, Glutathione S-transferase P, HLA class I histocompatibility antigen, A-68 alpha chain, HLA class II histocompatibility antigen, DM beta chain, Fructose-bisphosphate aldolase C, Beta-2-microglobulin, Cytochrome c oxidase subunit 5B, mitochondrial, Heat shock 70 kDa protein 13, ATP synthase protein 8, 60S ribosomal protein L13a, TRNA nucleotidyltransferase family enzyme, Ferredoxin-dependent glutamate synthase 2, Alkaline phosphatase, tissue-nonspecific isozyme, SLAM family member 5, Slit homolog 3 protein, Transforming growth factor-beta-induced protein ig-h3, Mannose-binding protein C, Calpain-1 catalytic subunit, Actin, gamma-enteric smooth muscle, Creatine kinase M-type, Protein THEM6, Histone-lysine N-methyltransferase ASH1 L, C2 calcium-dependent domain-containing protein 4A, Ras association domain-containing protein 10, Hepatocyte cell adhesion molecule, ADAMTS-like protein 5, HLA class II histocompatibility antigen, DRB1-15 beta chain, Anoctamin-2, Phosphoglycerate mutase 1, Por secretion system protein porV (Pg27, IptO), Beta-enolase, Receptor antigen A, 3-oxoacyl-[acyl-carrier-protein] synthase 2, Putative heat shock protein HSP 90-beta 2, Radixin, Tubulin beta-1 chain, Vacuolar protein sorting-associated protein 26A, Serine/threonine-protein phosphatase 5, Catalase, Transketolase, Protein S100-A1, Alpha-centractin, Tubulin beta-4A chain, Beta-centractin, Probable phosphoglycerate mutase 4, Beta-actin-like protein 2, Tubulin beta-4B chain, Phosphoglycerate mutase 2, Alpha-internexin, Tubulin beta-2A chain, Dihydropyrimidinase-related protein 3, Putative heat shock protein HSP 90-beta-3, Fructose-bisphosphate aldolase B, Protein P, Endoplasmin, ATP synthase subunit O, mitochondrial, Heat shock 70 kDa protein 6, Glyceraldehyde-3-phosphate dehydrogenase, testis-specific, Nascent polypeptide-associated complex subunit alpha-2, Carbonic anhydrase 2, Annexin A6, E3 ubiquitin-protein ligase RNF13, Myeloid-derived growth factor, Tyrosine-protein phosphatase non-receptor type substrate 1, Laminin subunit gamma-1, Trichohyalin, Thrombospondin-2, Sialoadhesin, GTPase IMAP family member 1, C4b-binding protein alpha chain, Voltage-dependent anion-selective channel protein 1, Hemopexin, Complement C5, FYVE, RhoGEF and PH domain-containing protein 2, Haptoglobin, Cytochrome P450 1B1, Titin, Myeloma-overexpressed gene 2 protein, Adipocyte enhancer-binding protein 1, Protein-glutamine gamma-glutamyltransferase 2, Protein Trim21, ADAMTS-like protein 3, N-alpha-acetyltransferase 16, NatA auxiliary subunit, Transforming growth factor beta-1, Elastin, Protein disulfide-isomerase A5, Plastin-2, Leukocyte immunoglobulin-like receptor subfamily B member 1, Histamine H2 receptor, Elongation factor 2, Caveolin-1, Ig gamma-2 chain C region, Immunoglobulin superfamily containing leucine-rich repeat protein, 40S ribosomal protein S9, Prolyl 4-hydroxylase subunit alpha-1, Endoplasmic reticulum-Golgi intermediate compartment protein 1, Tetranectin, Serine protease HTRA1, Heterogeneous nuclear ribonucleoprotein A1, Phosducin-like protein 3, Ig lambda chain V-VI region EB4, Fibronectin type III domain-containing protein 1, Keratin, type II cytoskeletal 2 epidermal, Ferritin heavy chain, Y-box-binding protein 3, Complement C4-B, HLA class I histocompatibility antigen, Cw-15 alpha chain, HLA class I histocompatibility antigen, B-42 alpha chain, Collagen alpha-1(V) chain, HLA class I histocompatibility antigen, B-73 alpha chain, Integral membrane protein 2B, Lysosome-associated membrane glycoprotein 3, Proteoglycan 4, Ribosomal protein S6 kinase alpha-6, Metalloproteinase inhibitor 2, HLA class II histocompatibility antigen, DRB1-12 beta chain, ATP-sensitive inward rectifier potassium channel 15, Vitamin D-binding protein, Osteopontin, Deoxynucleotidyltransferase terminal-interacting protein 2, Olfactory receptor 5K4, Myosin light chain kinase 2, skeletal/cardiac muscle, Non-POU domain-containing octamer-binding protein, Ubiquilin-2, HLA class I histocompatibility antigen, B-51 alpha chain, Minor histocompatibility antigen H13, Glycophorin-C, Eosinophil cationic protein, SWI/SNF complex subunit SMARCC2, Macrophage mannose receptor 1, tRNA-splicing ligase RtcB homolog, Reticulocalbin-2, Heterogeneous nuclear ribonucleoprotein L, 40S ribosomal protein S30, Collagen alpha-3(VI) chain, Matrix metalloproteinase-14, Antithrombin-III, 60S ribosomal protein L10a, Retinol-binding protein 4, Heterogeneous nuclear ribonucleoprotein R, Lithostathine-1-alpha, Ret finger protein-like 2, Zinc-alpha-2-glycoprotein, Carboxypeptidase Q, HLA class I histocompatibility antigen, B-56 alpha chain, Chondroadherin, Cysteine-rich protein 2, Prosaposin, Complement component C9, Apolipoprotein C-III, Protocadherin-16, Leukocyte immunoglobulin-like receptor subfamily B member 4, Galactokinase, Complement factor H, Uncharacterized protein YEL014C, Glycerophosphocholine phosphodiesterase GPCPD1, Echinoderm microtubule-associated protein-like 6, or a fragment, variant or derivative of any one of said autoantigens, or any combination thereof.

Allergens

According to further preferred embodiments, the artificial nuclei acid molecule, preferably RNA, according to the invention encodes, in its at least one coding region, at least one antigenic peptide or protein derived from an allergen. An “allergen” is any substance, in particular a protein or peptide, which induces allergy, an abnormal immune reaction of the body to a (previously encountered) foreign substance typically introduced by inhalation, ingestion, injection, or skin contact.

Preferably, the at least one antigenic peptide or protein encoded by the at least one coding region of the artificial nucleic acid molecule, preferably RNA, of the invention, may be derived from an allergen derived or selected from Allergen Pen n 18, Antigen Name, Ara h 2.01 allergen, Melanoma antigen recognized by T-cells 1, Non-specific lipid-transfer protein precursor (LTP) (Allergen Mal d 3), ovalbumin, Parvalbumin beta, Pollen allergen Lol p VA precursor, Pollen allergen Phl p 5b precursor, pru p 1, Pollen allergen Phl p 5a, Der p 1 allergen precursor, Pollen allergen KBG 60 precursor, major allergen Tur c1—Turbo cornutus, Mite group 2 allergen Lep d 2 precursor, Lep D 2 precursor, Major latex allergen Hev b 5, major allergen Cor a 1.0401, Major pollen allergen Art v 1 precursor, Major pollen allergen Bet v 1-A, Beta-lactoglobulin precursor, Alpha-amylase inhibitor 0.28 precursor (CIII) (WMAI-1), group V allergen Phl p 5.0203 precursor, Polygalacturonase precursor, pollen allergen Phl pl, Der f 2 allergen, Probable non-specific lipid-transfer protein 2 precursor, Venom allergen 5 precursor, Pollen allergen Phl p 1 precursor, group V allergen, Chain A, Crystal Structure Of The Calcium-Binding Pollen Allergen Phl P 7 (Polcalcin) At 1.75 Angstroem, Tri r 2 allergen, Pathogenesis-related protein precursor, Globin CTT-III precursor, Major allergen Alt a 1, 13S globulin seed storage protein 3 precursor (Legumin-like protein 3) (Allergen Fag e 1), Lit v 1 tropomyosin, Rubber elongation factor protein, Ovomucoid precursor, Small rubber particle protein, Mag3, Allergen Ara h 1, clone P41B precursor, 13S globulin seed storage protein 1 precursor (Legumin-like protein 1), Pollen allergen Lol p 1 precursor, Major pollen allergen Jun a 1 precursor, Sugi basic protein precursor, profilin, Globin CTT-IV precursor, alkaline serine protease, Glycinin, Conglutin-7 precursor, 2S protein 1, Globin CTT-VI precursor, Ribonuclease mitogillin precursor, Major pollen allergen Cyn d 1, Melanocyte-stimulating hormone receptor, P34 probable thiol protease precursor, Vicilin-like protein, Major allergen Equ c 1 precursor, major allergen Bet v 1, Major allergen Can f 1 precursor, Bd 30K (34 kDa maturing seed protein), Major pollen allergen, Major pollen allergen Hol l 1 precursor, Kappa-casein precursor, major allergen Dau c 1/1, Stress-induced protein SAM22, Major allergen Api g 1, Glycinin G2 precursor, allergen Arah3/Arah4, Der f 1 allergen, Peptidase 1 precursor (Mite group 1 allergen Eur m 1) (Allergen Eur m I), Oryzin precursor, alpha S1 casein, Major pollen allergen Cha o 1 precursor, Non-specific lipid-transfer protein 1, collagen, type I, alpha 2, Der P 1, Peptidase 1 precursor (Major mite fecal allergen Der p 1) (Allergen Der p I), pollen allergen Bet v 1, Phospholipase A2 precursor, Mite group 2 allergen Der p 2, Allergen Mag, Major urinary protein precursor, Major allergen I polypeptide chain 2 precursor, Pen a 1 allergen, Fag e 1, Serum albumin precursor, Pollen allergen Amb a 3, putative alpha-amylase inhibitor 0.28, Albumin seed storage protein, 2S sulfur-rich seed storage protein precursor (Allergen Ber e 1), seed storage protein SSP2, Pro-hevein precursor, pollen allergen, Der p 2 allergen precursor, 2S seed storage protein 1 precursor, prohevein, 2s albumin, major allergen I, polypeptide chain 1, Major allergen I polypeptide chain 1 precursor, Cry j IB precursor, Mite group 2 allergen Der f 2 precursor, beta-casein precursor, Lep D 2 allergen precursor, Allergen Cry j 2 (Pollen allergen), KIAA1224 protein, Hydrophobic seed protein, Allergen Bos d 2 precursor, Allergen II, Mite group 2 allergen Der p 2 precursor, Mite allergen Blo t 5, Peptidase 1 precursor (Major mite fecal allergen Der f 1) (Allergen Der f I), Par j, Can f I, Pollen allergen Lol p 2-A (Lol p II-A), Paramyosin, Alpha-S2-casein precursor, P34 probable thiol protease, beta-lactoglobulin, major allergen Phl p 5, Chain A, Structure Of Erythrocruorin In Different Ligand States Refined At 1.4 Angstroms Resolution, Globin CTT-VIII, Major allergen Asp f 2 precursor, tropomyosin, core protein [Hepatitis B virus], Omega gliadin storage protein, Alpha/beta-gliadin A-V, group 14 allergen protein, Pollen allergen Amb a 1.1 precursor, Glycinin G1 precursor, Pollen allergen Amb a 2 precursor, Cry j 1 precursor, allergen Ziz m 1, Glycine-rich cell wall structural protein 1.8 precursor, Putative pectate lyase 17 precursor, pectate lyase, Pectate lyase precursor, Probable pectate lyase 18 precursor, major allergen beta-lactoglobulin, Major allergen Mal d 1, Alpha-S1-casein precursor, 2S seed storage protein 1, plectrovirus spv1-r8a2b orf 14 transmembrane protein, allergen I/a, Allergen Cr-PI, Probable non-specific lipid-transfer protein 1, Cr-PII allergen, melanoma antigen gp100, Alpha-lactalbumin precursor, Chain A, Anomalous Substructure Of Alpha-Lactalbumin, Pilosulin-1 precursor (Major allergen Myr p 1) (Myr p I), Pollen allergen Lol p 3 (Lol p III), Lipocalin 1 (tear prealbumin), Major pollen allergen Cup a 1, Melanocyte protein Pmel 17 precursor, major house dust allergen, Non-specific lipid-transfer protein 1 (LTP 1) (Major allergen Pru d 3), Non-specific lipid-transfer protein 1 (LTP 1) (Major allergen Pru ar 3), Pollen allergen Lol p 1, alpha-gliadin, Cr-PII, albumin, Alpha-S1-casein, major allergen I, Ribonuclease mitogillin, beta-casein, UA3-recognized allergen, 2S sulfur-rich seed storage protein 1, unnamed protein product, Polygalacturonase, Major allergen Pru av 1, Der p 1 allergen, lyase allergen, Major pollen allergen Bet v 1-F/I, Gamma-gliadin precursor, 5-hydroxytryptamine receptor 2C (5-HT-2C) (Serotonin receptor 2C) (5-HT2C) (5-HTR2C) (5HT-1C), omega-5 gliadin, Enolase 1 (2-phosphoglycerate dehydratase) (2-phospho-D-glycerate hydro-lyase), Probable non-specific lipid-transfer protein, Allergen Sin a 1, Glutenin, low molecular weight subunit precursor, Major Peanut Allergen Ara H 1, mal d 3, Eukaryotic translation initiation factor 3 subunit D, tyrosinase-related protein-2, PC4 and SFRS1-interacting protein, RAD51-like 1 isoform 1, Antimicrobial peptide 2, Proteasome subunit alpha type-3, Neurofilament heavy polypeptide (NF-H) (Neurofilament triplet H protein) (200 kDa neurofilament protein), Superoxide dismutase, Major pollen allergen Cor a 1 isoforms 5, 6, 11 and 16, cherry-allergen PRUA1, Allergen Asp f 4 precursor, Chain A, Tertiary Structure Of The Major House Dust Mite Allergen Der P 2, Nmr, 10 Structures, RNA-binding protein NOB1, Dermatan-sulfate epimerase precursor, Squamous cell carcinoma antigen recognized by T-cells 3, Peptidyl-prolyl cis-trans isomerase B precursor, Probable glycosidase crf1, Chain A, Birch Pollen Profilin, Profilin-1, avenin precursor (clone pAv122)—oat, gamma 3 avenin, coeliac immunoreactive protein 2, CIP-2, prolamin 2 {N-terminal}, avenin gamma-3-small naked oat (fragment), major pollen allergen Ole e 1, Cytochrome P450 3A1, Ole e 1 protein, Ole e 1.0102 protein, Der f 2, GroEL-like chaperonin, major allergen Arahi, manganese superoxide dismutase, beta-1,3-glucanase-like protein, Ara h 1 allergen, Major allergen Alt a 1 precursor, Bla g 4 allergen, Per a 4 allergen variant 1, Lyc e 2.0101, pectate lyase 2, allergen, hypothetical protein, Probable pectate lyase P59, Pollen allergen Amb a 1.4, Patatin-2-Kuras 1, calcium-binding protein, vicilin seed storage protein, major allergenic protein Mal f4, pel protein, ripening-related pectate lyase, pectate lyase/Amb allergen, Bet v 4, Polcalcin Bet v 4, Mite allergen Der f 6, Allergen Alt a 2, Extracellular elastinolytic metalloproteinase, pectate lyase-like protein, Pectate lyase E, Profilin-2, Venom allergen 5, Cucumisin, Putative peroxiredoxin, putative pectate lyase precursor, Serum albumin, pollen allergen Phl p 11, serine (or cysteine) proteinase inhibitor, clade B (ovalbumin), member 3, Allergen Bla g 4 precursor (Bla g IV), Allergen Pen n 13, Hyaluronidase A, pectate lyase homolog, putative allergen Cup a 1, Major pollen allergen Jun v 1, putative allergen jun o 1, Pollen allergen Amb a 1.2, Probable pectate lyase 13, P8 protein, Cytochrome c, Glucan endo-1,3-beta-glucosidase, basic vacuolar isoform, 13S globulin, beta-1,3-glucanase, beta-1,3-glucananse, Glutenin, high molecular weight subunit DX5 precursor, X-type HMW glutenin, Glutenin, high molecular weight subunit DX5, high-molecular-weight glutenin subunit 1 Dx2.1, high molecular weight glutenin subunit, 11S globulin-like protein, seed storage protein, alpha-L-Fucp-(1→3)-[alpha-D-Manp-(1→6)-[beta-D-Xylp-(1→2)]-beta-D-Manp-(1→4)-beta-D-GlcpNAc-(1→4)]-D-GlcpNAc, beta casein B, type 1 non-specific lipid transfer protein precursor, Fas AMA, Caspase-8 precursor, H antigen glycoprotein, H antigen gl, Heat shock protein HSP 90-beta, dihydrolipoamide S-acetyltransferase (E2 component of pyruvate dehydrogenase complex), isoform CRA_a, Group V allergen Phl p 5.0103 precursor, Phl p6 allergen precursor, Group V allergen Phl p 5, Major pollen allergen Phl p 4 precursor, Pollen allergen Phl p V, Phl p 3 allergen, Pollen allergen Phl pl precursor, Chain A, Crystal Structure Of Phl P 1, A Major Timothy Grass Pollen Allergen, Pollen allergen Phl p 4, Profilin-3, Profilin-2/4, Pollen allergen Phl p 2, Phl p6 IgE binding fragment, Phlp5, Chain N, Crystal Structure Of Phl P 6, A Major Timothy Grass Pollen Allergen Co-Crystallized With Zinc, group V allergen Phl p 5.0206 precursor, allergenic protein, Major allergen Ani s 1, allergen Ana o 2, ENSP-like protein, BW 16 kDa allergen, alpha2(1) collagen, collagen a2(I), type 1 collagen alpha 2, Cyn d 1, Major pollen allergen Aln g 1 (Allergen Aln g I), allergen Len c 1.0101, galactomannan, Aspartic protease Bla g 2, alcohol dehydrogenase, lipid transfer protein precursor, alpha/beta gliadin precursor, Der f 7 allergen, Der p 7 allergen polypeptide, non-specific lipid transfer protein, Major allergen I polypeptide chain 1, prunin 1 precursor, prunin 2 precursor, 11S legumin protein, Ara h 7 allergen precursor, vicilin-like protein precursor, allergen Arah6, parvalbumin like 2, parvalbumin like 1, casein kappa, Ribosomal biogenesis protein LAS1 L, Pen c 1, SchS21 protein, Inactive hyaluronidase B, Mup1 protein, Macrophage migration inhibitory factor, Eukaryotic translation initiation factor 2 subunit 3, CR2/CD21/C3d/Epstein-Barr virus receptor precursor, DNA topoisomerase 2-alpha, pollen allergen Cyn d 23, major allergen Bla g 1.02, pectin methylesterase allergenic protein, major allergen Pha a 5 isoform, 2S albumin seed storage protein, aldehyde dehydrogenase (NAD+), pollen allergen Poa p 5, Bla g 1.02 variant allergen, partial, Major pollen allergen Lol p 5b, allergen Bla g 6.0301, protein disulfide isomerase, putative mannitol dehydrogenase, pollen allergen Lol p 4, Aspartic protease pep1, enolase, IgE-binding protein, Minor allergen Alt a 5, HDM allergen, Chain A, Crystal Structure Of An Mbp-Der P 7 Fusion Protein, allergen Bla g 6.0201, major allergen Bla g 1.0101, alpha-amylase, minor allergen, ribosomal protein P2, metalloprotease (MEP), autophagic serine protease Alp2, allergenic isoflavone reductase-like protein Bet v 6.0102, Chain A, Crystal Structure Of The Complex Of Antibody And The Allergen Bla G 2, minor allergen, thioredoxin TrxA, enolase, allergen Cla h 6, glutathione-S-transferase, molecular chaperone and allergen Mod-E/Hsp90/Hspl, major allergen Asp F2, Mite allergen Der p 3, Chain B, Crystal Structure Of *Aspergillus Fumigatus* Mnsod, Glutathione S-transferase (GST class-sigma) (Major allergen Bla g 5), Minor allergen Cla h 7, unknown protein, allergenic cerato-platanin Asp F13, art v 2 allergen, Polcalcin Aln g 4, major allergen and cytotoxin AspF1, pollen allergen Que a 1 isoform, trypsin-like serine protease, Mite group 6 allergen Der p 6, allergen Asp F7, cell wall protein PhiA, 60 kDa allergen Der f 18p, hsp70, Sal k 3 pollen allergen, acidic ribosomal protein P2, Chain B, Crystal Structure Of The Nadp-Dependent Mannitol Dehydrogenase From *Cladosporium Herbarum*., Art v 3.0301 allergen precursor, 60S ribosomal protein L3, Der p 20 allergen, Pollen allergen Sal k 1, Per a 6 allergen, gelsolin-like allergen Der f 16, Chain A, Structural Characterization Of The Tetrameric Form Of The Major Cat Allergen Fel D 1, Glutathione S-transferase, Fel d 4 allergen, Major pollen allergen Dac g 4, Group I allergen Ant o I (Form 1), pollen, allergen Bla g 6.0101, cystatin, Mite allergen Der p 5, allergen Fra e 1, allergen Asp F4, major antigen-like protein, PR5 allergen Cup s 3.1 precursor, heat shock protein, allergene precursor, arginine esterase precursor, Sal k 4 pollen allergen, 60S acidic ribosomal protein P1, pollen allergen Jun o 4, Polcalcin Cyn d 7, group I pollen allergen, peptidyl-prolyl cis-trans isomerase/cyclophilin, putative, profilin 2, pollen allergen Cyn d 15, Der f 13 allergen, Can f 2, peroxisomal-like protein, peptidylprolyl isomerase (cyclophilin), MHC class II antigen, BETV4 protein, Major pollen allergen Pla I 1, peptidase, MPA3 allergen, plantain pollen major allergen, Pla I 1.0103, major allergen Bla g 1.0101, partial, Pollen allergen Amb p 5a, Der f 16 allergen, Pollen allergen Dac g 2, IgE-binding protein C-terminal fragment (148 AA), Pollen allergen Dac g 3, PPlase, rAsp f 9, Mite allergen Der p 7, thioredoxin, hydrolase, Major pollen allergen Pha a 1, Der p 13 allergen, Chain B, X-Ray Structure Of Der P 2, The Major House Dust Mite Allergen, oleosin 3, Peptidyl-prolyl cis-trans isomerase, Chain A, Crystal Structure Of A Major House Dust Mite Allergen, Derf 2, Chain A, Crystal Structure Of Major Allergens, Bla G 4 From Cockroaches, Amb a 1-like protein, D-type LMW glutenin subunit, Glutathione S-transferase 2, acidic Cyn d 1 isoallergen isoform 4 precursor, albumin seed storage protein precursor, tyrosine 3-monooxygenase isoform b, N-glycoprotein, FAD-linked oxidoreductase BG60, Blot 21 allergen, Ubiquitin D, Nucleoporin Nup37, Non-POU domain-containing octamer-binding protein, Transcription elongation factor SPT5, Major allergen Mal d 1 (Yprl0 protein), Serpin-Z2B, Pas n 1 allergen precursor, arginine kinase, Lit v 3 allergen myosin light chain, sarcoplasmic calcium-binding protein, alpha subunit of beta conglycinin, prunin, allergen Cry j 2, Plexin-A4, Non-specific lipid-transfer protein, Low molecular weight glutenin subunit precursor, gamma-gliadin, friend of GATA-1, Wilms tumor protein, Ubiquitin-conjugating enzyme E2 C, Fatty acid synthase, Histone H4, Fructose-bisphosphate aldolase A, oxidoreductase, lactoglobulin beta, immunoglobulin gamma 3 heavy chain constant region, Phlp5 precursor, dust mite allergen precursor, heat shock protein 70, Major allergen I polypeptide chain 2, alpha-lactalbumin precursor protein, 30 kDa pollen allergen, group 5 allergen precursor, group 1 allergen Dac g 1.01 precursor, uncharacterized protein, unknown Timothy grass protein, kappa-casein, alpha-S1 casein, SXP/RAL-2 family protein, Lipocalin-1 precursor, alpha purothionin, major allergen Bet v 1.01A, P2 protein, Osmotin, Major Peanut Allergen Ara H 2, Der f 3 allergen, Conglutin, Ara h 6 allergen, Cathelicidin antimicrobial peptide, cholinesterase, Per a 2 allergen, Submaxillary gland androgen-regulated protein 3B, chitinase, partial, allergen Can f 4 precursor, Can f 4 variant allergen precursor, nascent polypeptide-associated complex subunit alpha-2, Polcalcin Phl p 7 (Calcium-binding pollen allergen Phl p 7) (P7), Der p II allergen, main allergen Ara hi, allergen Ara h 2.02, fatty acid binding protein, glutamate receptor, glycinin A3B4 subunit, profilin isoallergen 2, Pollen allergen Amb p 5b, calcium-binding protein isoallergen 2, calcium-binding protein isoallergen 1, cysteine protease, profilin isoallergen 1, ragweed homologue of Art v 1 precursor, Amb p 5, ragweed homologue of Art v 1 (isoform 1), partial, antigen E, putative pectate lyase precursor, partial, Pollen allergen Amb a 5, Amb p V allergen, hemocyanin subunit 6, major pollen allergen Cha o 2, trichohyalin, aspartyl endopeptidase, NCRA10, allergen bla g 8, vitellogenin, NCRA3, NCRA4, allergen Bla g 3 isoform 2 precursor, partial, NCRA2, NCRA13, NCRA8, NCRA1, Bla g 11, receptor for activated protein kinase C-like, NCRA5, NCRA14, triosephosphate isomerase, NCRA12, NCRA7, NCRA11, trypsin, triosephosphate isomerase, partial, NCRA6, structural protein, NCRA15, NCRA9, NCRA16, Der f 4 allergen, Der f 5 allergen, Phl p6 allergen, Der f Gal d 2 allergen, Derp_19830, glucosylceramidase, carboxypeptidase, Der f 8 allergen, partial, fructose bisphosphate aldolase, ATP synthase, Der f Alt a 10 allergen, glutamine synthetase, Derp_c23425, myosin, Der f 8 allergen, LytFM, Der f 11 allergen, serine protease, glutathione transferase mu, triose-phosphate isomerase, ubiquinol-cytochrome c reductase binding protein-like protein, ferritin, isomerase, filamin C, Der p 5, Mag44, partial, venom, muscle specific protein, Der f 5.02 allergen, Mag44, Derp_c21462, group 18 allergen protein, Derf_c9409, napin-type 2S albumin 1 precursor, napin-type 2S albumin 3, isoflavone reductase-like protein CJP-6, Pectate lyase 1, allergen Cry j 2, partial, Major allergen Dau c 1, Filamin-C, putative, Pis v 5.0101 allergen 11S globulin precusor, Pis v 5, 48-kDa glycoprotein precursor, vicilin, or a variant, fragment or derivative of any of said allergens, or any combination thereof.

Signal Peptide (SIG)

According to preferred embodiments, the artificial nucleic acid molecule, preferably RNA, of the invention further encodes, in its at least one coding region, at least one signal peptide.

A "signal peptide" (sometimes referred to as signal sequence, targeting signal, localization signal, localization sequence, transit peptide, leader sequence or leader peptide) is typically a short (5-30 amino acids long) N-terminal peptide.

According to preferred embodiments, the nucleic acid sequence encoding said at least one signal peptide may be fused (in frame) to a nucleic acid sequence encoding the at least one $IRST_{epm}$-derived amino acid sequence or the at least one antigenic peptide or protein. Therefore, expression of the artificial nucleic acid molecule, preferably RNA, of the invention may preferably result in a fusion protein comprising the at least one signal peptide joined to (optionally via appropriate peptide linkers) said $IRST_{epm}$-derived amino acid sequence and/or said antigenic protein or peptide. Said additional amino acid sequence preferably directs the antigenic peptide or protein to the plasma membrane, where antigenic peptides or proteins are preferably anchored via the TM domain and recycled to MHC class I and more preferably MHC class II processing compartments, resulting in both enhanced MHC class I and preferably MHC class II presentation. The signal peptide is envisaged to preferably mediate or support the transport of the antigenic construct (in) to a defined cellular compartment, in particular the external side of the plasma membrane.

Generally, the present invention envisages the combination of any of the signal peptides described herein with any of the antigenic peptides or proteins, any of the $IRST_{epm}$-derived additional amino acid sequences, any of the linkers, in any suitable order, in the antigenic fusion proteins encoded by the artificial nucleic acid molecules, preferably RNAs, of the invention.

According to preferred embodiments, the artificial nucleic acid molecule, preferably RNA, of the invention may encode in its at least one coding region at least one signal peptide selected from the signal peptides indicated in Table 4 below, or a (preferably functional) fragment, variant or derivative of any of said signal peptides.

TABLE 4

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 76 | P14207 | FOLR2 | Folate receptor beta (FR-beta) (Folate receptor 2) (Folate receptor, fetal/placental) (Placental folate-binding protein) (FBP) | 1-16 | 1 | 255 | FOLR2 | 209, 417, 625, 833, 1041, 1249, 1457, 1665, 1873, 2081, 2289, 2497, 2705 |
| 77 | O75787 | RENR | Renin receptor (ATPase H(+)-transporting lysosomal accessory protein 2) (ATPase H(+)-transporting lysosomal-interacting protein 2) (ER-localized type I transmembrane adaptor) (Embryonic liver differentiation factor 10) (N14F) (Renin/prorenin receptor) (Vacuolar ATP synthase membrane sector-associated protein M8-9) (ATP6M8-9) (V-ATPase M8.9 subunit) | 1-16 | 2 | 350 | ATP6AP2 ATP6IP2 CAPER ELDF10 HT028 MSTP009 PSEC0072 | 210, 418, 626, 834, 1042, 1250, 1458, 1666, 1874, 2082, 2290, 2498, 2706 |
| 78 | P07359 | GP1BA | Platelet glycoprotein lb alpha chain (GP-lb alpha) (GPlb-alpha) (GPlbA) (Glycoprotein lbalpha) (Antigen CD42b-alpha) (CD antigen CD42b) [Cleaved into: Glycocalicin] | 1-16 | 3 | 652 | GP1BA | 211, 419, 627, 835, 1043, 1251, 1459, 1667, 1875, 2083, 2291, 2499, 2707 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 79 | P08637 | FCG3A | Low affinity immunoglobulin gamma Fc region receptor III-A (CD16a antigen) (Fc-gamma RIII-alpha) (Fc-gamma RIII) (Fc-gamma RIIIa) (FcRIII) (FcRIIIa) (FcR-10) (IgG Fc receptor III-2) (CD antigen CD16a) | 1-16 | 4 | 254 | FCGR3A CD16A FCG3 FCGR3 IGFR3 | 212, 420, 628, 836, 1044, 1252, 1460, 1668, 1876, 2084, 2292, 2500, 2708 |
| 8081 | P07237 | PDIA1 | Protein disulfide-isomerase (PDI) (EC 5.3.4.1) (Cellular thyroid hormone-binding protein) (Prolyl 4-hydroxylase subunit beta) (p55) | 1-17 | 5 | 508 | P4HB ERBA2L PDI PDIA1 PO4DB | 213, 421, 629, 837, 1045, 1253, 1461, 1669, 1877, 2085, 2293, 2501, 2709 |
| 82 | O60911 | CATL2 | Cathepsin L2 (EC 3.4.22.43) (Cathepsin U) (Cathepsin V) | 1-17 | 6 | 334 | CTSV CATL2 CTSL2 CTSU UNQ268/PRO305 | 214, 422, 630, 838, 1046, 1254, 1462, 1670, 1878, 2086, 2294, 2502, 2710 |
| 83 | P20138 | CD33 | Myeloid cell surface antigen CD33 (Sialic acid-binding Ig-like lectin 3) (Siglec-3) (gp67) (CD antigen CD33) | 1-17 | 7 | 364 | CD33 SIGLEC3 | 215, 423, 631, 839, 1047, 1255, 1463, 1671, 1879, 2087, 2295, 2503, 2711 |
| 8485 | P27797 | CALR | Calreticulin (CRP55) (Calregulin) (Endoplasmic reticulum resident protein 60) (ERp60) (HACBP) (grp60) | 1-17 | 8 | 417 | CALR CRTC | 216, 424, 632, 840, 1048, 1256, 1464, 1672, 1880, 2088, 2296, 2504, 2712 |
| 86 | P10747 | CD28 | T-cell-specific surface glycoprotein CD28 (TP44) (CD antigen CD28) | 1-18 | 9 | 220 | CD28 | 217, 425, 633, 841, 1049, 1257, 1465, 1673, 1881, 2089, 2297, 2505, 2713 |
| 87 | O75487 | GPC4 | Glypican-4 (K-glypican) [Cleaved into: Secreted glypican-4] | 1-18 | 10 | 556 | GPC4 UNQ474/PRO937 | 218, 426, 634, 842, 1050, 1258, 1466, 1674, 1882, 20920, 2298, 2506, 2714 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 8889 | P07996 | TSP1 | Thrombospondin-1 | 1-18 | 11 | 1170 | THBS1 TSP TSP1 | 219, 427, 635, 843, 1051, 1259, 1467, 1675, 1883, 2091, 2299, 2507, 2715 |
| 90 | P22748 | CAH4 | Carbonic anhydrase 4 (EC 4.2.1.1) (Carbonate dehydratase IV) (Carbonic anhydrase IV) (CA-IV) | 1-18 | 12 | 312 | CA4 | 220, 428, 636, 844, 1052, 1260, 1468, 1676, 1884, 2092, 2300, 2508, 2716 |
| 91 | Q15762 | CD226 | CD226 antigen (DNAX accessory molecule 1) (DNAM-1) (CD antigen CD226) | 1-18 | 13 | 336 | CD226 DNAM1 | 221, 429, 637, 845, 1053, 1261, 1469, 1677, 1885, 2093, 2301, 2509, 2717 |
| 9293 | P30273 | FCERG | High affinity immunoglobulin epsilon receptor subunit gamma (Fc receptor gamma-chain) (FcRgamma) (Fc-epsilon RI-gamma) (IgE Fc receptor subunit gamma) (FceRI gamma) | 1-18 | 14 | 86 | FCER1G | 222, 430, 638, 846, 1054, 1262, 1470, 1678, 1886, 2094, 2302, 2510, 2718 |
| 94 | P38570 | ITAE | Integrin alpha-E (HML-1 antigen) (Integrin alpha-IEL) (Mucosal lymphocyte 1 antigen) (CD antigen CD103) [Cleaved into: Integrin alpha-E light chain; Integrin alpha-E heavy chain] | 1-18 | 15 | 1179 | ITGAE | 223, 431, 639, 847, 1055, 1263, 1471, 1679, 1887, 2095, 2303, 2511, 2719 |
| 95 | Q01638 | ILRL1 | Interleukin-1 receptor-like 1 (Protein ST2) | 1-18 | 16 | 556 | IL1RL1 DER4 ST2 T1 | 224, 432, 640, 848, 1056, 1264, 1472, 1680, 1888, 2096, 2304, 2512, 2720 |
| 96 | Q9NZQ7 | PD1L1 | Programmed cell death 1 ligand 1 (PD-L1) (PDCD1 ligand 1) (Programmed death ligand 1) (B7 homolog 1) (B7-H1) (CD antigen CD274) | 1-18 | 17 | 290 | CD274 B7H1 PDCD1L1 PDCD1LG1 PDL1 | 225, 433, 641, 849, 1057, 1265, 1473, 1681, 1889, 2097, 2305, 2513, 2712 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 97 | P30443 | HLA-A | HLA class I histocompatibility antigen, A-1 alpha chain (MHC class Iantigen A*1) | 1-18 | 76948 | 365 | HLA-A HLAA | 76952, 76956, 76960, 76964, 76968, 76972, 76976, 76980, 76984, 76988, 76992, 76996, 77000 |
| 98 | Q6GPI1 | CTRB2 | Chymotrypsinogen B2 | 1-18 | 76949 | 263 | CTRB2 | 76953, 76957, 76961, 76965, 76969, 76973, 76977, 76981, 76985, 76989, 76993, 76997, 77001 |
| 99 | P02768 | ALB | Serum albumin (ALB) (ALBU) (humanes serum albumin) | 1-18 | 76950 | 609 | ALB ALBU HSA | 76954, 76958, 76962, 76966, 76970, 76974, 76978, 76982, 76986, 76990, 76994, 76998, 77002 |
| 100 | AAB59424.1 | IGHE | Ig heavy chain epsilon-1 (V-D-J region) | 1-18 | 76951 | 574 | IgE, IgHE | 76955, 76959, 76963, 76967, 76971, 76975, 76979, 76983, 76987, 76991, 76995, 76999, 77003 |
| 101 | P13591 | NCAM1 | Neural cell adhesion molecule 1 (N-CAM-1) (NCAM-1) (CD antigen CD56) | 1-19 | 18 | 858 | NCAM1 NCAM | 226, 434, 642, 850, 1058, 1266, 1474, 1682, 1890, 2098, 2306, 2514, 2722 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 102 | P26842 | CD27 | CD27 antigen (CD27L receptor) (T-cell activation antigen CD27) (T14) (Tumor necrosis factor receptor superfamily member 7) (CD antigen CD27) | 1-19 | 19 | 260 | CD27 TNFRSF7 | 227, 435, 643, 851, 1059, 1267, 1475, 1683, 1891, 2099, 2307, 2515, 2723 |
| 103 | P15391 | CD19 | B-lymphocyte antigen CD19 (B-lymphocyte surface antigen B4) (Differentiation antigen CD19) (T-cell surface antigen Leu-12) (CD antigen CD19) | 1-19 | 20 | 556 | CD19 | 228, 436, 644, 852, 1060, 1268, 1476, 1684, 1892, 2100, 2308, 2516, 2724 |
| 104 | Q8NI17 | IL31R | Interleukin-31 receptor subunit alpha (IL-31 receptor subunit alpha) (IL-31R subunit alpha) (IL-31R-alpha) (IL-31RA) (Cytokine receptor-like 3) (GLM-R) (hGLM-R) (Gp130-like monocyte receptor) (Gp130-like receptor) (ZcytoR17) | 1-19 | 21 | 732 | IL31RA CRL3 GPL UNQ6368/PRO21073/PRO21384 | 229, 437, 645, 853, 1061, 1269, 1477, 1685, 1893, 2101, 2309, 2517, 2725 |
| 105 | P08571 | CD14 | Monocyte differentiation antigen CD14 (Myeloid cell-specific leucine-rich glycoprotein) (CD antigen CD14) [Cleaved into: Monocyte differentiation antigen CD14, urinary form; Monocyte differentiation antigen CD14, membrane-bound form] | 1-19 | 22 | 375 | CD14 | 230, 438, 646, 854, 1062, 1270, 1478, 1686, 1894, 2102, 2310, 2518, 2726 |
| 106 | P05154 | IPSP | Plasma serine protease inhibitor (Acrosomal serine protease inhibitor) (Plasminogen activator inhibitor 3) (PAI-3) (PAI3) (Protein C inhibitor) (PCI) (Serpin A5) | 1-19 | 23 | 406 | SERPINA5 PCI PLANH3 PROCI | 231, 439, 647, 855, 1063, 1271, 1479, 1687, 1895, 2103, 2311, 2519, 2727 |
| 107 | P02787 | TRFE | Serotransferrin (Transferrin) (Beta-1 metal-binding globulin) (Siderophilin) | 1-19 | 24 | 698 | TF PRO1400 | 232, 440, 648, 856, 1064, 1272, 1480, 1688, 1896, 2104, 2312, 2520, 2728 |
| 108 | P02671 | FIBA | Fibrinogen alpha chain [Cleaved into: Fibrinopeptide A; Fibrinogen alpha chain] | 1-19 | 25 | 866 | FGA | 233, 441, 649, 857, 1065, 1273, 1481, 1689, 1897, 2105, 2313, 2521, 2729 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 109 | P04216 | THY1 | Thy-1 membrane glycoprotein (CDw90) (Thy-1 antigen) (CD antigen CD90) | 1-19 | 26 | 161 | THY1 | 234, 442, 650, 858, 1066, 1274, 1482, 1690, 1898, 2106, 2314, 2522, 2730 |
| 110 | P00747 | PLMN | Plasminogen (EC 3.4.21.7) [Cleaved into: Plasmin heavy chain A; Activation peptide; Angiostatin; Plasmin heavy chain A, short form; Plasmin light chain B] | 1-19 | 27 | 810 | PLG | 235, 443, 651, 859, 1067, 1275, 1483, 1691, 1899, 2107, 2315, 2523, 2731 |
| 111 | P01764 | HV323 | Immunoglobulin heavy variable 3-23 (Ig heavy chain V-III region LAY) (Ig heavy chain V-III region POM) (Ig heavy chain V-III region TEI) (Ig heavy chain V-III region TIL) (Ig heavy chain V-III region TUR) (Ig heavy chain V-III region VH26) (Ig heavy chain V-III region WAS) (Ig heavy chain V-III region ZAP) | 1-19 | 28 | 117 | IGHV3-23 | 236, 444, 652, 860, 1068, 1276, 1484, 1692, 1900, 2108, 2316, 2524, 2732 |
| 112 | P16150 | LEUK | Leukosialin (Galactoglycoprotein) (GALGP) (Leukocyte sialoglycoprotein) (Sialophorin) (CD antigen CD43) | 1-19 | 29 | 400 | SPN CD43 | 237, 445, 653, 861, 1069, 1277, 1485, 1693, 1901, 2109, 2317, 2525, 2733 |
| 113 | Q6DN72 | FCRL6 | Fc receptor-like protein 6 (FcR-like protein 6) (FcRL6) (Fc receptor homolog 6) (FcRH6) (IFGP6) | 1-19 | 30 | 434 | FCRL6 FCRH6 | 238, 446, 654, 862, 1070, 1278, 1486, 1694, 1902, 2110, 2318, 2526, 2734 |
| 114 | Q01151 | CD83 | CD83 antigen (hCD83) (B-cell activation protein) (Cell surface protein HB15) (CD antigen CD83) | 1-19 | 31 | 205 | CD83 | 239, 447, 655, 863, 1071, 1279, 1487, 1695, 1903, 2111, 2319, 2527, 2735 |
| 115 | P07093 | GDN | Glia-derived nexin (GDN) (Peptidase inhibitor 7) (PI-7) (Protease nexin 1) (PN-1) (Protease nexin I) (Serpin E2) | 1-19 | 32 | 398 | SERPINE2 PI7 PN1 | 240, 448, 656, 864, 1072, 1280, 1488, 1696, 1904, 2112, 2320, 2528, 2736 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 116 | Q8WWQ8 | STAB2 | Stabilin-2 (FAS1 EGF-like and X-link domain-containing adhesion molecule 2) (Fasciclin, EGF-like, laminin-type EGF-like and link domain-containing scavenger receptor 2) (FEEL-2) (Hyaluronan receptor for endocytosis) [Cleaved into: 190 kDa form stabilin-2 (190 kDa hyaluronan receptor for endocytosis)] | 1-19 | 33 | 2551 | STAB2 FEEL2 FELL FEX2 HARE | 241, 449, 657, 865, 1073, 1281, 1489, 1697, 1905, 2113, 2321, 2529, 2737 |
| 117 | Q13291 | SLAF1 | Signaling lymphocytic activation molecule (CDw150) (IPO-3) (SLAM family member 1) (CD antigen CD150) | 1-20 | 34 | 335 | SLAMF1 SLAM | 242, 450, 658, 866, 1074, 1282, 1490, 1698, 1906, 2114, 2322, 2530, 2738 |
| 118 | P35225 | IL13 | Interleukin-13 (IL-13) | 1-20 | 35 | 146 | IL13 NC30 | 243, 451, 659, 867, 1075, 1283, 1491, 1699, 1907, 2115, 2323, 2531, 2739 |
| 119 | P25942 | TNR5 | Tumor necrosis factor receptor superfamily member 5 (B-cell surface antigen CD40) (Bp50) (CD40L receptor) (CDw40) (CD antigen CD40) | 1-20 | 36 | 277 | CD40 TNFRSF5 | 244, 452, 660, 868, 1076, 1284, 1492, 1700, 1908, 2116, 2324, 2532, 2740 |
| 120 | P52803 | EFNA5 | Ephrin-A5 (AL-1) (EPH-related receptor tyrosine kinase ligand 7) (LERK-7) | 1-20 | 37 | 228 | EFNA5 EPLG7 LERK7 | 245, 453, 661, 869, 1077, 1285, 1493, 1701, 1909, 2117, 2325, 2533, 2741 |
| 121 | Q15116 | PDCD1 | Programmed cell death protein 1 (Protein PD-1) (hPD-1) (CD antigen CD279) | 1-20 | 38 | 288 | PDCD1 PD1 | 246, 454, 662, 870, 1078, 1286, 1494, 1702, 1910, 2118, 2326, 2534, 2742 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 122 | P05556 | ITB1 | Integrin beta-1 (Fibronectin receptor subunit beta) (Glycoprotein IIa) (GPIIA) (VLA-4 subunit beta) (CD antigen CD29) | 1-20 | 39 | 798 | ITGB1 FNRB MDF2 MSK12 | 247, 455, 663, 871, 1079, 1287, 1495, 1703, 1911, 2119, 2327, 2535, 2743 |
| 123 | Q12891 | HYAL2 | Hyaluronidase-2 (Hyal-2) (EC 3.2.1.35) (Hyaluronoglucosaminidase-2) (Lung carcinoma protein 2) (LuCa-2) | 1-20 | 40 | 473 | HYAL2 LUCA2 | 248, 456, 664, 872, 1080, 1288, 1496, 1704, 1912, 2120, 2328, 2536, 2744 |
| 124 | Q8IV16 | HDBP1 | Glycosylphosphatidylinositol-anchored high density lipoprotein-binding protein 1 (GPI-HBP1) (GPI-anchored HDL-binding protein 1) (High density lipoprotein-binding protein 1) | 1-20 | 41 | 184 | GPIHBP1 HBP1 | 249, 457, 665, 873, 1081, 1289, 1497, 1705, 1913, 2121, 2329, 2537, 2745 |
| 125 | Q03167 | TGBR3 | Transforming growth factor beta receptor type 3 (TGF-beta receptor type 3) (TGFR-3) (Betaglycan) (Transforming growth factor beta receptor III) (TGF-beta receptor type III) | 1-20 | 42 | 851 | TGFBR3 | 250, 458, 666, 874, 1082, 1290, 1498, 1706, 1914, 2122, 2330, 2538, 2746 |
| 126 | Q14246 | AGRE1 | Adhesion G protein-coupled receptor E1 (EGF-like module receptor 1) (EGF-like module-containing mucin-like hormone receptor-like 1) (EMR1 hormone receptor) | 1-20 | 43 | 886 | ADGRE1 EMR1 TM7LN3 | 251, 459, 667, 875, 1083, 1291, 1499, 1707, 1915, 2123, 2331, 2539, 2747 |
| 127 | P16871 | IL7RA | Interleukin-7 receptor subunit alpha (IL-7 receptor subunit alpha) (IL-7R subunit alpha) (IL-7R-alpha) (IL-7RA) (CDw127) (CD antigen CD127) | 1-20 | 44 | 459 | IL7R | 252, 460, 668, 876, 1084, 1292, 1500, 1708, 1916, 2124, 2332, 2540, 2748 |
| 128 | P61769 | B2MG | Beta-2-microglobulin [Cleaved into: Beta-2-microglobulin form pI 5.3] | 1-20 | 45 | 119 | B2M CDABP0092 HDCMA22P | 253, 461, 669, 877, 1085, 1293, 1501, 1709, 1917, 2125, 2333, 2541, 2749 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 129 | Q9Y6W8 | ICOS | Inducible T-cell costimulator (Activation-inducible lymphocyte immunomediatory molecule) (CD antigen CD278) | 1-20 | 46 | 199 | ICOS AILIM | 254, 462, 670, 878, 1086, 1294, 1502, 1710, 1918, 2126, 2334, 2542, 2750 |
| 130 | P10966 | CD86 | T-cell surface glycoprotein CD8 beta chain (CD antigen CD8b) | 1-21 | 47 | 210 | CD86 CD8B1 | 255, 463, 671, 879, 1087, 1295, 1503, 1711, 1919, 2127, 2335, 2543, 2751 |
| 131 | Q9BZW8 | CD244 | Natural killer cell receptor 2B4 (NK cell activation-inducing ligand) (NAIL) (NK cell type I receptor protein 2B4) (NKR2B4) (h2B4) (SLAM family member 4) (SLAMF4) (Signaling lymphocytic activation molecule 4) (CD antigen CD244) | 1-21 | 48 | 370 | CD244 2B4 | 256, 464, 672, 880, 1088, 1296, 1504, 1712, 1920, 2128, 2336, 2544, 2752 |
| 132 | P02778 | CXL10 | C-X-C motif chemokine 10 (10 kDa interferon gamma-induced protein) (Gamma- IP10) (IP-10) (Small-inducible cytokine B10) [Cleaved into: CXCL10(1-73)] | 1-21 | 49 | 98 | CXCL10 INP10 SCYB10 | 257, 465, 673, 881, 1089, 1297, 1505, 1713, 1921, 2129, 2337, 2545, 2753 |
| 133 | P18564 | ITB6 | Integrin beta-6 | 1-21 | 50 | 788 | ITGB6 | 258, 466, 674, 882, 1090, 1298, 1506, 1714, 1922, 2130, 2338, 2546, 2754 |
| 134 | O14525 | ASTN1 | Astrotactin-1 | 1-21 | 51 | 1302 | ASTN1 ASTN KIAA0289 | 259, 467, 675, 883, 1091, 1299, 1507, 1715, 1923, 2131, 2339, 2547, 2755 |
| 135 | P01130 | LDLR | Low-density lipoprotein receptor (LDL receptor) | 1-21 | 52 | 860 | LDLR | 260, 468, 676, 884, 1092, 1300, 1508, 1716, 1924, 2132, 2340, 2548, 2756 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 136 | P01732 | CD8A | T-cell surface glycoprotein CD8 alpha chain (T-lymphocyte differentiation antigen T8/Leu-2) (CD antigen CD8a) | 1-21 | 53 | 235 | CD8A MAL | 261, 469, 677, 885, 1093, 1301, 1509, 1717, 1925, 2133, 2341, 2549, 2757 |
| 137 | P48061 | SDF1 | Stromal cell-derived factor 1 (SDF-1) (hSDF-1) (C-X-C motif chemokine 12) (Intercrine reduced in hepatomas) (IRH) (hIRH) (Pre-B cell growth-stimulating factor) (PBSF) [Cleaved into: SDF-1-beta(3-72); SDF-1-alpha(3-67)] | 1-21 | 54 | 93 | CXCL12 SDF1 SDF1A SDF1B | 262, 470, 678, 886, 1094, 1302, 1510, 1718, 1926, 2134, 2342, 2550, 2758 |
| 138 | P01589 | IL2RA | Interleukin-2 receptor subunit alpha (IL-2 receptor subunit alpha) (IL-2-RA) (IL-2R subunit alpha) (1L2-RA) (TAC antigen) (p55) (CD antigen CD25) | 1-21 | 55 | 272 | IL2RA | 263, 471, 679, 887, 1095, 1303, 1511, 1719, 1927, 2135, 2343, 2551, 2759 |
| 139 | Q86113 | CLC14 | C-type lectin domain family 14 member A (Epidermal growth factor receptor 5) (EGFR-5) | 1-21 | 56 | 490 | CLEC14A C14orf27 EGFR5 UNQ236/PRO269 | 264, 472, 680, 888, 1096, 1304, 1512, 1720, 1928, 2136, 2344, 2552, 2760 |
| 140 | Q5DID0 | UROL1 | Uromodulin-like 1 (Olfactorin) | 1-21 | 57 | 1318 | UMODL1 | 265, 473, 681, 889, 1097, 1305, 1513, 1721, 1929, 2137, 2345, 2553, 2761 |
| 141 | P40189 | IL6RB | Interleukin-6 receptor subunit beta (IL-6 receptor subunit beta) (IL-6R subunit beta) (IL-6R-beta) (IL-6RB) (CDw130) (Interleukin-6 signal transducer) (Membrane glycoprotein 130) (gp130) (Oncostatin-M receptor subunit alpha) (CD antigen CD130) | 1-22 | 58 | 918 | IL6ST | 266, 474, 682, 890, 1098, 1306, 1514, 1722, 1930, 2138, 2346, 2554, 2762 |
| 142 | Q86YL7 | PDPN | Podoplanin (Aggrus) (Glycoprotein 36) (Gp36) (PA2.26 antigen) (T1-alpha) (T1A) | 1-22 | 59 | 162 | PDPN GP36 PSEC0003 PSEC0025 | 267, 475, 683, 891, 1099, 1307, 1515, 1723, 1931, 2139, 2347, 2555, 2763 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 143 | P55075 | FGF8 | Fibroblast growth factor 8 (FGF-8) (Androgen-induced growth factor) (AIGF) (Heparin-binding growth factor 8) (HBGF-8) | 1-22 | 60 | 233 | FGF8 AIGF | 268, 476, 684, 892, 1100, 1308, 1516, 1724, 1932, 2140, 2348, 2556, 2764 |
| 144 | Q30201 | HFE | Hereditary hemochromatosis protein (HLA-H) | 1-22 | 61 | 348 | HFE HLAH | 269, 477, 685, 893, 1101, 1309, 1517, 1725, 1933, 2141, 2349, 2557, 2765 |
| 145 | P07766 | CD3E | T-cell surface glycoprotein CD3 epsilon chain (T-cell surface antigen T3/Leu-4 epsilon chain) (CD antigen CD3e) | 1-22 | 62 | 207 | CD3E T3E | 270, 478, 686, 894, 1102, 1310, 1518, 1726, 1934, 2142, 2350, 2558, 2766 |
| 146 | P18827 | SDC1 | Syndecan-1 (SYND1) (CD antigen CD138) | 1-22 | 63 | 310 | SDC1 SDC | 271, 479, 687, 895, 1103, 1311, 1519, 1727, 1935, 2143, 2351, 2559, 2767 |
| 147 | P55290 | CAD13 | Cadherin-13 (Heart cadherin) (H-cadherin) (P105) (Truncated cadherin) (T-cad) (T-cadherin) | 1-22 | 64 | 713 | CDH13 CDHH | 272, 480, 688, 896, 1104, 1312, 1520, 1728, 1936, 2144, 2352, 2560, 2768 |
| 148 | P37173 | TGFR2 | TGF-beta receptor type-2 (TGFR-2) (EC 2.7.11.30) (TGF-beta type II receptor) (Transforming growth factor-beta receptor type II) (TGF-beta receptor type II) (TbetaR-II) | 1-22 | 65 | 567 | TGFBR2 | 273, 481, 689, 897, 1105, 1313, 1521, 1729, 1937, 2145, 2353, 2561, 2769 |
| 149 | Q07325 | CXCL9 | C-X-C motif chemokine 9 (Gamma-interferon-induced monokine) (Monokine induced by interferon-gamma) (HuMIG) (MIG) (Small-inducible cytokine B9) | 1-22 | 66 | 125 | CXCL9 CMK MIG SCYB9 | 274, 482, 690, 898, 1106, 1314, 1522, 1730, 1938, 2146, 2354, 2562, 2770 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 150 | P04156 | PRIO | Major prion protein (PrP) (ASCR) (PrP27-30) (PrP33-35C) (CD antigen CD230) | 1-22 | 67 | 253 | PRNP ALTPRP PRIP PRP | 275, 483, 691, 899, 1107, 1315, 1523, 1731, 1939, 2147, 2355, 2563, 2771 |
| 151 | P31785 | IL2RG | Cytokine receptor common subunit gamma (Interleukin-2 receptor subunit gamma) (IL-2 receptor subunit gamma) (IL-2R subunit gamma) (IL-2RG) (gammaC) (p64) (CD antigen CD132) | 1-22 | 68 | 369 | IL2RG | 276, 484, 692, 900, 1108, 1316, 1524, 1732, 1940, 2148, 2356, 2564, 2772 |
| 152 | P01579 | IFNG | Interferon gamma (IFN-gamma) (Immune interferon) | 1-23 | 69 | 166 | IFNG | 277, 485, 693, 901, 1109, 1317, 1525, 1733, 1941, 2149, 2357, 2565, 2773 |
| 153 | P23229 | ITA6 | Integrin alpha-6 (CD49 antigen-like family member F) (VLA-6) (CD antigen CD49f) [Cleaved into: Integrin alpha-6 heavy chain; Integrin alpha-6 light chain; Processed integrin alpha-6 (Alpha6p)] | 1-23 | 70 | 1130 | ITGA6 | 278, 486, 694, 902, 1110, 1318, 1526, 1734, 1942, 2150, 2358, 2566, 2774 |
| 154 | O60494 | CUBN | Cubilin (460 kDa receptor) (Intestinal intrinsic factor receptor) (Intrinsic factor-cobalamin receptor) (Intrinsic factor-vitamin B12 receptor) | 1-23 | 71 | 3623 | CUBN IFCR | 279, 487, 695, 903, 1111, 1319, 1527, 1735, 1943, 2151, 2359, 2567, 2775 |
| 155 | P08575 | PTPRC | Receptor-type tyrosine-protein phosphatase C (EC 3.1.3.48) (Leukocyte common antigen) (L-CA) (1200) (CD antigen CD45) | 1-23 | 72 | 1304 | PTPRC CD45 | 280, 488, 696, 904, 1112, 1320, 1528, 1736, 1944, 2152, 2360, 2568, 2776 |
| 156 | Q8IWY4 | SCUB1 | Signal peptide, CUB and EGF-like domain-containing protein 1 | 1-23 | 73 | 988 | SCUBE1 | 281, 489, 697, 905, 1113, 1321, 1529, 1737, 1945, 2153, 2361, 2569, 2777 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 157 | Q08431 | MFGM | Lactadherin (Breast epithelial antigen BA46) (HMFG) (MFGM) (Milk fat globule-EGF factor 8) (MFG-E8) (SED1) [Cleaved into: Lactadherin short form; Medin] | 1-23 | 74 | 387 | MFGE8 | 282, 490, 698, 906, 1114, 1322, 1530, 1738, 1946, 2154, 2362, 2570, 2778 |
| 158 | Q99665 | I12R2 | Interleukin-12 receptor subunit beta-2 (IL-12 receptor subunit beta-2) (IL-12R subunit beta-2) (IL-12R-beta-2) (IL-12RB2) | 1-23 | 75 | 862 | IL12RB2 | 283, 491, 699, 907, 1115, 1323, 1531, 1739, 1947, 2155, 2363, 2571, 2779 |
| 159 | Q6Q8B3 | MO2R2 | Cell surface glycoprotein CD200 receptor 2 (CD200 cell surface glycoprotein receptor-like 2) (CD200 receptor-like 2) (HuCD200R2) (CD200 cell surface glycoprotein receptor-like a) (CD200RLa) (Cell surface glycoprotein CD200 receptor 1-like) (Cell surface glycoprotein OX2 receptor 2) | 1-23 | 76 | 271 | CD200R1L CD200R2 | 284, 492, 700, 908, 1116, 1324, 1532, 1740, 1948, 2156, 2364, 2572, 2780 |
| 160 | Q07011 | TNR9 | Tumor necrosis factor receptor superfamily member 9 (4-1BB ligand receptor) (CDw137) (T-cell antigen 4-1BB homolog) (T-cell antigen ILA) (CD antigen CD137) | 1-23 | 77 | 255 | TNFRSF9 CD137 ILA | 285, 493, 701, 909, 1117, 1325, 1533, 1741, 1949, 2157, 2365, 2573, 2781 |
| 161 | Q8NHL6 | LIRB1 | Leukocyte immunoglobulin-like receptor subfamily B member 1 (LIR-1) (Leukocyte immunoglobulin-like receptor 1) (CD85 antigen-like family member J) (Immunoglobulin-like transcript 2) (ILT-2) (Monocyte/macrophage immunoglobulin-like receptor 7) (MIR-7) (CD antigen CD85j) | 1-23 | 78 | 650 | LILRB1 ILT2 LIR1 MIR7 | 286, 494, 702, 910, 1118, 1326, 1534, 1742, 1950, 2158, 2366, 2574, 2782 |
| 162 | P36894 | BMR1A | Bone morphogenetic protein receptor type-1A (BMP type-1A receptor) (BMPR-1A) (EC 2.7.11.30) (Activin receptor-like kinase 3) (ALK-3) (Serine/threonine-protein kinase receptor R5) (SKR5) (CD antigen CD292) | 1-23 | 79 | 532 | BMPR1A ACVRLK3 ALK3 | 287, 495, 703, 911, 1119, 1327, 1535, 1743, 1951, 2159, 2367, 2575, 2783 |
| 163 | Q16552 | IL17 | Interleukin-17A (IL-17) (IL-17A) (Cytotoxic T-lymphocyte-associated antigen 8) (CTLA-8) | 1-23 | 80 | 155 | IL17A CTLA8 IL17 | 288, 496, 704, 912, 1120, 1328, 1536, 1744, 1952, 2160, 2368, 2576, 2784 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 164 | P42081 | CD86 | T-lymphocyte activation antigen CD86 (Activation B7-2 antigen) (B70) (BU63) (CTLA-4 counter-receptor B7.2) (FUN-1) (CD antigen CD86) | 1-23 | 8 | 329 | CD86 CD28LG2 | 289, 497, 705, 913, 1121, 1329, 1537, 1745, 1953, 2161, 2369, 2577, 2785 |
| 165 | P43121 | MUC18 | Cell surface glycoprotein MUC18 (Cell surface glycoprotein P1H12) (Melanoma cell adhesion molecule) (Melanoma-associated antigen A32) (Melanoma-associated antigen MUC18) (S-endo 1 endothelial-associated antigen) (CD antigen CD146) | 1-23 | 82 | 646 | MCAM MUC18 | 290, 498, 706, 914, 1122, 1330, 1538, 1746, 1954, 2162, 2370, 2578, 2786 |
| 166 | O00206 | TLR4 | Toll-like receptor 4 (hToll) (CD antigen CD284) | 1-23 | 83 | 839 | TLR4 | 291, 499, 707, 915, 1123, 1331, 1539, 1747, 1955, 2163, 2371, 2579, 2787 |
| 167 | P42701 | I12R1 | Interleukin-12 receptor subunit beta-1 (IL-12 receptor subunit beta-1) (IL-12R subunit beta-1) (IL-12R-beta-1) (IL-12RB1) (IL-12 receptor beta component) (CD antigen CD212) | 1-23 | 84 | 662 | IL12RB1 IL12R IL12RB | 292, 500, 708, 916, 1124, 1332, 1540, 1748, 1956, 2164, 2372, 2580, 2788 |
| 168 | P06729 | CD2 | T-cell surface antigen CD2 (Erythrocyte receptor) (LFA-2) (LFA-3 receptor) (Rosette receptor) (T-cell surface antigen T11/Leu-5) (CD antigen CD2) | 1-24 | 85 | 351 | CD2 SRBC | 293, 501, 709, 917, 1125, 1333, 1541, 1749, 1957, 2165, 2373, 2581, 2789 |
| 169 | P15328 | FOLR1 | Folate receptor alpha (FR-alpha) (Adult folate-binding protein) (FBP) (Folate receptor 1) (Folate receptor, adult) (KB cells FBP) (Ovarian tumor-associated antigen MOv18) | 1-24 | 86 | 257 | FOLR1 FOLR | 294, 502, 710, 918, 1126, 1334, 1542, 1750, 1958, 2166, 2374, 2582, 2790 |
| 170 | P05112 | IL4 | Interleukin-4 (1L-4) (B-cell stimulatory factor 1) (BSF-1) (Binetrakin) (Lymphocyte stimulatory factor 1) (Pitrakinra) | 1-24 | 87 | 153 | IL4 | 295, 503, 711, 919, 1127, 1335, 1543, 1751, 1959, 2167, 2375, 2583, 2791 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 171 | P06127 | CD5 | T-cell surface glycoprotein CD5 (Lymphocyte antigen T1/Leu-1) (CD antigen CD5) | 1-24 | 88 | 495 | CD5 LEU1 | 296, 504, 712, 920, 1128, 1336, 1544, 1752, 1960, 2168, 2376, 2584, 2792 |
| 172 | P32248 | CCR7 | C-C chemokine receptor type 7 (C-C CKR-7) (CC-CKR-7) (CCR-7) (BLR2) (CDw197) (Epstein-Barr virus-induced G-protein coupled receptor 1) (EBI1) (EBV-induced G-protein coupled receptor 1) (MIP-3 beta receptor) (CD antigen CD197) | 1-24 | 89 | 378 | CCR7 CMKBR7 EBI1 EVI1 | 297, 505, 713, 921, 1129, 1337, 1545, 1753, 1961, 2169, 2377, 2585, 2793 |
| 173 | Q7Z7D3 | VTCN1 | V-set domain-containing T-cell activation inhibitor 1 (B7 homolog 4) (B7-H4) (B7h.5) (Immune costimulatory protein B7-H4) (Protein B7S1) (T-cell costimulatory molecule B7x) | 1-24 | 90 | 282 | VTCN1 B7H4 UNQ659/PRO1291 | 298, 506, 714, 922, 1130, 1338, 1546, 1754, 1962, 2170, 2378, 2586, 2794 |
| 174 | P54756 | EPHA5 | Ephrin type-A receptors (EC 2.7.10.1) (Brain-specific kinase) (EPH homology kinase 1) (EHK-1) (EPH-like kinase 7) (EK7) (hEK7) | 1-24 | 91 | 1037 | EPHA5 BSK EHK1 HEK7 TYRO4 | 299, 507, 715, 923, 1131, 1339, 1547, 1755, 1963, 2171, 2379, 2587, 2795 |
| 175 | Q92823 | NRCAM | Neuronal cell adhesion molecule (Nr-CAM) (Neuronal surface protein Bravo) (hBravo) (NgCAM-related cell adhesion molecule) (Ng-CAM-related) | 1-24 | 92 | 1304 | NRCAM KIAA0343 | 300, 508, 716, 924, 1132, 1340, 1548, 1756, 1964, 2172, 2380, 2588, 2796 |
| 176 | P19320 | VCAM1 | Vascular cell adhesion protein 1 (V-CAM 1) (VCAM-1) (INCAM-100) (CD antigen CD106) | 1-24 | 93 | 739 | VCAM1 | 301, 509, 717, 925, 1133, 1341, 1549, 1757, 1965, 2173, 2381, 2589, 2797 |
| 177 | Q86UN2 | R4RL1 | Reticulon-4 receptor-like 1 (Nogo receptor-like 2) (Nogo-66 receptor homolog 2) (Nogo-66 receptor-related protein 3) (NgR3) | 1-24 | 94 | 441 | RTN4RL1 NGRH2 NGRL2 | 302, 510, 718, 926, 1134, 1342, 1550, 1758, 1966, 2174, 2382, 2590, 2798 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 178 | P33151 | CADH5 | Cadherin-5 (764 antigen) (Vascular endothelial cadherin) (VE-cadherin) (CD antigen CD144) | 1-25 | 95 | 784 | CDH5 | 303, 511, 719, 927, 1135, 1343, 1551, 1759, 1967, 2175, 2383, 2591, 2799 |
| 179 | P17813 | EGLN | Endoglin (CD antigen CD105) | 1-25 | 96 | 658 | ENG END | 304, 512, 720, 928, 1136, 1344, 1552, 1760, 1968, 2176, 2384, 2592, 2800 |
| 180 | P25445 | TNR6 | Tumor necrosis factor receptor superfamily member 6 (Apo-1 antigen) (Apoptosis-mediating surface antigen FAS) (FASLG receptor) (CD antigen CD95) | 1-25 | 97 | 335 | FAS APT1 FAS1 TNFRSF6 | 305, 513, 721, 929, 1137, 1345, 1553, 1761, 1969, 2177, 2385, 2593, 2801 |
| 181 | P01730 | CD4 | T-cell surface glycoprotein CD4 (T-cell surface antigen T4/Leu-3) (CD antigen CD4) | 1-25 | 98 | 458 | CD4 | 306, 514, 722, 930, 1138, 1346, 1554, 1762, 1970, 2178, 2386, 2594, 2802 |
| 182 | Q685J3 | MUC17 | Mucin-17 (MUC-17) (Small intestinal mucin-3) (MUC-3) | 1-25 | 99 | 4493 | MUC17 MUC3 | 307, 515, 723, 931, 1139, 1347, 1555, 1763, 1971, 2179, 2387, 2595, 2803 |
| 183 | P17787 | ACHB2 | Neuronal acetylcholine receptor subunit beta-2 | 1-25 | 100 | 502 | CHRNB2 | 308, 516, 724, 932, 1140, 1348, 1556, 1764, 1972, 2180, 2388, 2596, 2804 |
| 184 | Q6UQ28 | PLET1 | Placenta-expressed transcript 1 protein | 1-25 | 101 | 207 | PLET1 C11orf34 | 309, 517, 725, 933, 1141, 1349, 1557, 1765, 1973, 2181, 2389, 2597, 2805 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 185 | P13987 | CD59 | CD59 glycoprotein (1F5 antigen) (20 kDa homologous restriction factor) (HRF-20) (HRF20) (MAC-inhibitory protein) (MAC-IP) (MEM43 antigen) (Membrane attack complex inhibition factor) (MACIF) (Membrane inhibitor of reactive lysis) (MIRL) (Protectin) (CD antigen CD59) | 1-25 | 102 | 128 | CD59 MIC11 MIN1 MIN2 MIN3 MSK21 | 310, 518, 726, 934, 1142, 1350, 1558, 1766, 1974, 2182, 2390, 2598, 2806 |
| 186 | P10721 | KIT | Mast/stem cell growth factor receptor Kit (SCFR) (EC 2.7.10.1) (Piebald trait protein) (PBT) (Proto-oncogene c-Kit) (Tyrosine-protein kinase Kit) (p145 c-kit) (v-kit Hardy-Zuckerman 4 feline sarcoma viral oncogene homolog) (CD antigen CD117) | 1-25 | 103 | 976 | KIT SCFR | 311, 519, 727, 935, 1143, 1351, 1559, 1767, 1975, 2183, 2391, 2599, 2807 |
| 187 | P12319 | FCERA | High affinity immunoglobulin epsilon receptor subunit alpha (Fc-epsilon RI-alpha) (FcERI) (IgE Fc receptor subunit alpha) | 1-25 | 104 | 257 | FCER1A FCE1A | 312, 520, 728, 936, 1144, 1352, 1560, 1768, 1976, 2184, 2392, 2600, 2808 |
| 188 | Q9BZR6 | RTN4R | Reticulon-4 receptor (Nogo receptor) (NgR) (Nogo-66 receptor) | 1-26 | 105 | 473 | RTN4R NOGOR UNQ330/PRO526 | 313, 521, 729, 937, 1145, 1353, 1561, 1769, 1977, 2185, 2393, 2601, 2809 |
| 189 | P25063 | CD24 | Signal transducer CD24 (Small cell lung carcinoma cluster 4 antigen) (CD antigen CD24) | 1-26 | 106 | 80 | CD24 CD24A | 314, 522, 730, 938, 1146, 1354, 1562, 1770, 1978, 2186, 2394, 2602, 2810 |
| 190 | Q9NR97 | TLR8 | Toll-like receptor 8 (CD antigen CD288) | 1-26 | 107 | 1041 | TLR8 UNQ249/PRO286 | 315, 523, 731, 939, 1147, 1355, 1563, 1771, 1979, 2187, 2395, 2603, 2811 |
| 191 | Q8N131 | PORIM | Porimin (Keratinocytes-associated transmembrane protein 3) (KCT-3) (Pro-oncosis receptor inducing membrane injury) (Transmembrane protein 123) | 1-26 | 108 | 208 | TMEM123 KCT3 PSEC0111 UNQ641/PRO1271 | 316, 524, 732, 940, 1148, 1356, 1564, 1772, 1980, 2188, 2396, 2604, 2812 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 192 | P49771 | FLT3L | Fms-related tyrosine kinase 3 ligand (Flt3 ligand) (Flt3L) (SL cytokine) | 1-26 | 109 | 235 | FLT3LG | 317, 525, 733, 941, 1149, 1357, 1565, 1773, 1981, 2189, 2397, 2605, 2813 |
| 193 | P02679 | FIBG | Fibrinogen gamma chain | 1-26 | 110 | 453 | FGG PRO2061 | 318, 526, 734, 942, 1150, 1358, 1566, 1774, 1982, 2190, 2398, 2606, 2814 |
| 194 | P14784 | IL2RB | Interleukin-2 receptor subunit beta (IL-2 receptor subunit beta) (IL-2R subunit beta) (IL-2RB) (High affinity IL-2 receptor subunit beta) (p70-75) (p75) (CD antigen CD122) | 1-26 | 111 | 551 | IL2RB | 319, 527, 735, 943, 1151, 1359, 1567, 1775, 1983, 2191, 2399, 2607, 2815 |
| 195 | P05362 | ICAM1 | Intercellular adhesion molecule 1 (ICAM-1) (Major group rhinovirus receptor) (CD antigen CD54) | 1-27 | 112 | 532 | ICAM1 | 320, 528, 736, 944, 1152, 1360, 1568, 1776, 1984, 2192, 2400, 2608, 2816 |
| 196 | Q13740 | CD166 | CD166 antigen (Activated leukocyte cell adhesion molecule) (CD antigen CD166) | 1-27 | 113 | 583 | ALCAM MEMD | 321, 529, 737, 945, 1153, 1361, 1569, 1777, 1985, 2193, 2401, 2609, 2817 |
| 197 | Q13443 | ADAM9 | Disintegrin and metalloproteinase domain-containing protein 9 (ADAM 9) (EC 3.4.24.-) (Cellular disintegrin-related protein) (Meltrin-gamma) (Metalloprotease/disintegrin/cysteine-rich protein 9) (Myeloma cell metalloproteinase) | 1-28 | 114 | 819 | ADAM9 KIAA0021 MCMP MDC9 MLTNG | 322, 530, 738, 946, 1154, 1362, 1570, 1778, 1986, 2194, 2402, 2610, 2818 |
| 198 | P14151 | LYAM1 | L-selectin (CD62 antigen-like family member L) (Leukocyte adhesion molecule 1) (LAM-1) (Leukocyte surface antigen Leu-8) (Leukocyte-endothelial cell adhesion molecule 1) (LECAM1) (Lymph node homing receptor) (TQ1) (gp90-MEL) (CD antigen CD62L) | 1-28 | 115 | 372 | SELL LNHR LYAM1 | 323, 531, 739, 947, 1155, 1363, 1571, 1779, 1987, 2195, 2403, 2611, 2819 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 199 | P56199 | ITA1 | Integrin alpha-1 (CD49 antigen-like family member A) (Laminin and collagen receptor) (VLA-1) (CD antigen CD49a) | 1-28 | 116 | 1179 | ITGA1 | 324, 532, 740, 948, 1156, 1364, 1572, 1780, 1988, 2196, 2404, 2612, 2820 |
| 200 | P11279 | LAMP1 | Lysosome-associated membrane glycoprotein 1 (LAMP-1) (Lysosome-associated membrane protein 1) (CD107 antigen-like family member A) (CD antigen CD107a) | 1-28 | 117 | 417 | LAMP1 | 325, 533, 741, 949, 1157, 1365, 1573, 1781, 1989, 2197, 2405, 2613, 2821 |
| 201 | P40259 | CD79B | B-cell antigen receptor complex-associated protein beta chain (B-cell-specific glycoprotein B29) (Ig-beta) (Immunoglobulin-associated B29 protein) (CD antigen CD79b) | 1-28 | 118 | 229 | CD79B B29 IGB | 326, 534, 742, 950, 1158, 1366, 1574, 1782, 1990, 2198, 2406, 2614, 2822 |
| 202 | P43681 | ACHA4 | Neuronal acetylcholine receptor subunit alpha-4 | 1-28 | 119 | 627 | CHRNA4 NACRA4 | 327, 535, 743, 951, 1159, 1367, 1575, 1783, 1991, 2199, 2407, 2615, 2823 |
| 203 | P18627 | LAG3 | Lymphocyte activation gene 3 protein (LAG-3) (Protein FDC) (CD antigen CD223) | 1-28 | 120 | 525 | LAG3 FDC | 328, 536, 744, 952, 1160, 1368, 1576, 1784, 1992, 2200, 2408, 2616, 2824 |
| 204 | Q5ZPR3 | CD276 | CD276 antigen (4Ig-B7-H3) (B7 homolog 3) (B7-H3) (Costimulatory molecule) (CD antigen CD276) | 1-28 | 121 | 534 | CD276 B7H3 PSEC0249 UNQ309/PRO352 | 329, 537, 745, 953, 1161, 1369, 1577, 1785, 1993, 2201, 2409, 2617, 2825 |
| 205 | P23415 | GLRA1 | Glycine receptor subunit alpha-1 (Glycine receptor 48 kDa subunit) (Glycine receptor strychnine-binding subunit) | 1-28 | 122 | 457 | GLRA1 | 330, 538, 746, 954, 1162, 1370, 1578, 1786, 1994, 2202, 2410, 2618, 2826 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 206 | Q8TD46 | MO2R1 | Cell surface glycoprotein CD200 receptor 1 (CD200 cell surface glycoprotein receptor) (Cell surface glycoprotein OX2 receptor 1) | 1-28 | 123 | 325 | CD200R1 CD200R CRTR2 MOX2R OX2R UNQ2522/PRO6015 | 331, 539, 747, 955, 1163, 1371, 1579, 1787, 1995, 2203, 2411, 2619, 2827 |
| 207 | P17301 | ITA2 | Integrin alpha-2 (CD49 antigen-like family member B) (Collagen receptor) (Platelet membrane glycoprotein Ia) (GPIa) (VLA-2 subunit alpha) (CD antigen CD49b) | 1-29 | 124 | 1181 | ITGA2 CD49B | 332, 540, 748, 956, 1164, 1372, 1580, 1788, 1996, 2204, 2412, 2620, 2828 |
| 208 | P12821 | ACE | Angiotensin-converting enzyme (ACE) (EC 3.2.1.-) (EC 3.4.15.1) (Dipeptidyl carboxypeptidase 1) (Kininase II) (CD antigen CD143) [Cleaved into: Angiotensin-converting enzyme, soluble form] | 1-29 | 125 | 1306 | ACE DCP DCP1 | 333, 541, 749, 957, 1165, 1373, 1581, 1789, 1997, 2205, 2413, 2621, 2829 |
| 209 | Q14118 | DAG1 | Dystroglycan (Dystrophin-associated glycoprotein 1) [Cleaved into: Alpha-dystroglycan (Alpha-DG); Beta-dystroglycan (Beta-DG)] | 1-29 | 126 | 895 | DAG1 | 334, 542, 750, 958, 1166, 1374, 1582, 1790, 1998, 2206, 2414, 2622, 2830 |
| 210 | P05231 | IL6 | Interleukin-6 (IL-6) (B-cell stimulatory factor 2) (BSF-2) (CTL differentiation factor) (CDF) (Hybridoma growth factor) (Interferon beta-2) (IFN-beta-2) | 1-29 | 127 | 212 | IL6 IFNB2 | 335, 543, 751, 959, 1167, 1375, 1583, 1791, 1999, 2207, 2415, 2623, 2831 |
| 211 | O00602 | FCN1 | Ficolin-1 (Collagen/fibrinogen domain-containing protein 1) (Ficolin-A) (Ficolin-alpha) (M-ficolin) | 1-29 | 128 | 326 | FCN1 FCNM | 336, 544, 752, 960, 1168, 1376, 1584, 1792, 2000, 2208, 2416, 2624, 2832 |
| 212 | Q9Y6Q6 | TNR11 | Tumor necrosis factor receptor superfamily member 11A (Osteoclast differentiation factor receptor) (ODFR) (Receptor activator of NF-KB) (CD antigen CD265) | 1-29 | 129 | 616 | TNFRSF11A RANK | 337, 545, 753, 961, 1169, 1377, 1585, 1793, 2001, 2209, 2417, 2625, 2833 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 213 | Q9ULI3 | HEG1 | Protein HEG homolog 1 | 1-29 | 130 | 1381 | HEG1 KIAA1237 | 338, 546, 754, 962, 1170, 1378, 1586, 1794, 2002, 2210, 2418, 2626, 2834 |
| 214 | Q8NBP7 | PCSK9 | Proprotein convertase subtilisin/kexin type 9 (EC 3.4.21.-) (Neural apoptosis-regulated convertase 1) (NARC-1) (Proprotein convertase 9) (PC9) (Subtilisin/kexin-like protease PC9) | 1-30 | 131 | 692 | PCSK9 NARC1 PSEC0052 | 339, 547, 755, 963, 1171, 1379, 1587, 1795, 2003, 2211, 2419, 2627, 2835 |
| 215 | P02675 | FIBB | Fibrinogen beta chain [Cleaved into: Fibrinopeptide B; Fibrinogen beta chain] | 1-30 | 132 | 491 | FGB | 340, 548, 756, 964, 1172, 1380, 1588, 1796, 2004, 2212, 2420, 2628, 2836 |
| 216 | P06756 | ITAV | Integrin alpha-V (Vitronectin receptor subunit alpha) (CD antigen CD51) [Cleaved into: Integrin alpha-V heavy chain; Integrin alpha-V light chain] | 1-30 | 133 | 1048 | ITGAV MSK8 VNRA | 341, 549, 757, 965, 1173, 1381, 1589, 1797, 2005, 2213, 2421, 2629, 2837 |
| 217 | O60609 | GFRA3 | GDNF family receptor alpha-3 (GDNF receptor alpha-3) (GDNFR-alpha-3) (GFR-alpha-3) | 1-31 | 134 | 400 | GFRA3 UNQ339/PRO538/PRO3664 | 342, 550, 758, 966, 1174, 1382, 1590, 1798, 2006, 2214, 2422, 2630, 2838 |
| 218 | P50895 | BCAM | Basal cell adhesion molecule (Auberger B antigen) (B-CAM cell surface glycoprotein) (F8/G253 antigen) (Lutheran antigen) (Lutheran blood group glycoprotein) (CD antigen CD239) | 1-31 | 135 | 628 | BCAM LU MSK19 | 343, 551, 759, 967, 1175, 1383, 1591, 1799, 2007, 2215, 2423, 2631, 2839 |
| 219 | P28906 | CD34 | Hematopoietic progenitor cell antigen CD34 (CD antigen CD34) | 1-31 | 136 | 385 | CD34 | 344, 552, 760, 968, 1176, 1384, 1592, 1800, 2008, 2216, 2424, 2632, 2840 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 220 | P08514 | ITA2B | Integrin alpha-IIb (GPalpha IIb) (GPIIb) (Platelet membrane glycoprotein IIb) (CD antigen CD41) [Cleaved into: Integrin alpha-IIb heavy chain; Integrin alpha-IIb light chain, form 1; Integrin alpha-IIb light chain, form 2] | 1-31 | 137 | 1039 | ITGA2B GP2B ITGAB | 345, 553, 761, 969, 1177, 1385, 1593, 1801, 2009, 2217, 2425, 2633, 2841 |
| 221 | P00742 | FA10 | Coagulation factor X (EC 3.4.21.6) (Stuart factor) (Stuart-Prower factor) [Cleaved into: Factor X light chain; Factor X heavy chain; Activated factor Xa heavy chain] | 1-31 | 138 | 488 | F10 | 346, 554, 762, 970, 1178, 1386, 1594, 1802, 2010, 2218, 2426, 2634, 2842 |
| 222 | P26006 | ITA3 | Integrin alpha-3 (CD49 antigen-like family member C) (FRP-2) (Galactoprotein B3) (GAPB3) (VLA-3 subunit alpha) (CD antigen CD49c) [Cleaved into: Integrin alpha-3 heavy chain; Integrin alpha-3 light chain] | 1-32 | 139 | 1051 | ITGA3 MSK18 | 347, 555, 763, 971, 1179, 1387, 1595, 1803, 2011, 2219, 2427, 2635, 2843 |
| 223 | P13726 | TF | Tissue factor (TF) (Coagulation factor III) (Thromboplastin) (CD antigen CD142) | 1-32 | 140 | 295 | F3 | 348, 556, 764, 972, 1180, 1388, 1596, 1804, 2012, 2220, 2428, 2636, 2844 |
| 224 | P11912 | CD79A | B-cell antigen receptor complex-associated protein alpha chain (Ig-alpha) (MB-1 membrane glycoprotein) (Membrane-bound immunoglobulin-associated protein) (Surface IgM-associated protein) (CD antigen CD79a) | 1-32 | 141 | 226 | CD79A IGA MB1 | 349, 557, 765, 973, 1181, 1389, 1597, 1805, 2013, 2221, 2429, 2637, 2845 |
| 225 | Q9H6X2 | ANTR1 | Anthrax toxin receptor 1 (Tumor endothelial marker 8) | 1-32 | 142 | 564 | ANTXR1 ATR TEM8 | 350, 558, 766, 974, 1182, 1390, 1598, 1806, 2014, 2222, 2430, 2638, 2846 |
| 226 | Q8IWK6 | AGRA3 | Adhesion G protein-coupled receptor A3 (G-protein coupled receptor 125) | 1-33 | 143 | 1321 | ADGRA3 GPR125 UNQ556/PRO1113 | 351, 559, 767, 975, 1183, 1391, 1599, 1807, 2015, 2223, 2431, 2639, 2847 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 227 | P58335 | ANTR2 | Anthrax toxin receptor 2 (Capillary morphogenesis gene 2 protein) (CMG-2) | 1-33 | 144 | 489 | ANTXR2 CMG2 | 352, 560, 768, 976, 1184, 1392, 1600, 1808, 2016, 2224, 2432, 2640, 2848 |
| 228 | P06731 | CEAM5 | Carcinoembryonic antigen-related cell adhesion molecule 5 (Carcinoembryonic antigen) (CEA) (Meconium antigen 100) (CD antigen CD66e) | 1-34 | 145 | 702 | CEACAM5 CEA | 353, 561, 769, 977, 1185, 1393, 1601, 1809, 2017, 2225, 2433, 2641, 2849 |
| 229 | P33681 | CD80 | T-lymphocyte activation antigen CD80 (Activation B7-1 antigen) (BB1) (CTLA-4 counter-receptor B7.1) (B7) (CD antigen CD80) | 1-34 | 146 | 288 | CD80 CD28LG CD28LG1 LAB7 | 354, 562, 770, 978, 1186, 1394, 1602, 1810, 2018, 2226, 2434, 2642, 2850 |
| 230 | P38567 | HYALP | Hyaluronidase PH-20 (Hyal-PH20) (EC 3.2.1.35) (Hyaluronoglucosaminidase PH-20) (Sperm adhesion molecule 1) (Sperm surface protein PH-20) | 1-35 | 147 | 509 | SPAM1 HYAL3 PH20 | 355, 563, 771, 979, 1187, 1395, 1603, 1811, 2019, 2227, 2435, 2643, 2851 |
| 231 | P16410 | CTLA4 | Cytotoxic T-lymphocyte protein 4 (Cytotoxic T-lymphocyte-associated antigen 4) (CTLA-4) (CD antigen CD152) | 1-35 | 148 | 223 | CTLA4 CD152 | 356, 564, 772, 980, 1188, 1396, 1604, 1812, 2020, 2228, 2436, 2644, 2852 |
| 232 | P15814 | IGLL1 | Immunoglobulin lambda-like polypeptide 1 (CD179 antigen-like family member B) (Ig lambda-5) (Immunoglobulin omega polypeptide) (Immunoglobulin-related protein 14.1) (CD antigen CD179b) | 1-37 | 149 | 213 | IGLL1 IGL1 | 357, 565, 773, 981, 1189, 1397, 1605, 1813, 2021, 2229, 2437, 2645, 2853 |
| 233 | Q92956 | TNR14 | Tumor necrosis factor receptor superfamily member 14 (Herpes virus entry mediator A) (Herpesvirus entry mediator A) (HveA) (Tumor necrosis factor receptor-like 2) (1R2) (CD antigen CD270) | 1-38 | 150 | 283 | TNFRSF14 HVEA HVEM UNQ329/PRO509 | 358, 566, 774, 982, 1190, 1398, 1606, 1814, 2022, 2230, 2438, 2646, 2854 |

TABLE 4-continued

Signal peptides

| # | UniProt Identifier | Short Name | Protein names | Amino Acid position | SEQ ID NO (AA) | Full length | Gene names | SEQ ID NO: wt and optimized nucleic acid sequence |
|---|---|---|---|---|---|---|---|---|
| 234 | Q86VB7 | C163A | Scavenger receptor cysteine-rich type 1 protein M130 (Hemoglobin scavenger receptor) (CD antigen CD163) [Cleaved into: Soluble CD163 (sCD163)] | 1-41 | 151 | 1156 | CD163 M130 | 359, 567, 775, 983, 1191, 1399, 1607, 1815, 2023, 2231, 2439, 2647, 2855 |
| 235 | P08648 | ITA5 | Integrin alpha-5 (CD49 antigen-like family member E) (Fibronectin receptor subunit alpha) (Integrin alpha-F) (VLA-5) (CD antigen CD49e) [Cleaved into: Integrin alpha-5 heavy chain; Integrin alpha-5 light chain] | 1-41 | 152 | 1049 | ITGA5 FNRA | 360, 568, 776, 984, 1192, 1400, 1608, 1816, 2024, 2232, 2440, 2648, 2856 |
| 236 | P16109 | LYAM3 | P-selectin (CD62 antigen-like family member P) (Granule membrane protein 140) (GMP-140) (Leukocyte-endothelial cell adhesion molecule 3) (LECAM3) (Platelet activation dependent granule-external membrane protein) (PADGEM) (CD antigen CD62P) | 1-41 | 153 | 830 | SELP GMRP GRMP | 361, 569, 777, 985, 1193, 1401, 1609, 1817, 2025, 2233, 2441, 2649, 2857 |
| 237 | O75326 | SEM7A | Semaphorin-7A (CDw108) (JMH blood group antigen) (John-Milton-Hargen human blood group Ag) (Semaphorin-K1) (Sema K1) (Semaphorin-L) (Sema L) (CD antigen CD108) | 1-44 | 154 | 666 | SEMA7A CD108 SEMAL | 362, 570, 778, 986, 1194, 1402, 1610, 1818, 2026, 2234, 2442, 2650, 2858 |
| 238 | Q8N2Q7 | NLGN1 | Neuroligin-1 | 1-45 | 155 | 840 | NLGN1 KIAA1070 | 363, 571, 779, 987, 1195, 1403, 1611, 1819, 2027, 2235, 2443, 2651, 2859 |
| 239 | Q86UN3 | R4RL2 | Reticulon-4 receptor-like 2 (Nogo receptor-like 3) (Nogo-66 receptor homolog 1) (Nogo-66 receptor-related protein 2) (NgR2) | 1-46 | 156 | 420 | RTN4RL2 NGRH1 NGRL3 | 364, 572, 780, 988, 1196, 1404, 1612, 1820, 2028, 2236, 2444, 2652, 2860 |

Accordingly, in preferred embodiments, the artificial nucleic acid molecule, preferably RNA, of the invention may encode in its at least one coding region an amino acid sequence comprising or consisting of an amino acid sequence as defined by any one of SEQ ID NOs: 1-156, 76948-76951, or a (preferably functional) fragment, variant or derivative of any one of said sequences, preferably comprising or consisting of an amino acid sequence having at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

Accordingly, in preferred embodiments, the artificial nucleic acid molecule, preferably RNA, of the invention may comprise, in its at least one coding region, a nucleic acid sequence comprising or consisting of a nucleic acid sequence as defined by any one of SEQ ID NOs: 209-364, 417-572, 625-780, 833-988, 1041-1196, 1249-1404, 1457-1612, 1665-1820, 1873-2028, 2081-2236, 2289-2444, 2497-2652, 2705-2860, 76952-77003 or a (preferably functional) fragment, variant or derivative of any one of said sequences, preferably comprising or consisting of a nucleic acid sequence having at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any of these sequences.

Linker (L)

According to preferred embodiments, the at least one coding region of the artificial nucleic acid molecule according to the invention further encodes e. at least one linker.

The term "linker" preferably refers to peptide linkers, i.e. typically short (i.e. comprising 1-150 amino acids, preferably 1-50 amino acids, more preferably 1 to 20 amino acids), linear amino acid sequences connecting or linking two polypeptide sequences. Linkers according to the invention may be derived from any protein of human, animal, plant, bacterial or viral origin. Linkers according to the invention may be naturally occurring or artificial (i.e. synthetic or non-naturally occurring) linkers. Preferably, the linker(s) is/are non-immunogenic, i.e. do not trigger an immune response. Linkers may be employed to connect or link at least two components of the antigenic fusion protein encoded by the artificial nucleic acid molecule, preferably RNA, of the invention. The coding region of the artificial nucleic acid molecule according to the invention may encode at least one linker, or a plurality of at least 2, 3, 4, 5, 6, 7, 8, 9 or 10 identical or different linkers, as described herein. In case a plurality of linkers is encoded by the artificial nucleic acid molecule it is particularly preferred that the linkers differ in their amino acid sequence and/or nucleic acid sequence encoding the respective linkers.

Peptide linkers of interest are generally known in the art and may be classified into three types: flexible linkers, rigid linkers, and cleavable linkers. Flexible linkers are usually applied when the joined polypeptide sequences require a certain degree of movement or interaction. They are generally rich in small, non-polar (e.g. Gly) or polar (e.g. Ser or Thr) amino acids to provide good flexibility and solubility, and support the mobility of the connected polypeptide sequences. Exemplary flexible linker arm sequences typically contain about 4 to about 10 glycine residues. The incorporation of Ser or Thr may maintain the stability of the linker in aqueous solutions by forming hydrogen bonds with water molecules, and therefore reduces unfavorable interactions between the linker and the protein moieties.

The most commonly used flexible linkers have sequences consisting primarily of stretches of Gly and Ser residues ("GS" linker). An example of the most widely used flexible linker has the sequence of (Gly-Gly-Gly-Gly-Ser)$_n$. By adjusting the copy number "n", the length of this GS linker can be optimized to achieve appropriate separation of the protein domains, or to maintain necessary inter-domain interactions. Aside from GS linkers, many other flexible linkers are known in the art. These flexible linkers are also rich in small or polar amino acids such as Gly and Ser, but may contain additional amino acids such as Thr and Ala to maintain flexibility, as well as polar amino acids such as Lys and Glu to improve solubility. Rigid linkers may be employed to ensure separation of the joined polypeptide sequences and reduce interference or sterical hindrance. Cleavable linkers, on the other hand, can be introduced to release free functional domains in vivo. For instance, the cleavable linkers may be Arg-Arg or Lys-Lys that is sensitive to cleavage with an enzyme such as cathepsin or trypsin. Chen et al. Adv Drug Deliv Rev. 2013 Oct. 15; 65(10): 1357-1369 reviews the most commonly used peptide linkers and their applications, and is incorporated herein by reference in its entirety. Linkers of interest in the context of the present invention are inter alia disclosed in WO 2002/014478, WO 2001/008636, WO 2013/171505, WO 2008/017517 and WO 1997/047648, which are incorporated by reference in their entirety as well.

According to preferred embodiments, the artificial nucleic acid molecule, preferably RNA, of the invention encodes, in its at least one coding region, at least one linker, which is preferably a non-immunogenic linker, optionally comprising or consisting of an amino acid sequence selected from: SGGSGGSGG, RR, LL, GGGGSGGGGT, GGGGSGGGG, GPSL, GSTVAAPS, TVAAPSGS, GSTVAAPSGS, GGGGS, TVAAPS, GS, PAS, PAVPPP, TVSDVP, TGLDSP, HYGAEALERAG, AAY, AAAA, G, SG, GGS, GSG, SGG, GGG, GGGS, SGGG, GGGGSGS, GGGGSGGS, GGGGSGGGS, GGGGSGGGGSGGGGS, AKTTPKLEEGEFSEAR, AKTTPKLEEGEFSEARV, AKTTPKLGG, SAKTTPKLGG, AKTTPKLEEGEFSEARV, SAKTTP, SAKTTPKLGG, RADAAP, RADAAPTVS, RADAAAAGGPGS, RADAAAAGGGGS, SAKTTP, SAKTTPKLGG, SAKTTPKLEEGEFSEARV, ADAAP, ADAAPTVSIFPP, TVAAP, TVAAPSVFIFPP, QPKAAP, QPKAAPSVTLFPP, AKTTPP, AKTTPPSVTPLAP, AKTTAP, AKTTAPSVYPLAP, ASTKGP, ASTKGPSVFPLAP, GENKVEYAPALMALS, GPAKELTPLKEAKVS and GHEAAAVMQVQYPAS.

According to preferred embodiments, the artificial nucleic acid molecule, preferably RNA, of the invention encodes, in its at least one coding region, at least one linker, which is preferably a non-immunogenic linker, optionally comprising or consisting of an amino acid sequence according to any one of SEQ ID NOs: 2937, 76400-76418, 77018-77058. Accordingly, the artificial nucleic acid molecule, preferably RNA, of the invention preferably comprises, in its at least one coding region, a nucleic acid sequence comprising or consisting of a nucleic acid sequence according to any one of SEQ ID NOs: 2936, 76494, 76569, 76475-76493, 76550-76568, 77059-77061 or a (preferably functional) fragment, variant or derivative thereof, preferably comprising or consisting of a nucleic acid sequence having at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of said sequences.

T Helper Epitopes (TH)

The at least one coding region of the artificial nucleic acid molecule, preferably RNA, of the invention may preferably further encode f. at least one T helper epitope.

According to preferred embodiments, the nucleic acid sequence encoding said at least one T helper epitope may be fused (in frame) to a nucleic acid sequence encoding the at least one $IRST_{epm}$-derived amino acid sequence or the at least one antigenic peptide or protein. Therefore, expression of the artificial nucleic acid molecule, preferably RNA, of the invention may preferably result in a fusion protein comprising the at least one T helper epitope joined to (optionally via appropriate peptide linkers) said $IRST_{epm}$-derived amino acid sequence and/or said antigenic protein or peptide. The expressed antigenic fusion protein is processed and its fragments (including the T helper epitopes) are loaded onto MHC molecules, where they are presented to and recognized by antigen-specific T cells.

The artificial nucleic acid molecule according to the invention may encode in its at least one coding region one or a plurality of two or more T helper epitopes. Generally, the present invention envisages the combination of any of the T helper epitopes described herein with any of the antigenic peptides or proteins, any of the $IRST_{epm}$-derived additional amino acid sequences, any of the linkers, and any of the signal peptides, in any suitable order, in the antigenic fusion proteins encoded by the artificial nucleic acid molecules, preferably RNAs, of the invention.

The term "T helper epitope" refers to an antigenic determinant capable of binding to MHC moelcules, preferably MHC Class II molecules, thereby being recognized by $CD4^+$ T helper (Th) cells. Preferably, such T helper epitopes induce or enhance $CD4^+$ Th cell activation, differentiation, and/or proliferation (commonly referred to as "$CD4^+$ Th cell responses"). Activated $CD4^+$ Th cells are may preferably (1) (directly or indirectly) induce or enhance cytotoxic T lymphocyte (CTL) differentiation, and/or proliferation ("CTL responses"), and/or (2) (directly or indirectly) induce or enhance antibody-producing plasma cell differentiation, and/or proliferation ("B cell responses"). In this respect, "directly or indirectly" means that activated $CD4^+$ Th cells may induce or enhance the respective immune responses either via direct interaction with target cells or precursors thereof (e.g. B cells) or indirectly via interacting with other cells (e.g. dendritic cells) that in turn directly interact with target cells or precursors thereof (e.g. nafve $CD8^+$ T cells).

Thus, T helper epitopes may advantageously be used to induce or enhance $CD4^+$ Th cell responses, CTL responses (preferably including increased cell-mediated immunity and enhanced, e.g., anti-tumor or anti-viral immune responses) and/or to induce or enhance B cell responses (preferably including increased antibody production and enhanced, e.g., anti-bacterial immune responses) to the antigenic peptide or protein encoded by the artificial nucleic acid molecule, preferably RNA, of the invention.

T helper epitopes according to the invention may be derived from any protein of human, animal, plant, bacterial or viral origin. T helper epitopes according to the invention may be naturally occurring or artificial (i.e. synthetic or non-naturally occurring) epitopes. It may be preferred to employ generic T helper cell epitopes, i.e. promiscuous or permissive (generic) T helper epitopes, which are capable of interacting with a majority of MHC class II haplotypes, and thus preferably induce or enhance $T_h$ cell responses, CTL responses or B cell responses in the majority of the human or other mammalian populations.

In the context of the present invention, preferred T helper epitopes include the T helper epitopes disclosed in WO 2001/062284, WO 2010/023247, WO 2004/058297, WO 2004/000873 and WO 2006/113792.

Particularly preferred T helper cell epitopes in the context of the present invention include naturally occurring or artificial T helper epitopes derived from PADRE; Hepatitis C virus (Core); Hepatitis C virus (E1); Hepatitis C virus (E2); Hepatitis C virus (NS2); Hepatitis C virus (NS3); Hepatitis C virus (NS4); Hepatitis C virus (NS4a); Hepatitis C virus (NS4b); Hepatitis C virus (NS5a); Hepatitis C virus (NS5b); Influenza A; Measles virus (F protein); Canine distemper virus (Fusion protein); Mucin-1; foot-and-mouth disease virus (VP3); foot-and-mouth disease virus; *Clostridium tetani*); Human immunodeficiency virus 1 (gp120 protein); Human immunodeficiency virus 1 (gag protein); Human immunodeficiency virus 1 (envelope glycoprotein); Tetanus Toxid; Human papilloma virus 16 (E17); Diphtheria toxoid; *P. falciparum* (CS) or a functional fragment, variant or derivative thereof.

"PADRE" (pan DR epitope peptides") as described in WO 95/07707 and in Alexander J et al., 1994, Immunity 1: 751-761, with or without carrying D-amino acids in the C- and N-termini, are preferred T helper epitopes in the context of the present invention.

According to preferred embodiments, the artificial nucleic acid molecule, preferably RNA, of the invention encodes, in its at least one coding region, at least one T helper epitope comprising or consisting of an amino acid sequence according to any one of SEQ ID NOs: 3083-3294, or a (preferably functional) fragment, variant or derivative of any one of said sequences, preferably comprising or consisting of an amino acid sequence having at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of said sequences.

Accordingly, the artificial nucleic acid molecule, preferably RNA, of the invention preferably comprises, in its at least one coding region, a nucleic acid sequence comprising or consisting of a nucleic acid sequence according to any one of SEQ ID Nos: 3295-3506, 3507-3718, or a (preferably functional) fragment, variant or derivative of any one of said sequences, preferably comprising or consisting of a nucleic acid sequence having at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of said sequences.

Antiqenic Fusion Proteins

As indicated above, the artificial nucleic acid molecules, preferably RNAs, of the invention may encode, in their at least one encoding region, at least one antigenic fusion protein as defined herein. Said antigenic fusion protein may preferably be expressed (in particular translated) in the cytoplasm of recipient host cells, processed into fragments and loaded onto MHC class I and preferably also MHC class II molecules. The different components of the antigenic fusion protein each preferably fulfil a different functional role. Presentation of antigens/epitopes typically requires degradation of the antigenic fusion protein in the endosomal lysosomal compartment. The $IRST_{epm}$-derived additional amino acid sequence (in particular TM and optionally CD domains) preferably direct trafficking of the fused antigenic peptides or proteins to the plasma membrane, and via recycling to desired MHC processing compartments, where they are degraded and loaded onto MHC class I and in particular also MHC class II molecules for presentation to antigen-specific T cells. T helper epitopes preferably enhance the T helper cell response. Without wishing to be bound by specific theory, it is thought that $CD4^+$ T cell help is critical for effective induction of CTL responses and anti-tumor immunity. Preferably, the unique design of the inventive artificial nucleic acid molecules, preferably RNAs, provide for simultaneous MHC I and MHC II presentation, and achieves both $CD4'$ and $CD8^+$ T cell responses, resulting in increased overall immune responses and an enhanced therapeutic/prophylactic effect.

According to preferred embodiments, the artificial nucleic acid molecule, preferably RNA, of the invention comprises at least one coding region of the following Formula (I), preferably in 5'-3' direction:

$$-(SIG)_a-(L)_b-[(AN)_c-(L)_d]_e-[(TH)_m-(L)_n]_o-(TMD/TMCD)_p- \quad (I)$$

wherein

"SIG" encodes a signal peptide, preferably as defined elsewhere herein,

"L" encodes a linker sequence, preferably as defined elsewhere herein,

"AN" encodes each independently an antigenic peptide or protein, preferably as defined elsewhere herein, "TH" encodes a T helper epitope, preferably as defined elsewhere herein, "TMD/TMCD" encodes an amino acid sequence derived from an immune response signal transduction protein located in the external plasma membrane, preferably a transmembrane domain, preferably as defined elsewhere herein, and optionally a cytoplasmic domain, b, d, m, n, o is each independently an integer selected from 0, 1, 2, 3, 4, 5, 6, 7, 8, 9, and 10, a, c, e, p is each independently an integer selected from 1, 2, 3, 4, 5, 6, 7, 8, 9 and 10.

Preferably, a, e, and p may be 1—i.e., the artificial nucleic acid molecule, preferably RNA, of the invention encodes in its at least one coding region a signal peptide, as defined elsewhere herein, connected (optionally via a suitable peptide linker as defined elsewhere) herein to an antigenic peptide or protein as defined elsewhere herein, which is (optionally via a suitable peptide linker as defined elsewhere herein) connected to an $IRST_{epm}$-derived transmembrane domain (optionally connected to cytoplasmic domain) as defined elsewhere herein. More preferably, a b, c, d, e, m, n, o and p may each be 1, i.e. the coding region of the artificial nucleic acid molecule, preferably RNA, of the invention encodes one of each of the components described herein. The individual components of the antigenic fusion protein (SIG, L, AN, TH, TMD/TMCD) may be arranged (and thus encoded) in any suitable order.

RNAs

The inventive artificial nucleic acid molecule may preferably be an RNA. It will be understood that the term "RNA" refers to ribonucleic acid molecules characterized by the specific succession of their nucleotides joined to form said molecules (i.e. their RNA sequence). The term "RNA" may thus be used to refer to RNA molecules or RNA sequences as will be readily understood by the skilled person in the respective context. For instance, the term "RNA" as used in the context of the invention preferably refers to an RNA molecule (said molecule being characterized, inter alia, by its particular RNA sequence). The term "RNA" in the context of sequence modifications will be understood to relate to modified RNA sequences, but typically also includes the resulting RNA molecules (which are modified with regard to their RNA sequence).

In preferred embodiments, the RNA may be an mRNA, a viral RNA or a replicon RNA, preferably an mRNA.

In embodiments, the artificial RNA is a circular RNA. As used herein, "circular RNA" or "circRNA" has to be understood as a circular polynucleotide that can encode at least one antigenic peptide or protein as defined herein. E.g., said circular RNA may comprise at least one coding sequence encoding at least one antigenic peptide or protein derived from LASV or a fragment or variant thereof. Further, said circRNA may comprise at least one 3'-UTR and/or 5'-UTR as defined herein. The production of circRNAs can be performed using various methods provided in the art. E.g., U.S. Pat. No. 6,210,931 teaches a method of synthesizing circRNAs by inserting DNA fragments into a plasmid containing sequences having the capability of spontaneous cleavage and self-circularization. U.S. Pat. No. 5,773,244 teaches producing circRNAs by making a DNA construct encoding an RNA cyclase ribozyme, expressing the DNA construct as RNA, and then allowing the RNA to self-splice, which produces a circRNA free from intron in vitro. WO1992/001813 teaches a process of making single strand circular nucleic acids by synthesizing a linear polynucleotide, combining the linear nucleotide with a complementary linking oligonucleotide under hybridization conditions, and ligating the linear polynucleotide. The person skilled in the art may also use methods provided in WO2015/034925 or WO2016/011222 to produce circular RNA. Accordingly, methods for producing circular RNA as provided in U.S. Pat. Nos. 6,210,931, 5,773,244, WO1992/001813, WO2015/034925 and WO2016/011222 may suitably be used to generate the artificial RNA, i.e. the circRNA of the invention.

In embodiments, the artificial RNA is a replicon RNA. The term "replicon RNA" will be recognized and understood by the person of ordinary skill in the art, and is e.g. intended to be an optimized self-replicating artificial RNA. Such constructs may include replication elements (replicase) derived from e.g. alphaviruses and the substitution of the structural virus proteins with the artificial nucleic acid of interest. Alternatively, the replicase may be provided on an independent nucleic acid construct comprising a replicase sequence derived from e.g. Semliki forest virus (SFV), Sindbis virus (SIN), Venezuelan equine Encephalitis virus (VEE), Ross-River virus (RRV), or other viruses belonging to the alphavirus family. Downstream of the replicase may be a sub-genomic promoter that controls replication of the artificial RNA of the first aspect.

In particularly preferred embodiments the artificial nucleic acid of the present invention is an RNA, more preferably an mRNA.

The term "mRNA" (abbreviation of "messenger RNA") will be recognized and understood by the person of ordinary skill in the art, and is e.g. intended to be a ribonucleic acid molecule, i.e. a polymer consisting of nucleotides. These nucleotides are usually connected to each other along a so-called backbone. The backbone is formed by phosphodiester bonds between the sugar, i.e. ribose, of a first and a phosphate moiety of a second, adjacent monomer.

The specific succession of the monomers is called the RNA-sequence. The mRNA usually provides the coding sequence that is translated into an amino-acid sequence of a particular peptide or protein. Typically, an mRNA comprises a 5' cap structure, UTR elements, and a 3' poly(A)sequence.

The artificial RNA, preferably the mRNA of the invention may be prepared using any method known in the art, including chemical synthesis such as e.g. solid phase RNA synthesis, as well as in vitro methods, such as RNA in vitro transcription reactions.

In a preferred embodiment, the artificial RNA, preferably the mRNA is obtained by RNA in vitro transcription.

Accordingly, the RNA of the invention is an in vitro transcribed RNA, preferably an in vitro-transcribed mRNA.

Mono-, Bi- or Multicistronic RNAs

The artificial nucleic acid molecule, preferably RNA, may be mono-, bi-, or multicistronic, preferably as defined herein. "Bi- or multicistronic" RNAs typically comprise two (bicistronic) or more (multicistronic) open reading frames (ORF). An "open reading frame" is a sequence of codons that is translatable into a peptide or protein.

The ORFs in a bi- or multicistronic artificial nucleic acid molecule, may be identical or different from each other. "Identical" ORFs share a % sequence identity of 100%, and encode identical antigenic fusion proteins, whereas "different" ORFs share a % sequence identity of less than 100%, such as 99% or less, 90% or less, 80% or less, 70% or less, 60% or less, 50% or less, 40% or less, 30% or less, 20% or less, 10% or less, 5% or less, or 2% or less, and encode identical (due to the degeneracy of the genetic code) or different antigenic fusion proteins.

It may be preferred that "bi- or multicistronic" artificial nucleic acid molecules, preferably RNAs, encode different antigenic fusion proteins. For example, bi- or even multicistronic artificial nucleic acid molecules, preferably RNAs, may each encode, for example, at least two, three, four, five, six or more (preferably different) antigenic fusion proteins as defined herein.

The ORFs in a bi- or multicistronic artificial nucleic acid molecule, preferably RNA, encoding two or more (identical or different) antigenic fusion proteins as defined herein, may be separated by at least one IRES (internal ribosomal entry site) sequence. The term "IRES" (internal ribosomal entry site) refers to an RNA sequence that allows for translation initiation. An IRES can function as a sole ribosome binding site, but it can also serve to provide a bi- or even multicistronic artificial nucleic acid molecule, preferably RNA as defined above, which encodes several (identical or different) antigenic fusion proteins, which are to be translated by the ribosomes independently of one another.

Examples of IRES sequences, which can be used according to the invention, are those derived from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SIV) or cricket paralysis viruses (CrPV).

Preferably, the artificial nucleic acid molecule, preferably RNA, comprises a length of about 50 to about 20000, or 100 to about 20000 nucleotides, preferably of about 250 to about 20000 nucleotides, more preferably of about 500 to about 10000, even more preferably of about 500 to about 5000.

The artificial nucleic acid molecule, preferably RNA, of the invention may further be single stranded or double stranded. When provided as a double stranded RNA, the artificial nucleic acid molecule preferably comprises a sense and a corresponding antisense strand.

Nucleic Acid Modifications

Artificial nucleic acid molecules, preferably RNAs, of the invention, may be provided in the form of modified nucleic acids. Suitable nucleic acid modifications envisaged in the context of the present invention are described below.

Preferably, the at least one artificial nucleic acid molecule, preferably RNA (sequence) of the invention, is modified as defined herein. A "modification" as defined herein preferably leads to a stabilization of said artificial nucleic acid molecule, preferably RNA. More preferably, the invention thus provides a "stabilized" artificial nucleic acid molecule, preferably RNA.

Preferably, the artificial nucleic acid molecule, preferably RNA, of the invention may thus be provided as a "stabilized" artificial nucleic acid molecule, preferably RNA, in particular mRNA, i.e. which is essentially resistant to in vivo degradation (e.g. by an exo- or endo-nuclease).

Such stabilization can be achieved, for example, by a modified phosphate backbone of the artificial nucleic acid molecule, preferably RNA. A backbone modification in connection with the present invention is a modification in which phosphates of the backbone of the nucleotides contained in said artificial nucleic acid molecule, preferably RNA, are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized artificial nucleic acid molecule, preferably RNAs, may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the artificial nucleic acid molecule, preferably RNA, of the invention.

Chemical Modifications

The term "modification" as used herein may refer to chemical modifications comprising backbone modifications as well as sugar modifications or base modifications.

In this context, a "modified" artificial nucleic acid molecule, preferably RNA, may contain nucleotide analogues/modifications (modified nucleotides or nucleosides), e.g. backbone modifications, sugar modifications or base modifications.

A backbone modification in connection with the present invention is a modification, in which phosphates of the backbone of the nucleotides contained in said artificial nucleic acid molecule, preferably RNA herein are chemically modified. A sugar modification in connection with the present invention is a chemical modification of the sugar of the nucleotides of the artificial nucleic acid molecule, preferably RNA. Furthermore, a base modification in connection with the present invention is a chemical modification of the base moiety of the nucleotides of the artificial nucleic acid molecule, preferably RNA. In this context, nucleotide analogues or modifications are preferably selected from nucleotide analogues, which are applicable for transcription and/or translation.

Sugar Modifications:

(Chemically) modified nucleic acids, in particular artificial nucleic acid molecules according to the invention, may comprise sugar modifications, i.e., nucleosides/nucleotides that are modified in their sugar moiety.

For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O($CH_2CH_2O$)n$CH_2CH_2OR$; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. $NH_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified artificial nucleic acid molecule, preferably RNA can include nucleotides containing, for instance, arabinose as the sugar.

Backbone Modifications:

(Chemically) modified nucleic acids, in particular artificial nucleic acid molecules according to the invention, may comprise backbone modifications, i.e., nucleosides/nucleotides that are modified in their phosphate backbone.

The phosphate groups of the backbone can be modified by replacing one or more of the oxygen atoms with a different substituent. Further, the modified nucleosides and nucleotides can include the full replacement of an unmodified phosphate moiety with a modified phosphate as described herein.

Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

(Chemically) modified nucleic acids, in particular artificial nucleic acid molecules according to the invention, may comprise (nucleo-)base modifications, i.e., nucleosides/ nucleotides that are modified in their nucleobase moiety.

Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

The artificial nucleic acid molecule, preferably RNA, of the invention may comprise modified nucleosides selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, 06-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate, or combinations thereof.

The artificial nucleic acid molecule, preferably RNA, of the invention may comprise modified nucleosides selected from pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine, or combinations thereof.

The artificial nucleic acid molecule, preferably RNA, of the invention may comprise modified nucleosides selected from 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine, or combinations thereof.

The artificial nucleic acid molecule, preferably RNA, of the invention may comprise modified nucleosides selected from 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, or combinations thereof.

The artificial nucleic acid molecule, preferably RNA, of the invention may comprise modified nucleosides selected from inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, or combinations thereof.

The artificial nucleic acid molecule, preferably RNA, of the invention may comprise nucleotides modified on the major groove face, e.g. by replacing hydrogen on C-5 of uracil with a methyl group or a halo group, optionally selected from 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

The artificial nucleic acid molecule, preferably RNA, of the invention may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Alternatively, a "modified" artificial nucleic acid molecule, preferably RNA, may comprise none of the chemical modifications (or any other of chemical modification) described herein. Such modified artificial nucleic acids, may nevertheless comprise a lipid modification or a sequence modification as described below.

Lipid Modifications

Artificial nucleic acid molecules, preferably RNAs, of the invention may preferably contain at least one lipid modification. Such a lipid-modified artificial nucleic acid molecule, preferably RNA of the invention typically comprises (i) an artificial nucleic acid molecule, preferably RNA as defined herein, (ii) at least one linker covalently linked with said artificial nucleic acid molecule, preferably RNA, and (iii) at least one lipid covalently linked with the respective linker.

Alternatively, the lipid-modified artificial nucleic acid molecule, preferably RNA comprises at least one artificial nucleic acid molecule, preferably RNA and at least one (bifunctional) lipid covalently linked (without a linker) with said artificial nucleic acid molecule, preferably RNA.

Alternatively, the lipid-modified artificial nucleic acid molecule, preferably RNA, comprises (i) an artificial nucleic acid molecule, preferably RNA, (ii) at least one linker covalently linked with said artificial nucleic acid molecule, preferably RNA, and (iii) at least one lipid covalently linked with the respective linker, and also (iv) at least one (bifunctional) lipid covalently linked (without a linker) with said artificial nucleic acid molecule, preferably RNA.

In this context, it is particularly preferred that the lipid modification is present at the terminal ends of a linear artificial nucleic acid molecule, preferably RNA.

Sequence Modifications

According to preferred embodiments, the artificial nucleic acid molecule, preferably RNA, of the invention may be "sequence-modified", i.e. may comprise at least one sequence modification as described below. Without wishing to be bound by specific theory, such sequence modifications may increase stability and/or enhance expression of the inventive artificial nucleic acid molecules, preferably RNAs.

G/C Content Modification

According to preferred embodiments, the artificial nucleic acid molecule, preferably RNA, more preferably mRNA, of the invention, may be modified, and thus stabilized, by modifying its guanosine/cytosine (G/C) content, preferably by modifying the G/C content of the at least one coding sequence. In other words, the artificial nucleic acid molecule, preferably RNA, of the invention and preferably its sequence may be G/C modified.

A "G/C-modified" nucleic acid (preferably RNA) sequence typically refers to a nucleic acid (preferably RNA) comprising a nucleic acid (preferably RNA) sequence that is based on a modified wild-type nucleic acid (preferably RNA) sequence and comprises an altered number of guanosine and/or cytosine nucleotides as compared to said wild-type nucleic acid (preferably RNA) sequence. Such an altered number of G/C nucleotides may be generated by substituting codons containing adenosine or thymidine nucleotides by "synonymous" codons containing guanosine or cytosine nucleotides. Accordingly, the codon substitutions preferably do not alter the encoded amino acid residues, but exclusively alter the G/C content of the nucleic acid (preferably RNA).

In preferred embodiments, the G/C content of the coding sequence of the artificial nucleic acid molecule, preferably RNA, of the invention is modified, particularly increased, compared to the G/C content of the coding sequence of the respective wild-type, i.e. unmodified nucleic acid. The amino acid sequence encoded by the inventive artificial nucleic acid molecule, preferably RNA is preferably not modified as compared to the amino acid sequence encoded by the respective wild-type nucleic acid, preferably RNA.

Such modification of the inventive artificial nucleic acid molecule, preferably RNA is based on the fact that the sequence of any RNA region to be translated is important for efficient translation of said RNA. Thus, the composition of the RNA and the sequence of various nucleotides are important. In particular, sequences having an increased G (guanosine)/C (cytosine) content are more stable than sequences having an increased A (adenosine)/U (uracil) content.

According to the invention, the codons of the inventive artificial nucleic acid molecule, preferably RNA, may therefore preferably be varied compared to the respective wild-type nucleic acid, preferably RNA, while retaining the translated amino acid sequence, such that they include an increased amount of G/C nucleotides.

In respect to the fact that several codons code for one and the same amino acid (so-called degeneration of the genetic code), the most favourable codons for the stability can be determined (so-called alternative codon usage). Depending on the amino acid to be encoded by the inventive artificial nucleic acid molecule, preferably RNA, there are various possibilities for modification its nucleic acid sequence, compared to its wild-type sequence. In the case of amino acids, which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gin can be modified from CAA to CAG; the codons for lie can be modified from AUU or AUA to AUC; the codons for Thr can be modified from ACU or ACA to ACC or ACG; the codon for Asn can be modified from AAU to AAC; the codon for Lys can be modified from AAA to AAG; the codons for Val can be modified from GUU or GUA to GUC or GUG; the codon for Asp can be modified from GAU to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the inventive artificial nucleic acid sequence, preferably RNA sequence (or any other nucleic acid sequence as defined herein) compared to its particular wild-type nucleic acid sequence (i.e. the original sequence). Thus, for example, all codons for Thr occurring in the wild-type sequence can be modified to ACC (or ACG). Preferably, however, for example, combinations of the above substitution possibilities are used:

substitution of all codons coding for Thr in the original sequence (wild-type RNA) to ACC (or ACG) and substitution of all codons originally coding for Ser to UCC (or UCG or AGC); substitution of all codons coding for Ile in the original sequence to AUC and substitution of all codons originally coding for Lys to AAG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Gly to GGC (or GGG) and substitution of all codons originally coding for Asn to AAC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gin to CAG and substitution of all codons originally coding for Pro to CCC (or CCG); etc.

Preferably, the G/C content of the coding sequence of the artificial nucleic acid molecule, preferably RNA, of the invention is increased by at least 7%, more preferably by at least 15%, particularly preferably by at least 20%, compared to the G/C content of the coding sequence of the respective wild-type nucleic acid, preferably RNA.

According to preferred embodiments, at least 5%, 10%, 20%, 30%, 40%, 50%, 60%, more preferably at least 70%, even more preferably at least 80% and most preferably at least 90%, 95% or even 100% of the substitutable codons in the coding region or the whole sequence of the wild type RNA sequence are substituted, thereby increasing the G/C content of said sequence.

In this context, it is particularly preferable to increase the G/C content of the artificial nucleic acid molecule, preferably RNA, of the invention, preferably of its at least one coding sequence, to the maximum (i.e. 100% of the substitutable codons) as compared to respective the wild-type nucleic acid, preferably RNA, sequence.

According to a preferred embodiment, the present invention provides a nucleic acid sequence, preferably RNA, comprising at least one coding sequence comprising or consisting of any one of the RNA sequences according to SEQ ID NOs: 417-624, 2915, 2916, 2932, 2935, 76671-76693, 76956-76959, 1249-1456, 76763-76785, 76972-76975, 1457-1664, 76786-76808, 76976-76979, 1665-1872, 76809-76831, 76980-76983, 1873-2080, 76832-76854, 76984-76987, 2081-2288, 76855-76877, 76988-76991, 2289-2496, 76878-76900, 76992-76995, 2497-2704, 76901-76923, 76996-76999, 2705-2912, 76924-76946, 77000-77003, 76947, 77004-77017, 77059-77061, 77066 or of a fragment or variant of any one of these sequences.

Substitution of Rare Codons

A further preferred modification of the artificial nucleic acid molecule, preferably RNA, of the invention is based on the finding that the translation efficiency is also determined by a different frequency in the occurrence of tRNAs in cells. Thus, if so-called "rare codons" are present in the artificial nucleic acid molecule, preferably RNA, of the invention to an increased extent, the corresponding modified RNA sequence is translated to a significantly poorer degree than in the case where codons coding for relatively "frequent" tRNAs are present.

In some preferred embodiments, in modified artificial nucleic acid molecule, preferably RNAs defined herein, the region which codes for a protein is modified compared to the corresponding region of the wild-type nucleic acid, preferably RNA, such that at least one codon of the wild-type sequence, which codes for a tRNA which is relatively rare in the cell, is exchanged for a codon, which codes for a tRNA which is relatively frequent in the cell and carries the same amino acid as the relatively rare tRNA.

Thereby, the sequences of the artificial nucleic acid molecule, preferably RNA, of the invention is modified such that codons for which frequently occurring tRNAs are available are inserted. In other words, according to the invention, by this modification all codons of the wild-type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons, which use for the particular amino acid the tRNA which occurs the most frequently, e.g. the Gly codon, which uses the tRNA, which occurs the most frequently in the (human) cell, are particularly preferred.

According to the invention, it is particularly preferable to link the sequential G/C content which is increased, in particular maximized, in the modified artificial nucleic acid molecule, preferably RNA, of the invention with the "frequent" codons without modifying the encoded amino acid sequence encoded by the coding sequence of said artificial nucleic acid molecule, preferably RNA. Such preferred embodiments allow the provision of a particularly efficiently translated and stabilized (modified) artificial nucleic acid molecule, preferably RNA (or any other nucleic acid as defined herein).

The determination of a modified artificial nucleic acid molecule, preferably RNA as described above (increased G/C content; exchange of tRNAs) can be carried out using the computer program explained in WO 02/098443, the disclosure content of which is included in its full scope in the present invention. Using this computer program, the nucleotide sequence of any desired nucleic acid, in particular RNA, can be modified with the aid of the genetic code or the degenerative nature thereof such that a maximum G/C content results, in combination with the use of codons which code for tRNAs occurring as frequently as possible in the cell, the amino acid sequence coded by the modified nucleic acid, in particular RNA, preferably not being modified compared to the non-modified sequence.

Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443.

A/U Content Modification

Preferably, the A/U content in the environment of the ribosome binding site of the artificial nucleic acid molecule, preferably RNA, of the invention is increased compared to the A/U content in the environment of the ribosome binding site of its respective wild-type nucleic acid, preferably RNA.

This modification (an increased A/U content around the ribosome binding site) increases the efficiency of ribosome binding to said artificial nucleic acid molecule, preferably RNA. An effective binding of the ribosomes to the ribosome binding site (Kozak sequence, SEQ ID NO: 3081) in turn has the effect of an efficient translation of the artificial nucleic acid molecule, preferably RNA.

DSE Modifications

Preferably, the artificial nucleic acid molecule, preferably RNA, of the invention may be modified with respect to potentially destabilizing sequence elements. Particularly, the coding sequence and/or the 5' and/or 3' untranslated region of said artificial nucleic acid molecule, preferably RNA may be modified compared to the respective wild-type nucleic acid, preferably RNA (or said other wild-type nucleic acid) such that it contains no destabilizing sequence elements, the encoded amino acid sequence of the modified artificial nucleic acid molecule, preferably RNA preferably not being modified compared to its respective wild-type nucleic acid, preferably RNA (or said other wild-type nucleic acid).

It is known that, for example in sequences of eukaryotic RNAs, destabilizing sequence elements (DSE) occur, to which signal proteins bind and regulate enzymatic degradation of RNA in vivo. For further stabilization of the modified artificial nucleic acid molecule, preferably RNA, optionally in its at least one coding region, one or more such modifications compared to the corresponding region of the wild-type nucleic acid, preferably RNA, can therefore be carried out, so that no or substantially no destabilizing sequence elements are contained there.

According to the invention, DSE present in the untranslated regions (3'- and/or 5'-UTR) can also be eliminated from the artificial nucleic acid molecule, preferably RNA by such modifications. Such destabilizing sequences are e.g. AU-rich sequences (AURES), which occur in 3'-UTR sections of numerous unstable RNAs (Caput et al., Proc. Natl. Acad. Sci. USA 1986, 83: 1670 to 1674). The artificial nucleic acid molecule, preferably RNA, of the invention is therefore preferably modified compared to the respective wild-type nucleic acid, preferably RNA (or said respective other wild-type nucleic acid) such that said artificial nucleic acid molecule, preferably RNA, contains no such destabilizing sequences. This also applies to those sequence motifs, which are recognized by possible endonucleases, e.g. the sequence GAACAAG, which is contained in the 3'-UTR segment of the gene encoding the transferrin receptor (Binder et al., EMBO J. 1994, 13: 1969 to 1980). These sequence motifs are also preferably removed from said artificial nucleic acid molecule, preferably RNA.

Sequences Adapted to Human Codon Usage:

A further preferred modification of the artificial nucleic acid molecule, preferably RNA, of the invention is based on the finding that codons encoding the same amino acid typically occur at different frequencies. According to further preferred embodiments, in the modified artificial nucleic acid molecule, preferably RNA, the coding sequence is modified compared to the corresponding region of the respective wild-type nucleic acid, preferably RNA such that the frequency of the codons encoding the same amino acid corresponds to the naturally occurring frequency of that codon according to the human codon usage as e.g. shown in Table 5.

For example, in the case of the amino acid alanine (Ala) present in an amino acid sequence encoded by the at least one coding sequence of the artificial nucleic acid molecule, preferably RNA, of the invention, the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 5).

TABLE 5

Human codon usage table

| Amino acid | codon | fraction | /1000 |
| --- | --- | --- | --- |
| Ala | GCG | 0.10 | 7.4 |
| Ala | GCA | 0.22 | 15.8 |
| Ala | GCT | 0.28 | 18.5 |
| Ala | GCC* | 0.40 | 27.7 |
| Cys | TGT | 0.42 | 10.6 |
| Cys | TGC* | 0.58 | 12.6 |

TABLE 5-continued

Human codon usage table

| Amino acid | codon | fraction | /1000 |
|---|---|---|---|
| Asp | GAT | 0.44 | 21.8 |
| Asp | GAC* | 0.56 | 25.1 |
| Glu | GAG* | 0.59 | 39.6 |
| Glu | GAA | 0.41 | 29.0 |
| Phe | ITT | 0.43 | 17.6 |
| Phe | TTC* | 0.57 | 20.3 |
| Gly | GGG | 0.23 | 16.5 |
| Gly | GGA | 0.26 | 16.5 |
| Gly | GGT | 0.18 | 10.8 |
| Gly | GGC* | 0.33 | 22.2 |
| His | CAT | 0.41 | 10.9 |
| His | CAC* | 0.59 | 15.1 |
| Ile | ATA | 0.14 | 7.5 |
| Ile | ATT | 0.35 | 16.0 |
| Ile | ATC* | 0.52 | 20.8 |
| Lys | AAG* | 0.60 | 31.9 |
| Lys | AAA | 0.40 | 24.4 |
| Leu | TTG | 0.12 | 12.9 |
| Leu | TTA | 0.06 | 7.7 |
| Leu | CTG* | 0.43 | 39.6 |
| Leu | CTA | 0.07 | 7.2 |
| Leu | CTT | 0.12 | 13.2 |
| Leu | CTC | 0.20 | 19.6 |
| Met | ATG* | 1 | 22.0 |
| Asn | AAT | 0.44 | 17.0 |
| Asn | AAC* | 0.56 | 19.1 |
| Pro | CCG | 0.11 | 6.9 |
| Pro | CCA | 0.27 | 16.9 |
| Pro | CCT | 0.29 | 17.5 |
| Pro | CCC* | 0.33 | 19.8 |
| Gln | CAG* | 0.73 | 34.2 |
| Gln | CAA | 0.27 | 12.3 |
| Arg | AGG | 0.22 | 12.0 |
| Arg | AGA* | 0.21 | 12.1 |
| Arg | CGG | 0.19 | 11.4 |
| Arg | CGA | 0.10 | 6.2 |
| Arg | CGT | 0.09 | 4.5 |
| Arg | CGC | 0.19 | 10.4 |
| Ser | AGT | 0.14 | 12.1 |
| Ser | AGC* | 0.25 | 19.5 |
| Ser | TCG | 0.06 | 4.4 |
| Ser | TCA | 0.15 | 12.2 |
| Ser | TCT | 0.18 | 15.2 |
| Ser | TCC | 0.23 | 17.7 |
| Thr | ACG | 0.12 | 6.1 |
| Thr | ACA | 0.27 | 15.1 |
| Thr | ACT | 0.23 | 13.1 |
| Thr | ACC* | 0.38 | 18.9 |
| Val | GTG* | 0.48 | 28.1 |
| Val | GTA | 0.10 | 7.1 |
| Val | GTT | 0.17 | 11.0 |
| Val | GTC | 0.25 | 14.5 |
| Trp | TGG* | 1 | 13.2 |
| Tyr | TAT | 0.42 | 12.2 |
| Tyr | TAC* | 0.58 | 15.3 |
| Stop | TGA* | 0.61 | 1.6 |
| Stop | TAG | 0.17 | 0.8 |
| Stop | TAA | 0.22 | 1.0 |

*most frequent codon

According to a preferred embodiment, the present invention provides a nucleic acid sequence, preferably RNA, most preferably mRNA, comprising at least one coding sequence comprising or consisting of any one of the RNA sequences according to SEQ ID NOs: 833-1040, 76717-76739, 76964-76967, or of a fragment or variant of any one of these sequences.

Codon-Optimized Sequences:

As described above, preferably all codons of the wild-type sequence which code for a tRNA, which is relatively rare in the cell, may be exchanged for a codon which codes for a tRNA, which is relatively frequent in the cell and which, in each case, carries the same amino acid as the relatively rare tRNA.

Therefore, it is particularly preferred that the most frequent codons are used for each encoded amino acid (see Table 5, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or "CAI increased" and/or "maximized" sequences.

Preferably, the artificial nucleic acid molecule, preferably RNA, of the invention may comprise at least one coding sequence, wherein the coding sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence may be 1.

For example, in the case of the amino acid alanine (Ala) present in the amino acid sequence encoded by the at least one coding sequence of the artificial nucleic acid molecule, preferably RNA, of the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

According to a preferred embodiment, the present invention provides a nucleic acid sequence, preferably RNA, most preferably mRNA, comprising at least one coding sequence comprising or consisting of any one of the RNA sequences according to SEQ ID NOs: 834-1248, 76740-76762, 76968-76971, or of a fragment or variant of any one of these sequences.

C-Optimized Sequences:

Preferably, the artificial nucleic acid molecule, preferably RNA, of the invention may be modified by modifying, preferably increasing, the cytosine (C) content of said artificial nucleic acid molecule, preferably RNA, in particular in its at least one coding sequence.

Preferably, the C content of the coding sequence of the artificial nucleic acid molecule, preferably RNA, of the invention is modified, preferably increased, compared to the C content of the coding sequence of the respective wild-type (unmodified) nucleic acid. The amino acid sequence encoded by the at least one coding sequence of the artificial nucleic acid molecule, preferably RNA, of the invention is preferably not modified as compared to the amino acid sequence encoded by the respective wild-type nucleic acid, preferably RNA (or the respective other wild type nucleic acid).

Preferably, said modified artificial nucleic acid molecule, preferably RNA is modified such that at least 10%, 20%, 30%, 40%, 50%, 60%, 70% or 80%, or at least 90% of the theoretically possible maximum cytosine-content or even a maximum cytosine-content is achieved.

Preferably, at least 10%, 20%, 30%, 40%, 50%, 60%, 70%, 80%, 90% or even 100% of the codons of the wild-type nucleic acid, preferably RNA, sequence, which are "cytosine content optimizable" are replaced by codons having a higher cytosine-content than the ones present in the wild type sequence.

It may further be preferred that some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

It may be further preferred that the modified artificial nucleic acid molecule, preferably RNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term "cytosine content-optimizable codon" as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding sequence increases its overall C-content and reflects a C-enriched modified RNA sequence.

Preferably, the artificial nucleic acid molecule, preferably RNA, of the invention, and in particular its at least one coding sequence, may comprise or consist of a C-maximized sequence containing C-optimized codons for all potentially C-optimizable codons. Accordingly, 100% or all of the theoretically replaceable C-optimizable codons are preferably replaced by C-optimized codons over the entire length of the coding sequence.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or the codon UGU that codes for Cys may be exchanged by the codon UGC encoding the same amino acid, and/or the codon GAU which codes for Asp may be exchanged by the codon GAC encoding the same amino acid, and/or the codon that UUU that codes for Phe may be exchanged for the codon UUC encoding the same amino acid, and/or any of the codons GGG, GGA, GGU that code Gly may be exchanged by the codon GGC encoding the same amino acid, and/or the codon CAU that codes for His may be exchanged by the codon CAC encoding the same amino acid, and/or any of the codons AUA, AUU that code for Iie may be exchanged by the codon AUC, and/or any of the codons UUG, UUA, CUG, CUA, CUU coding for Leu may be exchanged by the codon CUC encoding the same amino acid, and/or the codon AAU that codes for Asn may be exchanged by the codon AAC encoding the same amino acid, and/or any of the codons CCG, CCA, CCU coding for Pro may be exchanged by the codon CCC encoding the same amino acid, and/or any of the codons AGG, AGA, CGG, CGA, CGU coding for Arg may be exchanged by the codon CGC encoding the same amino acid, and/or any of the codons AGU, AGC, UCG, UCA, UCU coding for Ser may be exchanged by the codon UCC encoding the same amino acid, and/or any of the codons ACG, ACA, ACU coding for Thr may be exchanged by the codon ACC encoding the same amino acid, and/or any of the codons GUG, GUA, GUU coding for Val may be exchanged by the codon GUC encoding the same amino acid, and/or the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding sequence results in a C-maximized coding sequence. In the context of the invention, at least 70%, preferably at least 80%, more preferably at least 90%, of the non C-optimized codons within the at least one coding sequence of the artificial nucleic acid molecule, preferably RNA, of the invention are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding sequence.

Preferably, in a C-optimized artificial nucleic acid molecule, preferably RNA, at least 50% of the C-optimizable wild type codons for any given amino acid are replaced by C-optimized codons, e.g. any modified C-enriched RNA (or other nucleic acid, in particular RNA) preferably contains at least 50% C-optimized codons at C-optimizable wild type codon positions encoding any one of the above mentioned amino acids Ala, Cys, Asp, Phe, Gly, His, Iie, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid.

Accordingly, the relatively rare codon GAA coding for Glu may be exchanged by the relative frequent codon GAG coding for the same amino acid, and/or the relatively rare codon AAA coding for Lys may be exchanged by the relative frequent codon AAG coding for the same amino acid, and/or the relatively rare codon CAA coding for Gin may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (UGA).

The single substitutions listed above may be used individually as well as in all possible combinations in order to optimize the cytosine-content of the modified artificial nucleic acid molecule, preferably RNA, compared to the wild type sequence.

Accordingly, the at least one coding sequence as defined herein may be changed compared to the coding sequence of the respective wild type nucleic acid, preferably RNA, in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

According to a preferred embodiment, the present invention provides a nucleic acid sequence, preferably RNA, most preferably mRNA, comprising at least one coding sequence comprising or consisting of any one of the RNA sequences according to SEQ ID NOs: 625-832, 76694-76716, 76960-76963, or of a fragment or variant of any one of these sequences.

Combined Modifications

The sequence modifications described herein are particularly envisaged to be applied to the coding sequences of the artificial nucleic acid molecules, preferably RNAs, as described herein. The modifications (including chemical modifications, lipid modifications and sequence modifications) may, if suitable or necessary, be combined with each other in any combination, provided that the combined modifications do not interfere with each other, and preferably provided that the encoded antigenic fusion proteins preferably retain their desired functionality or property, as described herein above.

Preferably, artificial nucleic acids, preferably RNAs, according to the invention comprise at least one coding sequence as defined herein, wherein said coding sequence has been modified as described above, and encodes an antigenic fusion protein as defined herein.

According to preferred embodiments, the inventive artificial nucleic acid molecule, preferably RNA, comprises at least one coding sequence as defined herein, wherein (a) the G/C content of the at least one coding sequence of said artificial nucleic acid molecule, preferably RNA, is increased compared to the G/C content of the corresponding coding sequence of the corresponding wild-type nucleic acid (preferably RNA), and/or (b) wherein the C content of the at least one coding sequence of said artificial nucleic acid molecule, preferably RNA, is increased compared to the C content of the corresponding coding sequence of the corresponding wild-type nucleic acid (preferably RNA), and/or (c) wherein the codons in the at least one coding sequence of said artificial nucleic acid molecule, preferably RNA, are adapted to human codon usage, wherein the codon adaptation index (CAI) is preferably increased or maximized in the at least one coding sequence of said artificial nucleic acid molecule, preferably RNA, and wherein the amino acid sequence encoded by said artificial nucleic acid molecule, preferably RNA, is preferably not being modified compared to the amino acid sequence encoded by the corresponding wild-type nucleic acid (preferably RNA).

Preferably, the artificial nucleic acid molecule, preferably RNA, of the invention may comprise at least one coding region comprising or consisting of a nucleic acid sequence according to any one of SEQ ID NOs: 625-832, 76694-76716, 76960-76963, 833-1040, 76717-76739, 76964-76967, 417-624, 2915, 2916, 2932, 2935, 76671-76693, 76956-76959, 1249-1456, 76763-76785, 76972-76975, 1457-1664, 76786-76808, 76976-76979, 1665-1872, 76809-76831, 76980-76983, 1873-2080, 76832-76854, 76984-76987, 2081-2288, 76855-76877, 76988-76991, 2289-2496, 76878-76900, 76992-76995, 2497-2704, 76901-76923, 76996-76999, 2705-2912, 76924-76946, 77000-77003, 76947, 834-1248, 76740-76762, 76968-76971, 77004-77017, 77066, 76569, 76550-76568, 2936, 76494, 76475-76493, 77059-77061, 3295-3506, 3507-3718, 27946-52172, 76495-76514, 52173-76399; 76570-76589, or a (preferably functional) fragment, variant or derivative of any one of said sequences, preferably comprising or consisting of a nucleic acid sequence having at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, sequence identity to any one of said sequences.

5' Cap

According to preferred embodiments, artificial nucleic acid molecules, preferably RNAs as defined herein, may be modified by the addition of a so-called "5' cap" structure, which preferably stabilizes said artificial nucleic acid molecule, preferably RNA, as described herein.

Accordingly, in preferred embodiments, the artificial nucleic acid, preferably RNA, of the invention may comprise a 5'-cap structure, preferably m7G (m7G(5')ppp(5')G), cap0, cap1, cap2, a modified cap0 or a modified cap1 structure (generated using a cap analogue as defined below).

A "5'-cap" is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a "modified" mRNA in this context. Accordingly, a "modified" artificial nucleic acid molecule, preferably RNA may comprise a m7GpppN as 5'-cap, but additionally said modified artificial nucleic acid molecule, preferably RNA, typically comprises at least one further modification as defined herein. Preferably, the 5'-cap is added using a 5'-5'-triphosphate linkage (also named m7GpppN). Further examples of 5' cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety. These modified 5'-cap structures are regarded as at least one modification in this context.

Particularly preferred "modified" 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

According to preferred embodiments of the present invention, the artificial nucleic acid molecule, in particular RNA, comprises a 5'-Cap structure selected from m7GpppN or cap1.

A 5'-cap (cap0 or cap1) structure may be formed in chemical RNA synthesis or RNA in vitro transcription (co-transcriptional capping) using cap analogues.

The term "cap analogue" as used herein will be recognized and understood by the person of ordinary skill in the art, and is e.g. intended to refer to a non-polymerizable di-nucleotide that has cap functionality in that it facilitates translation or localization, and/or prevents degradation of a nucleic acid molecule, particularly of an RNA molecule, when incorporated at the 5'-end of the nucleic acid molecule. Non-polymerizable means that the cap analogue will be incorporated only at the 5'-terminus because it does not have a 5' triphosphate and therefore cannot be extended in the 3'-direction by a template-dependent polymerase, particularly, by template-dependent RNA polymerase. Examples of cap analogues include, but are not limited to, a chemical structure selected from the group consisting of m7GpppG, m7GpppA, m7GpppC; unmethylated cap analogues (e.g. GpppG); dimethylated cap analogue (e.g. m2,7GpppG), trimethylated cap analogue (e.g. m2,2,7GpppG), dimethylated symmetrical cap analogues (e.g. m7Gpppm7G), or anti reverse cap analogues (e.g. ARCA; m7,2'OmeGpppG, m7,2'dGpppG, m7,3'OmeGpppG, m7,3'dGpppG and their tetraphosphate derivatives). Further cap analogues have been described previously (WO2008/016473, WO2008/157688, WO2009/149253, WO2011/015347, and WO2013/059475). Further suitable cap analogues in that context are described in WO2017/066793, WO2017/066781, WO2017/066791, WO2017/066789, WO2017/053297, WO2017/066782, WO2018075827 and WO2017/066797 wherein the disclosures referring to cap analogues are incorporated herewith by reference.

In embodiments, a modified cap1 structure is generated using a cap analogue as disclosed in WO2017/053297, WO2017/066793, WO2017/066781, WO2017/066791, WO2017/066789, WO2017/066782, WO2018075827 and WO2017/066797. In particular, any cap structures derivable from the structure disclosed in claim 1-5 of WO2017/053297 may be suitably used to co-transcriptionally generate a modified cap1 structure. Further, any cap structures derivable from the structure defined in claim 1 or claim 21 of WO2018075827 may be suitably used to co-transcriptionally generate a modified cap1 structure.

In preferred embodiments, the 5'-cap structure may suitably be added co-transcriptionally using cap-analogues as defined herein in an RNA in vitro transcription reaction as defined herein. Preferred cap-analogues in the context of the invention are m7G(5')ppp(5')G (m7G) or 3'-O-Me-m7G(5')ppp(5')G. Further preferred cap-analogues in the context of the invention are m7G(5')ppp(5')(2'OMeA)pG or m7G(5')ppp(5')(2'OMeG)pG to co-transcriptionally generate cap1 structures.

In other embodiments, the 5'-cap structure is added via enzymatic capping using capping enzymes (e.g. vaccinia virus capping enzymes and/or cap-dependent 2'-O methyltransferases) to generate cap0 or cap1 or cap2 structures. The 5'-cap structure (cap0 or cap1) may be added using immobilized capping enzymes and/or cap-dependent 2'-O methyltransferases using methods and means disclosed in WO2016/193226.

Accordingly, the RNA of the first aspect may comprise a 5'-cap structure, preferably m7G (m7G(5')), m7G(5')ppp(5')(2'OMeA), or m7G(5')ppp(5')(2'OMeG).

Poly(A)

According to further preferred embodiments, the artificial nucleic acid molecule, preferably RNA, of the invention may contain a poly(A) sequence.

A "poly(A) sequence", also called "poly(A) tail" or "3'-poly(A) tail", is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. As used herein, a poly(A) sequence may also comprise about 10 to 200 adenosine nucleotides, preferably about 10 to 100 adenosine nucleotides, more preferably about 40 to 80 adenosine nucleotides or even more preferably about 50 to 70 adenosine nucleotides. A poly(A) sequence is typically located at the 3'-end of an RNA, in particular a mRNA.

Preferably, the artificial nucleic acid molecule, preferably RNA, of the invention may contain at its 3' terminus a poly(A) tail of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the artificial nucleic acid molecule, preferably RNA, of the invention may be derived from a DNA template by RNA in vitro transcription.

Alternatively, the poly(A) sequence may also be obtained in vitro by common methods of chemical-synthesis without being necessarily transcribed from a DNA-progenitor.

Moreover, poly(A) sequences, or poly(A) tails may be generated by enzymatic polyadenylation of the artificial nucleic acid molecule, preferably RNA, of the invention using commercially available polyadenylation kits and corresponding protocols known in the art. "Polyadenylation" is typically understood to be the addition of a poly(A) sequence to a nucleic acid molecule, such as an RNA molecule, e.g. to a premature mRNA. Polyadenylation may be induced by a so-called polyadenylation signal. This signal is preferably located within a stretch of nucleotides at the 3'-end of the mRNA to be polyadenylated.

A polyadenylation signal typically comprises a hexamer consisting of adenine and uracil/thymine nucleotides, preferably the hexamer sequence AAUAAA. Other sequences, preferably hexamer sequences, are also conceivable.

Polyadenylation typically occurs during processing of a pre-mRNA (also called premature-mRNA). Typically, RNA maturation (from pre-mRNA to mature mRNA) comprises a step of polyadenylation.

Accordingly, the artificial nucleic acid molecule, preferably RNA, of the invention may comprise a polyadenylation signal which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(C)

According to preferred embodiments, the artificial nucleic acid molecule, preferably RNA, of the invention may contain a poly(C) tail on the 3' terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

UTRs

According to preferred embodiments, the artificial nucleic acid molecule, preferably RNA, of the invention may comprise at least one 5'- and/or 3'-UTR element. A "UTR element" comprises or consists of a nucleic acid sequence, which is derived from the 5'- or 3'-UTR of any naturally occurring gene or which is derived from a fragment, a homolog or a variant of the 5'- or 3'-UTR of a gene. Preferably, 5'- or 3'-UTR elements may be heterologous to the at least one coding sequence of said artificial nucleic acid molecule, preferably RNA. Even though 5'- or 3'-UTR elements derived from naturally occurring genes may be preferred, synthetically engineered UTR elements may also be used in the context of the present invention.

3' UTR

The term "3'UTR element" typically refers to a nucleic acid sequence, which comprises or consists of a nucleic acid sequence that is derived from a 3'UTR or from a variant of a 3'UTR. Generally, the term "3'-UTR" refers to a part of a nucleic acid molecule, which is located 3' (i.e. "downstream") of an open reading frame and which is not translated into protein. In the context of the present invention, a 3'-UTR corresponds to a sequence which is located between the stop codon of the protein coding sequence, preferably immediately 3' to the stop codon of the protein coding sequence, and optionally the poly(A) sequence of the artificial nucleic acid molecule, preferably RNA, of the invention.

The term "corresponds to" means that the 3'-UTR sequence may be an RNA sequence, such as in the mRNA sequence used for defining the 3'-UTR sequence, or a DNA sequence, which corresponds to such RNA sequence. In the context of the present invention, the term "a 3'-UTR of a gene", such as "a 3'-UTR of a ribosomal protein gene", is the sequence, which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR.

A 3'UTR element in the sense of the present invention may represent the 3'UTR of an RNA, preferably an mRNA. Thus, in the sense of the present invention, preferably, a 3'UTR element may be the 3'UTR of an RNA, preferably of an mRNA, or it may be the transcription template for a 3'UTR of an RNA. Thus, a 3'UTR element preferably is a nucleic acid sequence which corresponds to the 3'UTR of an RNA, preferably to the 3'UTR of an mRNA, such as an mRNA obtained by transcription of a genetically engineered vector construct. Preferably, the 3'UTR element fulfils the function of a 3'UTR or encodes a sequence which fulfils the function of a 3'UTR.

Preferably, the at least one 3'UTR element comprises or consists of a nucleic acid sequence derived from the 3'UTR of a chordate gene, preferably a vertebrate gene, more preferably a mammalian gene, most preferably a human gene, or from a variant of the 3'UTR of a chordate gene, preferably a vertebrate gene, more preferably a mammalian gene, most preferably a human gene.

Preferably, the artificial nucleic acid molecule, preferably RNA, of the invention comprises a 3'UTR element, which may be derivable from a gene that relates to an mRNA with an enhanced half-life (that provides a stable mRNA), for example a 3'UTR element as defined and described below. Preferably, the 3'-UTR element is a nucleic acid sequence derived from a 3'-UTR of a gene, which preferably encodes a stable mRNA, or from a homolog, a fragment or a variant of said gene It may be particularly preferred that the 3'UTR element comprises or consists of a nucleic acid sequence, which is derived from a 3'UTR of a gene selected from the group consisting of an albumin gene, an alpha-globin gene, a beta-globin gene, a tyrosine hydroxylase gene, a lipoxygenase gene, and a collagen alpha gene, such as a collagen alpha 1(I) gene, or from a variant of a 3'UTR of a gene selected from the group consisting of an albumin gene, an alpha-globin gene, a beta-globin gene, a tyrosine hydroxylase gene, a lipoxygenase gene, and a collagen alpha gene, such as a collagen alpha 1(I) gene according to SEQ ID NO: 1369-1390 of the patent application WO2013/143700, whose disclosure is incorporated herein by reference, or from a homolog, a fragment or a variant thereof.

The term "a nucleic acid sequence which is derived from the 3'UTR of a [ . . . ] gene" preferably refers to a nucleic acid sequence which is based on the 3'UTR sequence of a [ . . . ] gene or on a part thereof, such as on the 3'UTR of an albumin gene, an alpha-globin gene, a beta-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire sequence of the variant of the 3'UTR of a gene, i.e. the full length variant 3'UTR sequence of a gene, and sequences corresponding to a fragment of the variant 3'UTR sequence of a gene. A fragment in this context preferably consists of a continuous stretch of nucleotides corresponding to a continuous stretch of nucleotides in the full-length variant 3'UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'UTR. Such a fragment of a variant, in the sense of the present invention, is preferably a functional fragment of a variant as described herein.

Albumin-Derived 3' UTRs

Preferably, the 3'UTR element may comprise or consist of a nucleic acid sequence which is derived from a 3'UTR of an albumin gene, preferably a vertebrate albumin gene, more preferably a mammalian albumin gene, most preferably a human albumin gene according to SEQ ID NO: 3073 or the corresponding RNA sequence (SEQ ID NO: 3074).

Human albumin 3'UTR SEQ ID NO: 3073: CATCACATTT AAAAGCATCT CAGCCTACCA TGAGAATAAG AGAAAGAAAA TGAAGATCAA AAGCTTATTC ATCTGTTTTT CTTTTTCGTT GGTGTAAAGC CAACACCCTG TCTAAAAAAC ATAAATTTCT TTAATCATTT TGCCTCTTTT CTCTGTGCTT CAATTAATAA AAAATGGAAA GAATCT (corresponding to SEQ ID No: 1369 of the patent application PCT/EP2013/000938 published under WO2013/143700).

The artificial nucleic acid molecule, preferably RNA, of the invention may comprise a 3'-UTR element comprising a corresponding RNA sequence derived from the nucleic acids according to SEQ ID NOs: 1369-1390 of the patent application WO2013/143700 or a fragment, homolog or variant thereof.

Preferably, the 3'-UTR element may comprise the nucleic acid sequence derived from a fragment of the human albumin gene according to SEQ ID NO: 3075 or 3077: albumin7 3'UTR CATCACATTTAAAAGCATCTCAGCCTACCAT-GAGAATAAGAGAAAGAAAATGAAGATCAATAGCT-TATTCATCTCT TTTTCTTTTTCGTTGGTGTAAAGC-CAACACCCTGTCTAAAAAACATAAATTTCTTTAAT-CATTTTGCCTCTTTTCTCT GTGCTTCAAT-TAATAAAAAATGGAAAGAACCT (SEQ ID NO: 3075 corresponding to SEQ ID No: 1376 of the patent application WO2013/143700)

The 3'-UTR element of the artificial nucleic acid molecule, preferably RNA, of the invention may preferably comprise or consist of a corresponding RNA sequence of the nucleic acid sequence according to SEQ ID NO: 3076 or 3078.

Globin-Derived 3'UTRs

In another particularly preferred embodiment, the 3'UTR element comprises or consists of a nucleic acid sequence which is derived from a 3'UTR of an alpha-globin gene, preferably a vertebrate alpha- or beta-globin gene, more preferably a mammalian alpha- or beta-globin gene, most preferably a human alpha- or beta-globin gene according to SEQ ID NO: 3065, 3067 or 3069 or the corresponding RNA sequences:

3'-UTR of *Homo sapiens* hemoglobin, alpha 1 (HBA1)
GCTGGAGCCTCGGTGGC-
CATGCTTCTTGCCCCTTGGGCCTCCCCCCAGCCC-
CTCCTCCCCTTCCTGCACCCGT
ACCCCCGTGGTCTTTGAATAAAGTCT-
GAGTGGGCGGC (SEQ ID NO: 3065 corresponding to SEQ ID NO: 1370 of the patent application WO2013/143700)

3'-UTR of *Homo sapiens* hemoglobin, alpha 2 (HBA2)
GCTG-
GAGCCTCGGTAGCCGTTCCTCCTGCCCGCTGG-
GCCTCC-
CAACGGGCCCTCCTCCCCTCCTTGCACCGGC
CCTTCCTGGTCTTTGAATAAAGTCTGAGTGGGCAG (SEQ ID NO: 3067 corresponding to SEQ ID NO: 1371 of the patent application WO2013/143700)

3'-UTR of *Homo sapiens* hemoglobin, beta (HBB)
GCTCGCTTTCTTGCTGTCCAATTTCTAT-
TAAAGGTTCCTTTGTTCCCTAAGTCCAAC-
TACTAAACTGGGGGATATT ATGAAGGGCCTTGAG-
CATCTGGATTCTGCCTAATAAAAAACATTTATTTT-
CATTGC (SEQ ID NO: 3069 corresponding to SEQ ID NO: 1372 of the patent application WO2013/143700)

For example, the 3'UTR element may comprise or consist of the center, alpha-complex-binding portion of the 3'UTR of an alpha-globin gene, such as of a human alpha-globin gene, or a homolog, a fragment, or a variant of an alpha-globin gene, preferably according to SEQ ID NO: 3071:

Center, alpha-complex-binding portion of the 3'UTR of an alpha-globin gene ("muag"):
GCCCGATGGGCCTCC-
CAACGGGCCCTCCTCCCCTCCTTGCACCG (SEQ ID NO: 3071 corresponding to SEQ ID NO: 1393 of the patent application WO2013/143700).

5' UTR

A "5'-UTR" is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites. The 5'-UTR may be post-transcriptionally modified, for example by addition of a 5'-Cap. In the context of the present invention, a 5'-UTR corresponds to the sequence of a mature mRNA, which is located between the 5'-Cap and the start codon. Preferably, the 5'-UTR corresponds to the sequence, which extends from a nucleotide located 3' to the 5'-Cap, preferably from the nucleotide located immediately 3' to the 5'-Cap, to a nucleotide located 5' to the start codon of the protein coding sequence, preferably to the nucleotide located immediately 5' to the start codon of the protein coding sequence. The nucleotide located immediately 3' to the 5'-Cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence, which corresponds to such RNA sequence. In the context of the present invention, the term "a 5'-UTR of a gene" is the sequence, which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR. By the inventive embodiments such a 5'-UTR may be provided 5'-terminal to the coding sequence. Its length is typically less than 500, 400, 300, 250 or less than 200 nucleotides. In other embodiments its length may be in the range of at least 10, 20, 30 or 40, preferably up to 100 or 150, nucleotides.

In the context of the present invention, 5' UTRs comprising or consisting of a nucleic acid sequence, which is derived from the 5'UTR of a TOP gene or which is derived from a fragment, homolog or variant of the 5'UTR of a TOP gene, may be particularly preferred.

The 5' terminal oligopyrimidine tract (TOP) is typically a stretch of pyrimidine nucleotides located in the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. An mRNA that contains a 5' terminal oligopyrimidine tract is often referred to as "TOP mRNA". Accordingly, genes that provide such messenger RNAs are referred to as "TOP genes".

TOP sequences have, for example, been found in genes and mRNAs encoding peptide elongation factors and ribosomal proteins.

TOP genes are typically characterized by the presence of a 5' terminal oligopyrimidine tract (TOP). Furthermore, most TOP genes are characterized by a growth-associated translational regulation. However, also TOP genes with a tissue specific translational regulation are known. As defined above, the 5'UTR of a TOP gene corresponds to the sequence of a 5'UTR of a mature mRNA derived from a TOP gene, which preferably extends from the nucleotide located 3' to the 5'-CAP to the nucleotide located 5' to the start codon. A 5'UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'UTRs of TOP genes are generally rather short. The lengths of 5'UTRs of TOP genes may vary between 20 nucleotides up to 500 nucleotides, and are typically less than about 200 nucleotides, preferably less than about 150 nucleotides, more preferably less than about 100 nucleotides. Exemplary 5'UTRs of TOP genes in the sense of the present invention are the nucleic acid sequences extending from the nucleotide at position 5 to the nucleotide located immediately 5' to the start codon (e.g. the ATG) in the sequences according to SEQ ID NOs: 1-1363 of the patent application WO2013/143700, whose disclosure is incorporated herewith by reference. In this context, a particularly preferred fragment of a 5'UTR of a TOP gene is a 5'UTR of a TOP gene lacking the 5'TOP motif. The terms "5'UTR of a TOP gene" or "5'-TOP UTR" preferably refer to the 5'UTR of a naturally occurring TOP gene.

In the context of the present invention, a "TOP motif" is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5' end with a cytosine nucleotide. In TOP genes and TOP mRNAs, the TOP-motif preferably starts at its 5' end with the transcriptional start site and ends one nucleotide 5' to the first purin residue in said gene or mRNA. A TOP motif in the sense of the present invention is preferably located at the 5' end of a sequence, which represents a 5'UTR, or at the 5' end of a sequence, which codes for a 5'UTR. Thus, preferably, a stretch of 3 or more pyrimidine nucleotides is called "TOP motif" in the sense of the present invention if this stretch is located at the 5' end of a respective sequence, such as the artificial nucleic acid molecule, the 5'UTR element of the artificial nucleic acid molecule, or the nucleic acid sequence which is derived from the 5'UTR of a TOP gene as described herein. In other words, a stretch of 3 or more pyrimidine nucleotides, which is not located at the 5'-end of a 5'UTR or a 5'UTR element but anywhere within a 5'UTR or a 5'UTR element, is preferably not referred to as "TOP motif".

Preferably, the 5'UTR element of the artificial nucleic acid molecule, preferably RNA, of the invention may not comprise a TOP-motif or a 5'TOP, as defined above.

The nucleic acid sequence of the 5'UTR element, which is derived from a 5'UTR of a TOP gene, may preferably terminate at its 3'-end with a nucleotide located at position 1, 2, 3, 4, 5, 6, 7, 8, 9 or 10 upstream of the start codon (e.g. A(U/T)G) of the gene or mRNA it is derived from. Accordingly, the 5'UTR element may preferably not comprise any part of the protein coding sequence.

Therefore, preferably, the only amino acid coding part of the at least one artificial nucleic acid molecule, preferably RNA, of the invention may be provided by its coding region.

The nucleic acid sequence derived from the 5'UTR of a TOP gene may preferably be derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'UTR element may preferably be selected from 5'-UTR elements comprising or consisting of a nucleic acid sequence, which is derived from a nucleic acid sequence selected from the group consisting of SEQ ID Nos: 1-1363, SEQ ID NO: 1395, SEQ ID NO: 1421 and SEQ ID NO: 1422 of the patent application WO2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than *Homo sapiens*, which are homologous to the sequences according to SEQ ID NOs: 1-1363, SEQ ID NO: 1395, SEQ ID NO: 1421 and SEQ ID NO: 1422 of the patent application WO2013/143700.

Preferably, the 5'UTR element of the artificial nucleic acid molecule, preferably RNA, of the invention may comprise or consist of a nucleic acid sequence, which is derived from a nucleic acid sequence extending from nucleotide position 5 (i.e. the nucleotide that is located at position 5 in the sequence) to the nucleotide position immediately 5' to the start codon (located at the 3' end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5' UTR element is derived from a nucleic acid sequence extending from the nucleotide position immediately 3' to the 5'TOP to the nucleotide position immediately 5' to the start codon (located at the 3' end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID Nos: 1395, SEQ ID No: 1421 and SEQ ID NO: 1422 of the patent application WO2013/143700, from a variant thereof, or a corresponding RNA sequence.

It may be particularly preferred that the 5'UTR element comprises or consists of a nucleic acid sequence, which is derived from a 5'UTR of a TOP gene encoding a ribosomal protein or from a variant of a 5'UTR of a TOP gene encoding a ribosomal protein. For example, the 5'UTR element may preferably comprise or consist of a nucleic acid sequence, which is derived from a 5'UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'TOP motif. As described above, the sequence extending from position 5 to the nucleotide immediately 5' to the ATG (which is located at the 3' end of the sequences) corresponds to the 5'UTR of said sequences.

The artificial nucleic acid molecule, preferably RNA, of the invention may thus comprise a 5'UTR element, which comprises or consists of a nucleic acid sequence, which is derived from the 5'UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'UTR element does not comprise a TOP-motif or the 5'TOP of said genes, and wherein optionally the 5'UTR element starts at its 5'-end with a nucleotide located at position 1, 2, 3, 4, 5, 6, 7, 8, 9 or 10 downstream of the 5' terminal oligopyrimidine tract (TOP) and wherein further optionally the 5'UTR element which is derived from a 5'UTR of a TOP gene terminates at its 3'-end with a nucleotide located at position 1, 2, 3, 4, 5, 6, 7, 8, 9 or 10 upstream of the start codon (A(U/T)G) of the gene it is derived from.

Preferably, the 5'UTR element may comprise or consist of a nucleic acid sequence, which is derived from the 5'UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH 1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), or a mammalian N-acylsphingosine amidohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP syn-thase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'UTR element does not comprise the 5'TOP of said gene.

ATP5A1 Derived 5' UTR

Preferably, the artificial nucleic acid molecule, preferably RNA, of the invention may comprise a 5'UTR element which comprises or consists of a nucleic acid sequence, which is derived from a 5'UTR of a TOP gene encoding a mitochondrial ATP synthase subunit alpha or from a homolog or variant of a 5'UTR of a TOP gene encoding a mitochondrial ATP synthase subunit alpha, preferably lacking the 5'TOP motif.

In this context, the 5'UTR element preferably comprises or consists of a nucleic acid sequence which is derived from the 5'UTR of a mitochondrial ATP synthase subunit alpha gene, preferably from a vertebrate mitochondrial ATP synthase subunit alpha (ATP5A1) gene, more preferably from a mammalian mitochondrial ATP synthase subunit alpha (ATP5A1) gene, most preferably from a human mitochondrial ATP synthase subunit alpha (ATP5A1) gene, or from a variant of the 5'UTR of a mitochondrial ATP synthase subunit alpha gene, preferably from a vertebrate mitochondrial ATP synthase subunit alpha (ATP5A1) gene, more preferably from a mammalian mitochondrial ATP synthase subunit alpha (ATP5A1) gene, most preferably from a human mitochondrial ATP synthase subunit alpha (ATP5A1) gene, wherein preferably the 5'UTR element does not comprise the 5'TOP of said gene.

Accordingly, in a particularly preferred embodiment, the 5'UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3063 (5'-UTR of ATP5A1 lacking the 5' terminal oligopyrimidine tract: GCGGCTCGGCCAT-TTTGTCCCAGTCAGTCCG-GAGGCTGCGGCTGCAGAAGTACCGCCTGCG-GAGTAACTGCAA AG; corresponding to SEQ ID NO: 1414 of the patent application WO2013/143700) or preferably to a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3063 or more preferably to a corresponding RNA sequence, wherein, preferably, the fragment is as described above, i.e. being a continuous stretch of nucleotides representing at least 20% etc. of the full-length 5'UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

L32 Derived 5' UTR

Preferably, the artificial nucleic acid molecule, preferably RNA, of the invention may comprise a 5'UTR element which comprises or consists of a nucleic acid sequence, which is derived from a 5'UTR of a TOP gene encoding a ribosomal Large protein (RPL) or from a homolog or variant of a 5'UTR of a TOP gene encoding a ribosomal Large protein (RPL). For example, the 5'UTR element comprises or consists of a nucleic acid sequence, which is derived from a 5'UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'TOP motif.

In this context, the 5'UTR element may preferably comprise or consist of a nucleic acid sequence which is derived from the 5'UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'UTR element does not comprise the 5'TOP of said gene.

Accordingly, the 5'UTR element may preferably comprise or consist of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3061 (5'-UTR of human ribosomal protein Large 32 lacking the 5' terminal oligopyrimidine tract: GGCGCTGCCTACG-GAGGTGGCAGCCATCTCCTTCTCGGCATC; corresponding to SEQ ID NO: 1368 of the patent application WO2013/143700) or preferably to a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 3061 or more preferably to a corresponding RNA sequence, wherein, preferably, the fragment is as described above, i.e. being a continuous stretch of nucleotides representing at least 20% etc. of the full-length 5'UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Histone Stem-Loop

According to preferred embodiments, the artificial nucleic acid molecule, preferably RNA, of the invention comprises a histone stem-loop sequence/structure.

Such histone stem-loop sequences are preferably selected from histone stem-loop sequences as disclosed in WO 2012/019780, the disclosure of which is incorporated herewith by reference.

A histone stem-loop sequence, suitable to be used within the present invention, is preferably selected from at least one of the following formulae (II) or (III):

Formula (II) (Stem-Loop Sequence without Stem Bordering Elements):

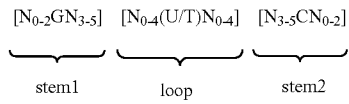

Formula (III) (Stem-Loop Sequence with Stem Bordering Elements):
wherein:

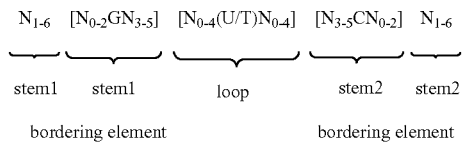

| | |
|---|---|
| stem1 or stem2 bordering elements $N_{1-6}$ | is a consecutive sequence of 1 to 6, preferably of 2 to 6, more preferably of 2 to 5, even more preferably of 3 to 5, most preferably of 4 to 5 or 5N, wherein each N is independently from another selected from a nucleotide selected from A, U, T, G and C, or a nucleotide analogue thereof; |
| stem1 $[N_{0-2}GN_{3-5}]$ | is reverse complementary or partially reverse complementary with element stem2, and is a consecutive sequence between of 5 to 7 nucleotides; wherein $N_{0-2}$ is a consecutive sequence of 0 to 2, preferably of 0 to 1, more preferably of 1N, wherein each N is independently from another selected from a nucleotide selected from A, U, T, G and C or a nucleotide analogue thereof; wherein $N_{3-5}$ is a consecutive sequence of 3 to 5, preferably of 4 to 5, more preferably of 4N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine; |
| loop sequence $[N_{0-4}(U/T)N_{0-4}]$ | is located between elements stem1 and stem2, and is a consecutive sequence of 3 to 5 nucleotides, more preferably of 4 nucleotides; wherein each $N_{0-4}$ is independent from another a consecutive sequence of 0 to 4, preferably of 1 to 3, more preferably of 1 to 2N, wherein each N is independently from another selected from a nucleotide selected from A, U, T, G and C or a nucleotide analogue thereof; and wherein U/T represents uridine, or optionally thymidine; |
| stem2 $[N_{3-5}CN_{0-2}]$ | is reverse complementary or partially reverse complementary with element stem1, and is a consecutive sequence between of 5 to 7 nucleotides; wherein $N_{3-5}$ is a consecutive sequence of 3 to 5, preferably of 4 to 5, more preferably of 4N, wherein each N is independently from another selected from a nucleotide selected from A, U, T, G and C or a nucleotide analogue thereof; wherein $N_{0-2}$ is a consecutive sequence of 0 to 2, preferably of 0 to 1, more preferably of 1N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine; | wherein
stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

According to a further preferred embodiment, the artificial nucleic acid molecule, preferably RNA, of the invention may comprise at least one histone stem-loop sequence according to at least one of the following specific formulae (IIa) or (IIIa):

Formula (IIa) (Stem-Loop Sequence without Stem Bordering Elements):

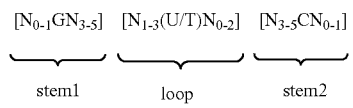

Formula (IIIa) (Stem-Loop Sequence with Stem Bordering Elements):

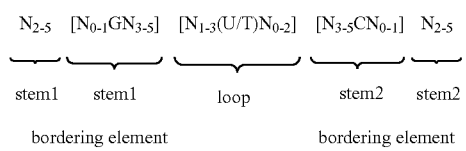

wherein:
N, C, G, T and U are as defined above.

According to a further more particularly preferred embodiment, the artificial nucleic acid molecule, preferably RNA, of the invention may comprise at least one histone stem-loop sequence according to at least one of the following specific formulae (IIb) or (IIIb):

Formula (IIb) (Stem-Loop Sequence without Stem Bordering Elements):

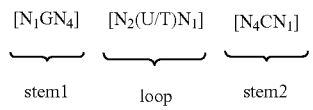

Formula (IIIb) (Stem-Loop Sequence with Stem Bordering Elements):

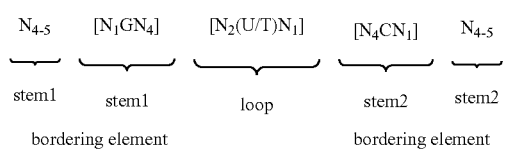

wherein:
N, C, G, T and U are as defined above.

A particularly preferred histone stem-loop sequence is the sequence CAAAGGCTCTTTTCAGAGCCACCA (SEQ ID NO: 3079) or more preferably the corresponding RNA sequence CAAAGGCUCUUUUCAGAGCCACCA (SEQ ID NO: 3080).

Constructs

The artificial nucleic acid molecule, preferably RNA, of the invention, which comprises at least one coding sequence as defined herein preferably comprises at least one 5' UTR and/or at least one 3' UTR as described herein, and optionally at least one histone stem-loop.

The 3' UTR of the artificial nucleic acid molecule, preferably RNA, of the invention (or any other nucleic acid, in particular RNA, as defined herein) may further comprise a poly(A) and/or a poly(C) sequence as defined herein. The single elements of the 3' UTR may occur therein in any order from 5' to 3' along the sequence of the artificial nucleic acid molecule, preferably RNA, of the invention.

In addition, further elements as described herein, may also be contained, such as a stabilizing sequence as defined herein (e.g. derived from the UTR of a globin gene), IRES sequences, etc. Each of the elements may also be repeated in the artificial nucleic acid molecule, preferably RNA, of the invention at least once (particularly in di- or multicistronic constructs), e.g. twice or more. As an example, the single elements may be present in the artificial nucleic acid molecule, preferably RNA, of the invention in the following order:

5'-coding sequence-histone stem-loop-poly(A)/(C) sequence-3'; or

5'-coding sequence-poly(A)/(C) sequence-histone stem-loop-3'; or

5'-coding sequence-histone stem-loop-polyadenylation signal-3'; or

5'-coding sequence-polyadenylation signal-histone stem-loop-3'; or

5'-coding sequence-histone stem-loop-histone stem-loop-poly(A)/(C) sequence-3'; or 5'-coding sequence-histone stem-loop-histone stem-loop-polyadenylation signal-3'; or 5'-coding sequence-stabilizing sequence-poly(A)/(C) sequence-histone stem-loop-3'; or 5'-coding sequence-stabilizing sequence-poly(A)/(C) sequence-poly(A)/(C) sequence-histone stem-loop-3'; etc.

According to further embodiments, the artificial nucleic acid molecule, preferably RNA, preferably further comprises at least one of the following structural elements: a histone-stem-loop structure, preferably a histone-stem-loop in its 3' untranslated region; a 5'-cap structure; a poly-A tail; or a poly(C) sequence.

According to some embodiments, in addition to the (poly-)peptides or proteins described herein, a further peptide or protein is encoded by the at least one coding sequence as defined herein, wherein the further peptide or protein is preferably no histone protein, no reporter protein (e.g. Luciferase, GFP and its variants (such as eGFP, RFP or BFP), and/or no marker or selection protein, including alpha-globin, galactokinase and Xanthine:Guanine phosphoribosyl transferase (GPT), hypoxanthine-guanine phosphoribosyltransferase (HGPRT), beta-galactosidase, galactokinase, alkaline phosphatase, secreted embryonic alkaline phosphatase (SEAP) or a resistance gene (such as a resistance gene against neomycin, puromycin, hygromycin and zeocin). In preferred embodiments, the artificial nucleic acid molecule, preferably RNA, does not encode a reporter gene or a marker gene. In preferred embodiments, the artificial nucleic acid molecule, preferably RNA, does not encode luciferase. In other embodiments, the artificial nucleic acid molecule, preferably RNA, does not encode GFP or a variant thereof.

Specifically, artificial nucleic acid molecules, in particular RNAs, according to the invention may comprise preferably in 5' to 3' direction, the following elements:
a) a 5'-CAP structure, preferably m7GpppN or Cap1
b) a 5'-UTR element, which comprises or consists of a nucleic acid sequence, which is derived from a 5'-UTR as defined herein, preferably comprising a nucleic acid sequence corresponding to the nucleic acid sequence according to SEQ ID NO: 3061, 3063, or a homolog, fragment or variant thereof;
c) at least one coding sequence as defined herein;
d) a 3'-UTR element, which comprises or consists of a nucleic acid sequence, which is derived from a 3'-UTR as defined herein, preferably comprising a nucleic acid sequence corresponding to the nucleic acid sequence according to SEQ ID NO: 3065, 3067, 3069, 3071, 3073, 3075, 3077, or a homolog, a fragment or a variant thereof,
e) optionally a poly(A) tail, preferably consisting of 10 to 1000, 10 to 500, 10 to 300 10 to 200, 10 to 100, 40 to 80 or 50 to 70 adenosine nucleotides,
f) optionally a poly(C) tail, preferably consisting of 10 to 200, 10 to 100, 20 to 70, 20 to 60 or 10 to 40 cytosine nucleotides, and
g) optionally a histone stem-loop.

Complexation

According to some embodiments of the present invention, the artificial nucleic acid molecule, preferably RNA, of the invention, and/or any other nucleic acid disclosed herein (e.g. immunostimulatory nucleic acids) may be provided in a "naked" form, i.e. without being associated with any further vehicle, transfection or complexation agent for increasing the transfection efficiency and/or the immunostimulatory properties of said artificial nucleic acid molecule, preferably RNA, or of any other nucleic acid.

According to other preferred embodiments, the artificial nucleic acid molecule, preferably RNA, of the invention, and/or any other nucleic acid disclosed herein (e.g. immunostimulatory nucleic acids) is/are provided in a complexed form. Therein, the at least artificial nucleic acid molecule, preferably RNA, or any other nucleic acid disclosed herein may be associated with a suitable vehicle, transfection or complexation agent for increasing the transfection efficiency and/or the immunostimulatory properties of said artificial nucleic acid molecule, preferably RNA, or said other nucleic acid.

According to preferred embodiments, said artificial nucleic acid molecule, preferably RNA, and/or said other nucleic acid(s)) is/are complexed or associated with one or more (poly-)cationic compounds, preferably with (poly-)cationic polymers, (poly-)cationic peptides or proteins, e.g. protamine, (poly-)cationic polysaccharides and/or [(poly-)cationic]lipids. In this context, the terms "complexed" or "associated" refer to the essentially stable combination of said artificial nucleic acid molecule, preferably RNA, or said other nucleic acid, with one or more of the aforementioned compounds into larger complexes or assemblies without covalent binding.

Lipids

According to preferred embodiments, the artificial nucleic acid molecule, preferably RNA, or any other nucleic acid disclosed herein, is complexed with one or more lipids, thereby forming lipid nanoparticles, lipoplexes and/or preferably liposomes.

Therefore, the artificial nucleic acid molecule, preferably RNA, of the invention and/or any other nucleic acid disclosed herein may be provided in the form of a lipid-based formulation, in particular in the form of liposomes, lipoplexes, and/or lipid nanoparticles comprising said artificial nucleic acid molecule, preferably RNA, and/or said other nucleic acid disclosed herein.

The term "lipid nanoparticle", also referred to as "LNP", is not restricted to any particular morphology, and include any morphology generated when a cationic lipid and optionally one or more further lipids are combined, e.g. in an aqueous environment and/or in the presence of RNA. For example, a liposome, a lipid complex, a lipoplex and the like are within the scope of a lipid nanoparticle (LNP).

Lipid Nanoparticles

The artificial nucleic acid molecule, preferably RNA, of the invention, or any other nucleic acid disclosed herein, may be complexed or associated with lipids (in particular cationic and/or neutral lipids) to form one or more lipid nanoparticles.

Preferably, lipid nanoparticles (LNPs) comprise: (a) at least one artificial nucleic acid molecule, preferably RNA, of the invention or any other nucleic acid disclosed herein, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol. In particular, LNPs may comprise, in addition to the at least one artificial nucleic acid molecule, preferably RNA, of the invention, and/or any other nucleic acid disclosed herein (i) at least one cationic lipid; (ii) a neutral lipid; (iii) a sterol, e.g., cholesterol; and (iv) a PEG-lipid, in a molar ratio of about 20-60% cationic lipid: 5-25% neutral lipid:25-55% sterol; 0.5-15% PEG-lipid.

The artificial nucleic acid molecule, preferably RNA, of the invention and/or any other nucleic acid disclosed herein, may be formulated in an aminoalcohol lipidoid. Aminoalcohol lipidoids which may be used in the present invention may be prepared by the methods described in U.S. Pat. No. 8,450,298, herein incorporated by reference in its entirety.

LNPs typically comprise a cationic lipid and one or more excipient selected from neutral lipids, charged lipids, steroids and polymer conjugated lipids (e.g. PEGylated lipid). The RNA may be encapsulated in the lipid portion of the LNP or an aqueous space enveloped by some or the entire lipid portion of the LNP. The RNA or a portion thereof may also be associated and complexed with the LNP. An LNP may comprise any lipid capable of forming a particle to which the nucleic acids are attached, or in which the one or more nucleic acids are encapsulated. Preferably, the LNP comprising nucleic acids comprises one or more cationic lipids, and one or more stabilizing lipids. Stabilizing lipids include neutral lipids and PEGylated lipids.

The cationic lipid of an LNP may be cationisable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

(i) Cationic Lipids

LNPs may include any cationic lipid suitable for forming a lipid nanoparticle. Preferably, the cationic lipid carries a net positive charge at about physiological pH.

The cationic lipid may be an amino lipid. As used herein, the term "amino lipid" is meant to include those lipids having one or two fatty acid or fatty alkyl chains and an amino head group (including an alkylamino or dialkylamino group) that may be protonated to form a cationic lipid at physiological pH.

The cationic lipid may be, for example, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-di-ylinolenyloxy-N,N-dimethylaminopropane (γ-DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta-[d][1,3]dioxol-5-amine, (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)-didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), (6Z,9Z,28Z,31Z)-heptatriaconta-6,9,28,31-tetraen-19-yl 4-(di-methylamino)butanoate (DLin-M-C3-DMA), 3-((6Z,9Z,28Z,31 Z)-heptatriaconta-6,9,28,31-tetraen-19-yloxy)-N,N-dimethylpropan-1-amine (MC3 Ether), 4-((6Z,9Z,28Z,31Z)-heptatriaconta-6,9,28,31-tetraen-19-yloxy)-N,N-dimethyl-butan-1-amine (MC4 Ether), or any combination of any of the foregoing.

Other cationic lipids include, but are not limited to, N,N-distearyl-N,N-dimethylammonium bromide (DDAB), 3P—(N—(N',N'-dimethylaminoethane)-carbamoyl)cholesterol (DC-Chol), N-(1-(2,3-dioleyloxy)propyl)-N-2-(spermine-carboxamido)ethyl)-N,N-dimethylammonium trifluoracetate (DOSPA), dioctadecylamidoglycyl carboxyspermine (DOGS), 1,2-dileoyl-sn-3-phosphoethanolamine (DOPE), 1,2-dioleoyl-3-dimethylammonium propane (DODAP), N-(1,2-dimyristyloxyprop-3-yl)-N,N-dimethyl-N-hydroxyethyl ammonium bromide (DMRIE), and 2,2-Dilinoleyl-4-dimethylaminoethyl-[1,3]-dioxolane (XTC). Additionally, commercial preparations of cationic lipids can be used, such as, e.g., LIPOFECTIN (including DOTMA and DOPE, available from GIBCO/BRL), and LIPOFECTAMINE (comprising DOSPA and DOPE, available from GIBCO/BRL).

Other suitable cationic lipids are disclosed in International Publication Nos. WO 09/086558, WO 09/127060, WO 10/048536, WO 10/054406, WO 10/088537, WO 10/129709, and WO 2011/153493; U.S. Patent Publication Nos. 2011/0256175, 2012/0128760, and 2012/0027803; U.S. Pat. No. 8,158,601; and Love et al, PNAS, 107(5), 1864-69, 2010.

In some embodiments, the lipid is selected from the group consisting of 98N12-5, C12-200, and ckk-E12.

In another embodiment, ionizable lipids can also be the compounds as disclosed in WO2015/074085A1 (i.e. ATX-001 to ATX-032 or the compounds as specified in claims 1-26), U.S. Appl. Nos. 61/905,724 and 15/614,499 or U.S. Pat. Nos. 9,593,077 and 9,567,296 hereby incorporated by reference in their entirety.

In that context, any lipid derived from generic Formula (LNP-I)

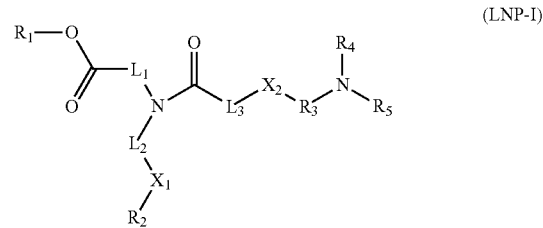

(LNP-I)

wherein, $R_1$ and $R_2$ are the same or different, each a linear or branched alkyl consisting of 1 to 9 carbons, an alkenyl or alkynyl consisting of 2 to 11 carbons, $L_1$ and $L_2$ are the same or different, each a linear alkylene or alkenylene consisting of 5 to 18 carbons, or forming a heterocycle with N, $X_1$ is a bond, or is —CO—O— whereby -$L_2$-CO—O—$R_2$ is formed, $X_2$ is S or O, $L_3$ is a bond or a linear or branched alkylene consisting of 1 to 6 carbons, or forming a heterocycle with N, $R_3$ is a linear or branched alkylene consisting of 1 to 6 carbons, and $R_4$ and $R_5$ are the same or different, each hydrogen or a linear or branched alkyl consisting of 1 to 6 carbons; or a pharmaceutically acceptable salt thereof may be suitably used.

In other embodiments, suitable cationic lipids can also be the compounds as disclosed in WO2017/117530A1 (i.e. lipids 13, 14, 15, 16, 17, 18, 19, 20, or the compounds as specified in the claims), hereby incorporated by reference in its entirety.

In that context, any lipid derived from generic Formula (LNP-II)

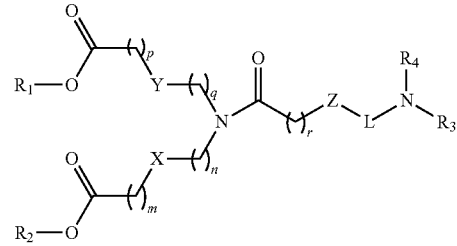

wherein
X is a linear or branched alkylene or alkenylene, monocyclic, bicyclic, or tricyclic arene or heteroarene;
Y is a bond, an ethene, or an unsubstituted or substituted aromatic or heteroaromatic ring; Z is S or O;
L is a linear or branched alkylene of 1 to 6 carbons;
$R_3$ and $R_4$ are independently a linear or branched alkyl of 1 to 6 carbons;
$R_1$ and $R_2$ are independently a linear or branched alkyl or alkenyl of 1 to 20 carbons; r is 0 to 6; and
m, n, p, and q are independently 1 to 18;

wherein when n=q, m=p, and R$_1$=R$_2$, then X and Y differ;
wherein when X=Y, n=q, m=p, then R$_1$ and R$_2$ differ;
wherein when X=Y, n=q, and R$_1$=R$_2$, then m and p differ; and
wherein when X=Y, m=p, and R$_1$=R$_2$, then n and q differ;
or a pharmaceutically acceptable salt thereof.

In preferred embodiments, a lipid may be used derived from Formula (LNP-II), wherein, X is a bond, linear or branched alkylene, alkenylene, or monocyclic, bicyclic, or tricyclic arene or heteroarene; Y is a monocyclic, bicyclic, or tricyclic arene or heteroarene; Z is S or O; L is a linear or branched alkylene of 1 to 6 carbons; R$_3$ and R$_4$ are independently a linear or branched alkyl of 1 to 6 carbons; R$_1$ and R$_2$ are independently a linear or branched alkyl or alkenyl of 1 to 20 carbons; r is 0 to 6; and m, n, p, and q are independently 1 to 18; or a pharmaceutically acceptable salt thereof may be suitably used.

In preferred embodiments, ionizable lipids may also be selected from the lipid compounds disclosed in PCT application PCT/EP2017/077517 (i.e. lipid compounds derived form Formula I, II, and III of PCT/EP2017/077517, or lipid compounds as specified in Claims 1 to 12 of PCT/EP2017/077517), the disclosure of PCT/EP2017/077517 hereby incorporated by reference in its entirety. In that context, lipid compounds disclosed in Table 7 of PCT/EP2017/077517 (e.g. lipid compounds derived from Formula I-1 to 1-41) and lipid compounds disclosed in Table 8 of PCT/EP2017/077517 (e.g. lipid compounds derived from Formula II-1 to 11-36) may be suitably used in the context of the invention. Accordingly, Formula I-1 to Formula I-41 and Formula II-1 to Formula II-36 of PCT/EP2017/077517, and the specific disclosure relating thereto, are herewith incorporated by reference.

In particularly preferred embodiments of the second aspect, a suitable lipid may be a cationic lipid according to Formula (LNP-III)

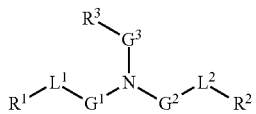

or a pharmaceutically acceptable salt, tautomer, prodrug or stereoisomer thereof, wherein, R$^1$, R$^2$, R$^3$, L$^1$, L$^2$, G$^1$, G$^2$, and G$^3$ are as below.

Formula (LNP-III) is further defined in that: one of L$^1$ or L$^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, —NR$^a$C(=O)NR$^a$—, —OC(=O)NR$^a$— or —NR$^a$C(=O)O—, and the other of L$^1$ or L$^2$ is —O(C=O)—, —(C=O)O—, —C(=O)—, —O—, —S(O)$_x$—, —S—S—, —C(=O)S—, SC(=O)—, —NR$^a$C(=O)—, —C(=O)NR$^a$—, —NR$^a$C(=O)NR$^a$—, —OC(=O)NR$^a$— or —NR$^a$C(=O)O— or a direct bond;

G$^1$ and G$^2$ are each independently unsubstituted C$_1$-C$_{12}$ alkylene or C$_1$-C$_{12}$ alkenylene;

G$^3$ is C$_1$-C$_{24}$ alkylene, C$_1$-C$_{24}$ alkenylene, C$_3$-C$_8$ cycloalkylene, C$_3$-C$_8$ cycloalkenylene;

R$^a$ is H or C$_1$-C$_{12}$ alkyl;

R$^1$ and R$^2$ are each independently C$_6$-C$_{24}$ alkyl or C$_6$-C$_{24}$ alkenyl;

R$^3$ is H, OR$^5$, CN, —C(=O)OR$^4$, —OC(=O)R$^4$ or —NR$^5$C(=O)R$^4$;

R$^4$ is C$_1$-C$_{12}$ alkyl;

R$^5$ is H or C$_1$-C$_6$ alkyl; and x is 0, 1 or 2.

In some of the foregoing embodiments of Formula (LNP-III), the lipid has one of the following structures (LNP-IIIA) or (LNP-IIIB):

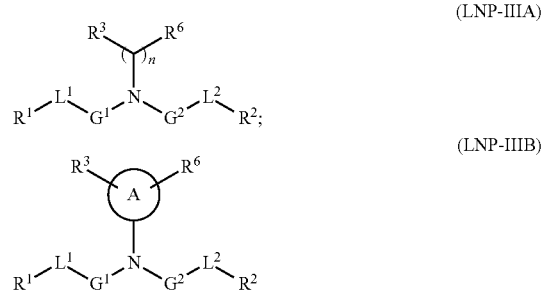

wherein:

A is a 3 to 8-membered cycloalkyl or cycloalkylene ring;

R$^6$ is, at each occurrence, independently H, OH or C$_1$-C$_{24}$ alkyl;

n is an integer ranging from 1 to 15.

In some of the foregoing embodiments of Formula (LNP-III), the lipid has structure (LNP-IIIA), and in other embodiments, the lipid has structure (LNP-IIIB).

In other embodiments of Formula (LNP-III), the lipid has one of the following structures (LNP-IIIC) or (LNP-IIID):

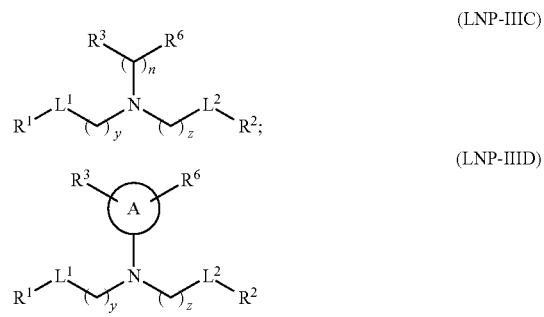

wherein y and z are each independently integers ranging from 1 to 12.

In any of the foregoing embodiments of Formula (LNP-III), one of L$^1$ or L$^2$ is —O(C=O)—. For example, in some embodiments each of L$^1$ and L$^2$ are —O(C=O)—. In some different embodiments of any of the foregoing, L$^1$ and L$^2$ are each independently —(C=O)O— or —O(C=O)—. For example, in some embodiments each of L$^1$ and L$^2$ is —(C=O)O—.

In preferred embodiments, the cationic lipid of the LNP is a compound of Formula (LNP-III), wherein:

L$^1$ and L$^2$ are each independently —O(C=O)— or (C=O)—O—;

G$^3$ is C$_1$-C$_{24}$ alkylene or C$_1$-C$_{24}$ alkenylene; and

R$^3$ is H or OR$^5$.

In some different embodiments of Formula (LNP-III), the lipid has one of the following structures (LNP-IIIE) or (LNP-IIIF):

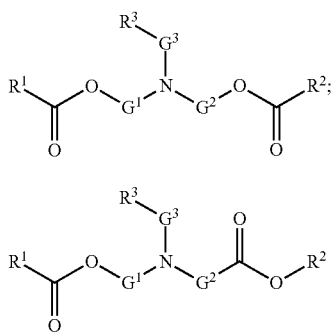

(LNP-IIIE)

(LNP-IIIF)

In some of the foregoing embodiments of Formula (LNP-III), the lipid has one of the following structures (LNP-IIIG), (LNP-IIIH), (LNP-IIII), or (LNP-IIIJ):

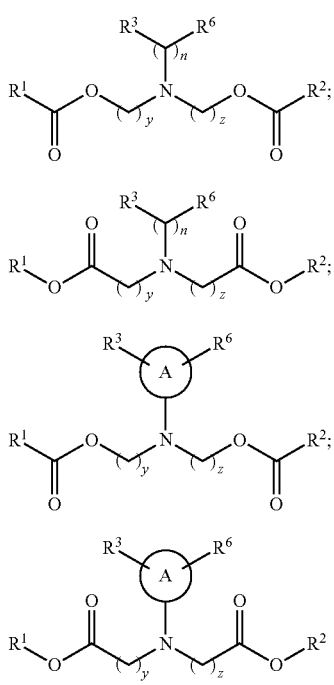

(LNP-IIIG)

(LNP-IIIH)

(LNP-IIII)

(LNP-IIIJ)

In some of the foregoing embodiments of Formula (LNP-III), n is an integer ranging from 2 to 12, for example from 2 to 8 or from 2 to 4. In some embodiments, n is 3, 4, 5 or 6. In some embodiments, n is 3. In some embodiments, n is 4.

In some embodiments, n is 5. In some embodiments, n is 6. In some other of the foregoing embodiments of Formula (LNP-III), y and z are each independently an integer ranging from 2 to 10. For example, in some embodiments, y and z are each independently an integer ranging from 4 to 9 or from 4 to 6. In some of the foregoing embodiments of Formula (LNP-III), $R^6$ is H. In other of the foregoing embodiments, $R^6$ is $C_1$-$C_{24}$ alkyl. In other embodiments, $R^6$ is OH. In some embodiments of Formula (LNP-III), $G^3$ is unsubstituted. In other embodiments, $G^3$ is substituted. In various different embodiments, $G^3$ is linear $C_1$-$C_{24}$ alkylene or linear $C_1$-$C_{24}$ alkenylene. In some other foregoing embodiments of Formula (LNP-III), $R^1$ or $R^2$, or both, is $C_6$-$C_{24}$ alkenyl. For example, in some embodiments, $R^1$ and $R^2$ each, independently have the following structure:

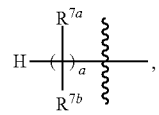

wherein:

$R^{7a}$ and $R^{7b}$ are, at each occurrence, independently H or $C_1$-$C_{12}$ alkyl; and a is an integer from 2 to 12, wherein $R^{7a}$, $R^{7b}$ and a are each selected such that $R^1$ and $R^2$ each independently comprise from 6 to 20 carbon atoms. For example, in some embodiments a is an integer ranging from 5 to 9 or from 8 to 12. In some of the foregoing embodiments of Formula (LNP-III), at least one occurrence of $R^{7a}$ is H. For example, in some embodiments, $R^{7a}$ is H at each occurrence. In other different embodiments of the foregoing, at least one occurrence of $R^{7b}$ is $C_1$-$C_8$ alkyl. For example, in some embodiments, $C_1$-$C_8$ alkyl is methyl, ethyl, n-propyl, iso-propyl, n-butyl, iso-butyl, tert-butyl, n-hexyl or n-octyl.

In different embodiments of Formula (LNP-III), $R^1$ or $R^2$, or both, has one of the following structures:

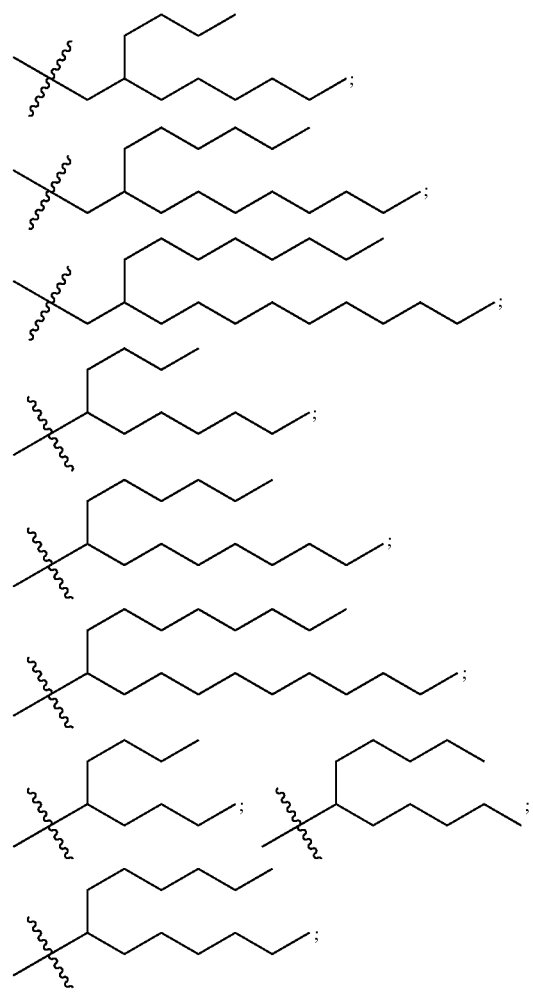

221

-continued

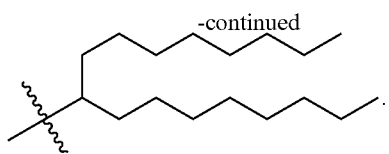

In preferred embodiments, the cationic lipid of the LNP is a compound of formula (LNP-III), wherein:
L$^1$ and L$^2$ are each independently —O(C=O)— or (C=O)—O—; and
R$^1$ and R$^2$ each independently have one of the following structures:

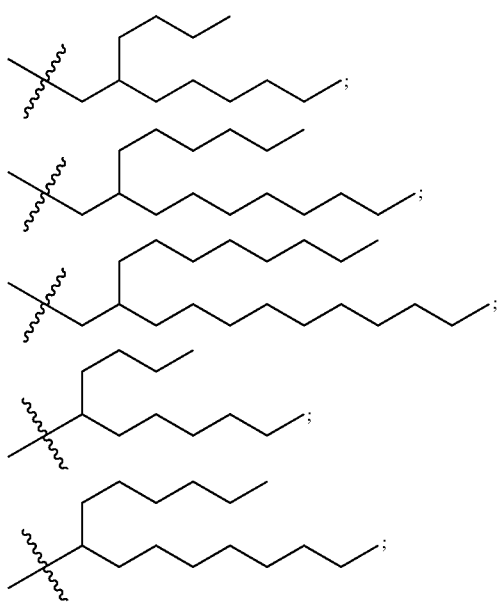

222

-continued

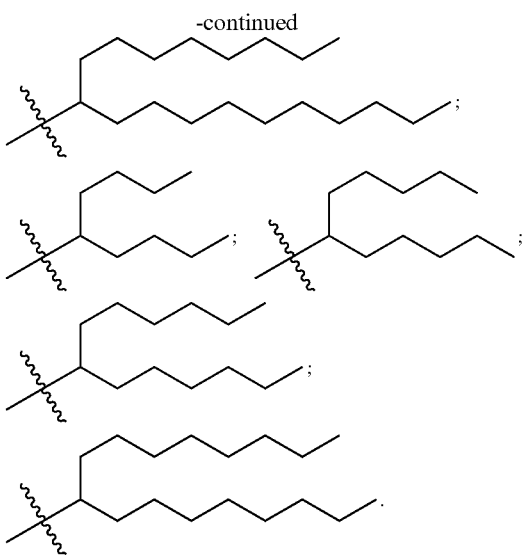

In some of the foregoing embodiments of Formula (LNP-III), R$^3$ is OH, CN, —C(=O)OR$^4$, —OC(=O)R$^4$ or —NHC(=O)R$^4$. In some embodiments, R$^4$ is methyl or ethyl.

In preferred embodiments of the second aspect, the cationic lipid of the LNP is a compound of Formula (LNP-III), wherein R$^3$ is OH.

In particularly preferred embodiment, the artificial nucleic acid, preferably RNA of the first aspect is complexed with one or more lipids thereby forming lipid nanoparticles (LNP), wherein the LNP is selected from structures (LNP-III-1) to (LNP-III-36) (see Table 6).

TABLE 6

Representative lipid compounds derived from Formula (LNP-III)

| No. | Structure |
|---|---|
| LNP-III-1 | 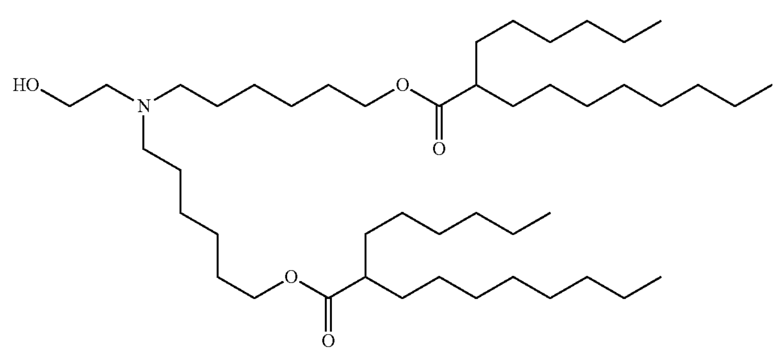 [SMILES: CCCCCCCCC(CCCCCC)C(=O)OCCCCCCN(CCO)CCCCCCOC(=O)C(CCCCCC)CCCCCCCC] |

TABLE 6-continued

Representative lipid compounds derived from Formula (LNP-III)

| No. | Structure |
|---|---|
| LNP-III-2 | 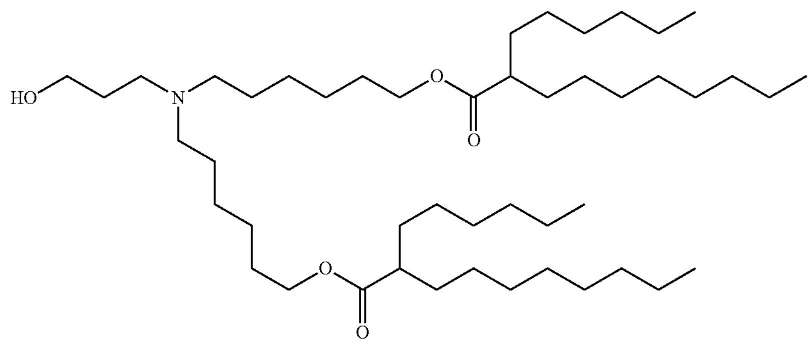 [SMILES: CCCCCCCCC(CCCCCC)C(=O)OCCCCCCN(CCCO)CCCCCCOC(=O)C(CCCCCC)CCCCCCCC] |
| LNP-III-3 | 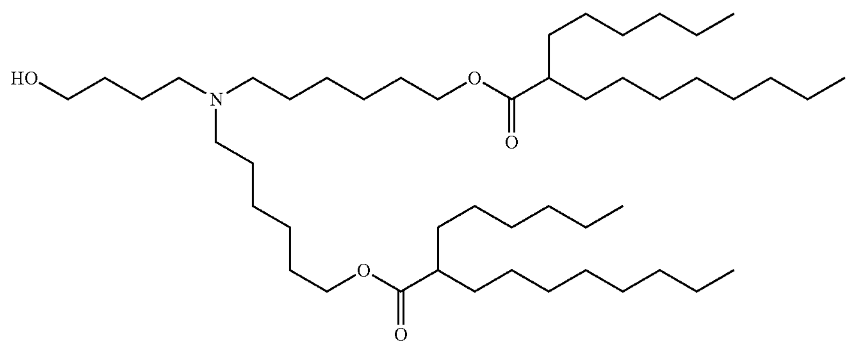 [SMILES: CCCCCCCCC(CCCCCC)C(=O)OCCCCCCN(CCCCO)CCCCCCOC(=O)C(CCCCCC)CCCCCCCC] |
| LNP-III-4 | 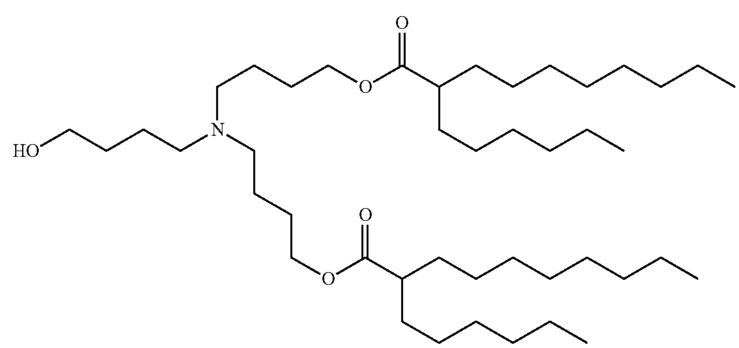 [SMILES: CCCCCCCCC(CCCCCC)C(=O)OCCCCN(CCCCO)CCCCOC(=O)C(CCCCCC)CCCCCCCC] |
| LNP-III-5 | 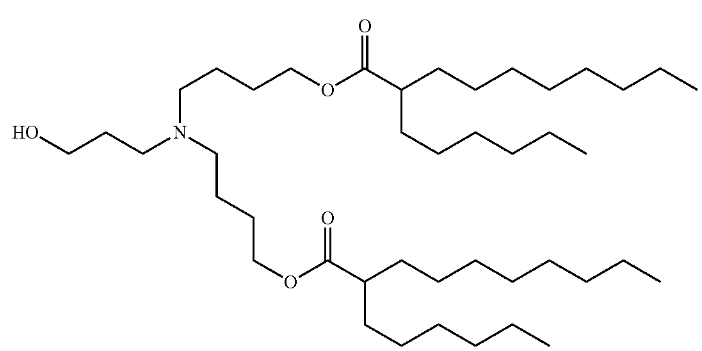 [SMILES: CCCCCCCCC(CCCCCC)C(=O)OCCCCN(CCCO)CCCCOC(=O)C(CCCCCC)CCCCCCCC] |

TABLE 6-continued

Representative lipid compounds derived from Formula (LNP-III)

| No. | Structure |
|---|---|
| LNP-III-6 | 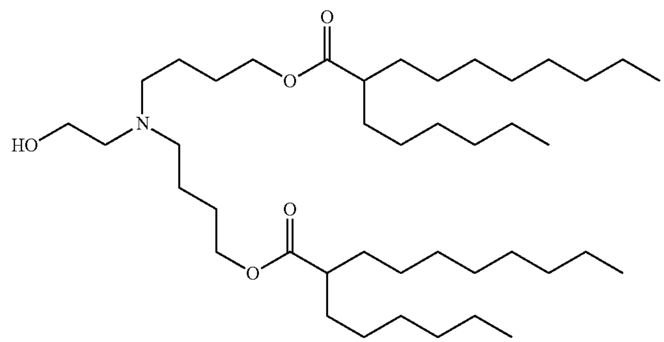 [SMILES: CCCCCCCCC(CCCCCC)C(=O)OCCCCN(CCO)CCCCOC(=O)C(CCCCCC)CCCCCCCC] |
| LNP-III-7 | 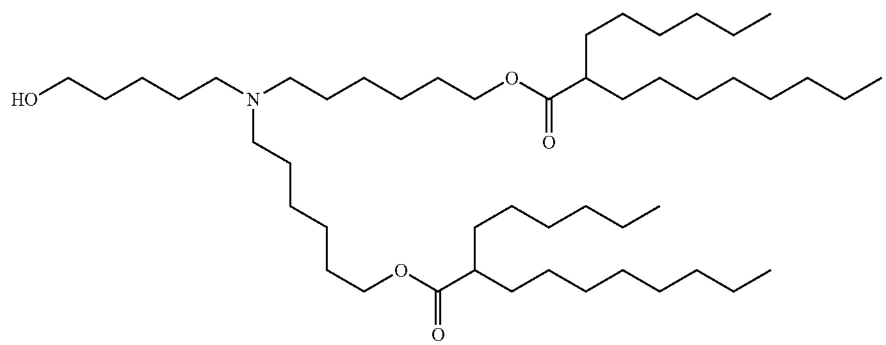 [SMILES: CCCCCCCCC(CCCCCC)C(=O)OCCCCCCN(CCCCCO)CCCCCCOC(=O)C(CCCCCC)CCCCCCCC] |
| LNP-III-8 | 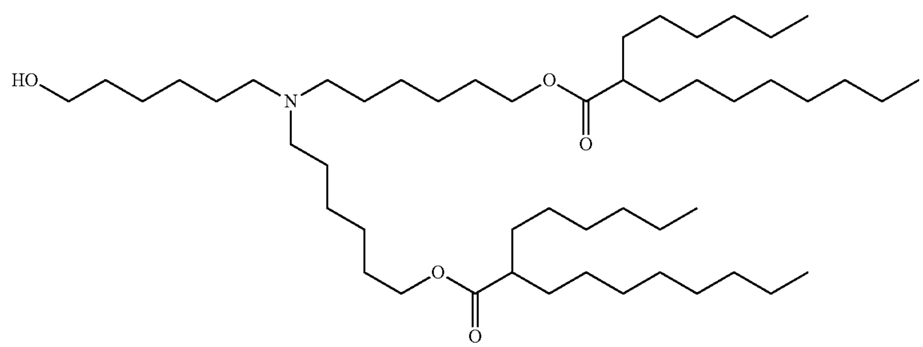 [SMILES: CCCCCCCCC(CCCCCC)C(=O)OCCCCCCN(CCCCCCO)CCCCCCOC(=O)C(CCCCCC)CCCCCCCC] |
| LNP-III-9 | 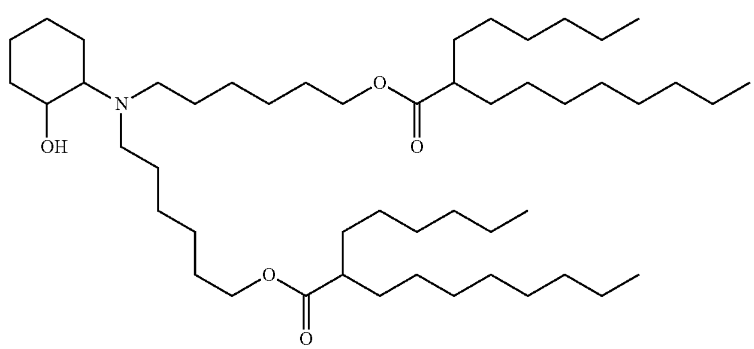 [SMILES: CCCCCCCCC(CCCCCC)C(=O)OCCCCCCN(CCCCCCOC(=O)C(CCCCCC)CCCCCCCC)C1CCCCC1O] |

TABLE 6-continued
Representative lipid compounds derived from Formula (LNP-III)
| No. | Structure |
|---|---|
| LNP-III-10 | 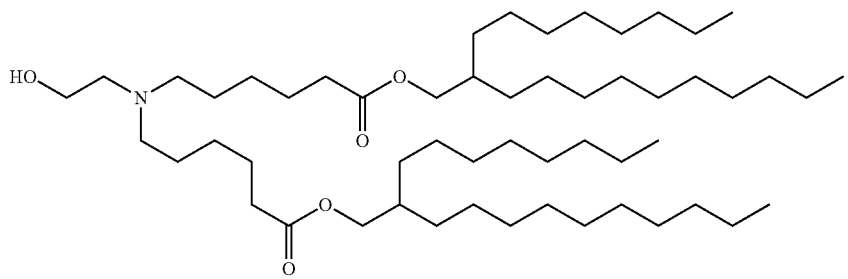 [SMILES: CCCCCCCCCCC(CCCCCCCC)COC(=O)CCCCCN(CCO)CCCCCC(=O)OCC(CCCCCCCC)CCCCCCCCCC] |
| LNP-III-11 | 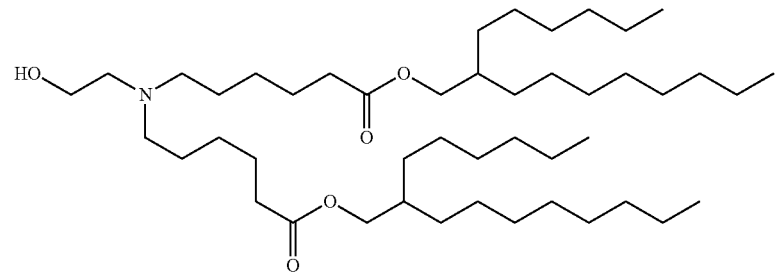 [SMILES: CCCCCCCCC(CCCCCC)COC(=O)CCCCCN(CCO)CCCCCC(=O)OCC(CCCCCC)CCCCCCCC] |
| LNP-III-12 | 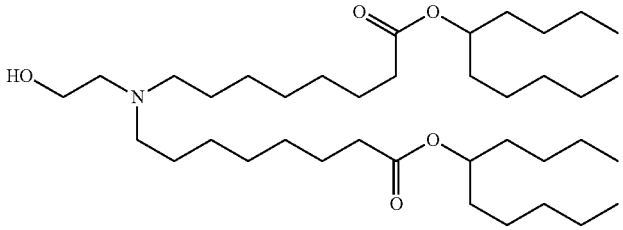 [SMILES: CCCCCC(CCCC)OC(=O)CCCCCCCN(CCO)CCCCCCCC(=O)OC(CCCC)CCCCC] |
| LNP-III-13 | 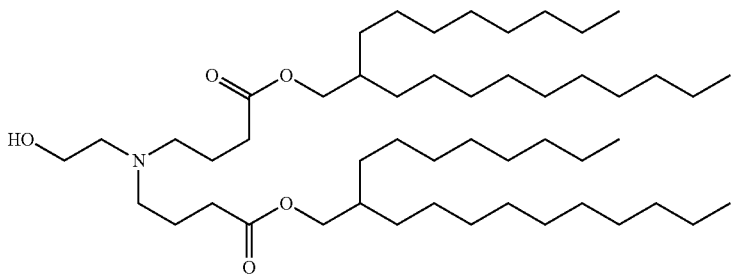 [SMILES: CCCCCCCCCCC(CCCCCCCC)COC(=O)CCCN(CCO)CCCC(=O)OCC(CCCCCCCC)CCCCCCCCCC] |
| LNP-III-14 | 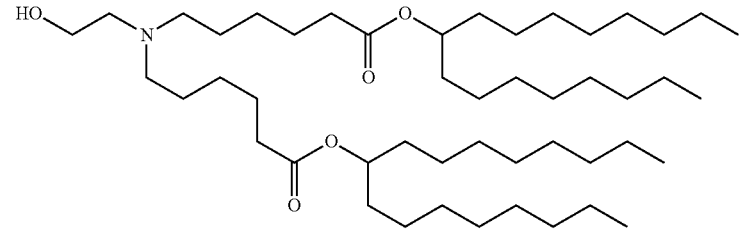 [SMILES: CCCCCCCCC(CCCCCCCC)OC(=O)CCCCCN(CCO)CCCCCC(=O)OC(CCCCCCCC)CCCCCCCC] |

TABLE 6-continued

Representative lipid compounds derived from Formula (LNP-III)

| No. | Structure |
|---|---|
| LNP-III-15 | 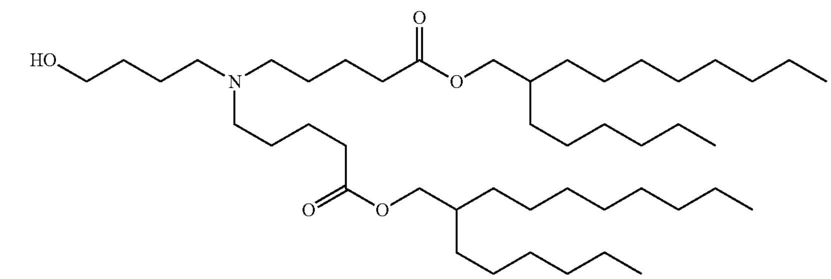 [SMILES: CCCCCCCCC(CCCCCC)COC(=O)CCCCN(CCCCO)CCCCC(=O)OCC(CCCCCC)CCCCCCCC] |
| LNP-III-16 | 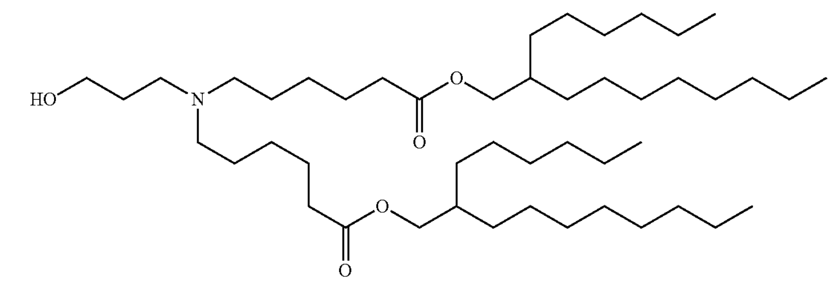 [SMILES: CCCCCCCCC(CCCCCC)COC(=O)CCCCCN(CCCO)CCCCCC(=O)OCC(CCCCCC)CCCCCCCC] |
| LNP-III-17 | 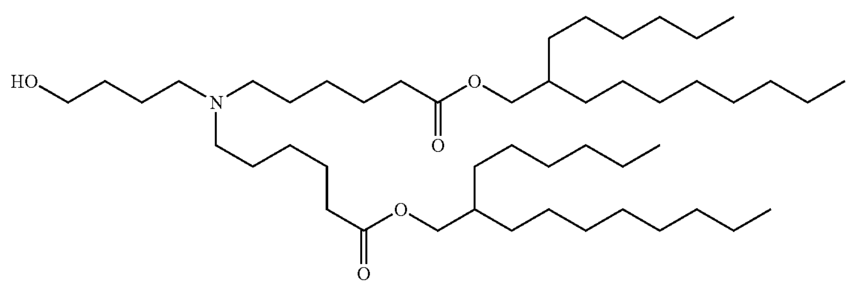 [SMILES: CCCCCCCCC(CCCCCC)COC(=O)CCCCCN(CCCCO)CCCCCC(=O)OCC(CCCCCC)CCCCCCCC] |
| LNP-III-18 | 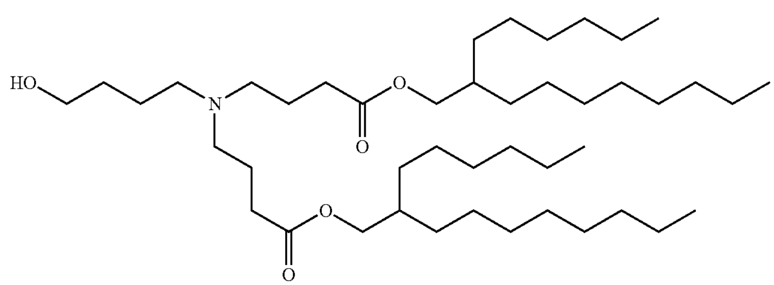 [SMILES: CCCCCCCCC(CCCCCC)COC(=O)CCCN(CCCCO)CCCC(=O)OCC(CCCCCC)CCCCCCCC] |
| LNP-III-19 | 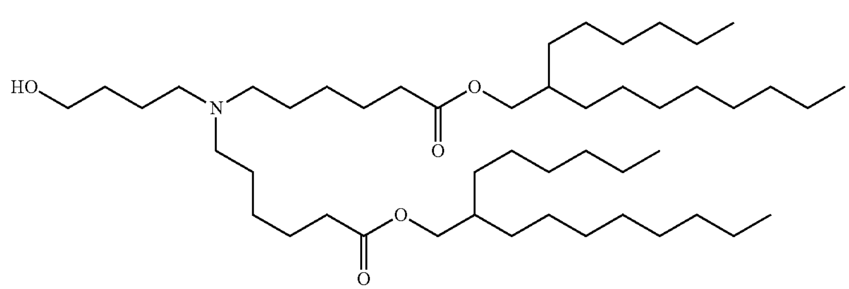 [SMILES: CCCCCCCCC(CCCCCC)COC(=O)CCCCCN(CCCCO)CCCCCC(=O)OCC(CCCCCC)CCCCCCCC] |

TABLE 6-continued

Representative lipid compounds derived from Formula (LNP-III)

| No. | Structure |
|---|---|
| LNP-III-20 | 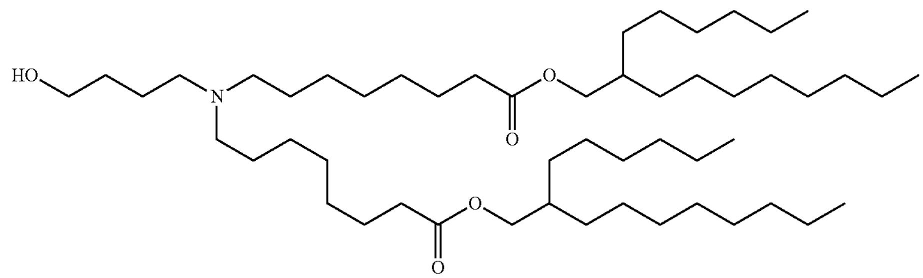 [SMILES: CCCCCCCCC(CCCCCC)COC(=O)CCCCCCCN(CCCCO)CCCCCCCC(=O)OCC(CCCCCC)CCCCCCCC] |
| LNP-III-21 | 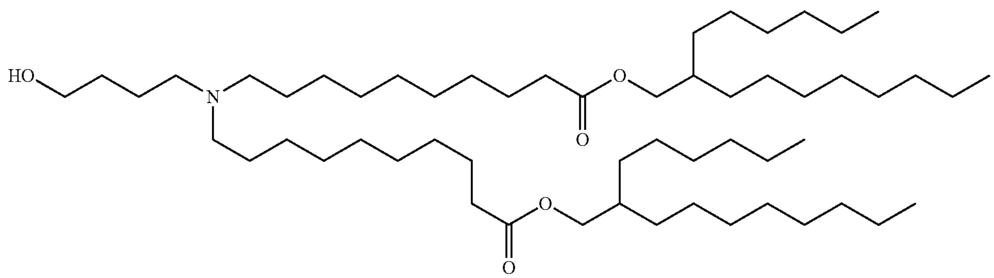 [SMILES: CCCCCCCCC(CCCCCC)COC(=O)CCCCCCCCCN(CCCCO)CCCCCCCCCC(=O)OCC(CCCCCC)CCCCCCCC] |
| LNP-III-22 | 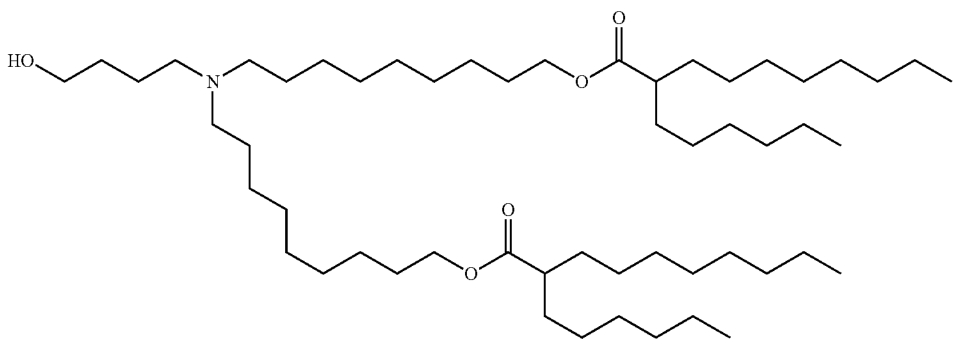 [SMILES: CCCCCCCCC(CCCCCC)C(=O)OCCCCCCCCCN(CCCCO)CCCCCCCCCOC(=O)C(CCCCCC)CCCCCCCC] |
| LNP-III-23 | 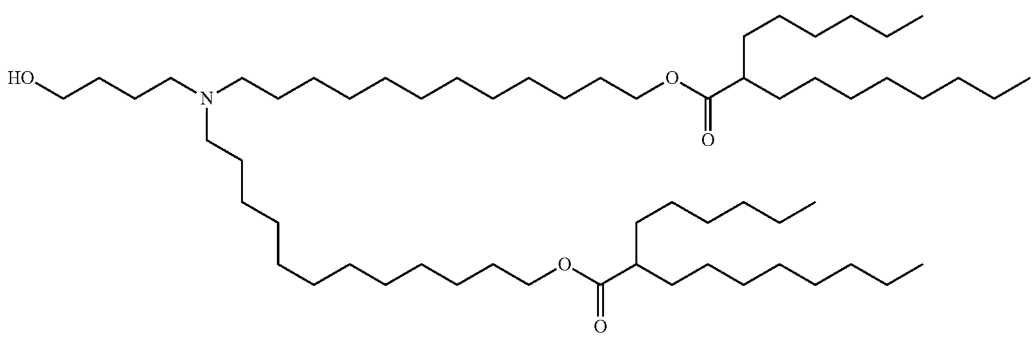 [SMILES: CCCCCCCCC(CCCCCC)C(=O)OCCCCCCCCCCCCN(CCCCO)CCCCCCCCCCCCOC(=O)C(CCCCCC)CCCCCCCC] |
| LNP-III-24 | 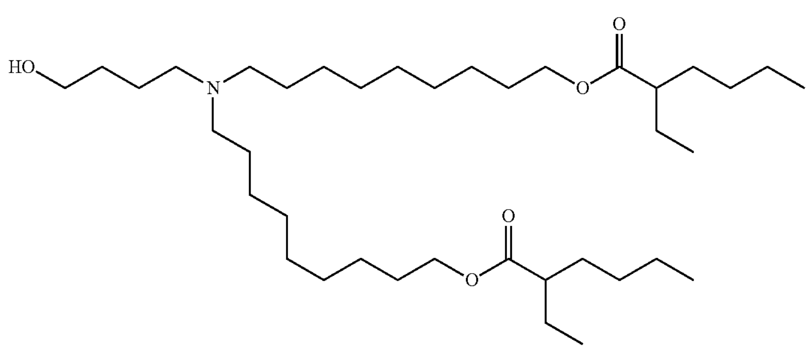 [SMILES: CCCCC(CC)C(=O)OCCCCCCCCCN(CCCCO)CCCCCCCCCOC(=O)C(CC)CCCC] |

TABLE 6-continued

Representative lipid compounds derived from Formula (LNP-III)

| No. | Structure |
|---|---|
| LNP-III-25 | 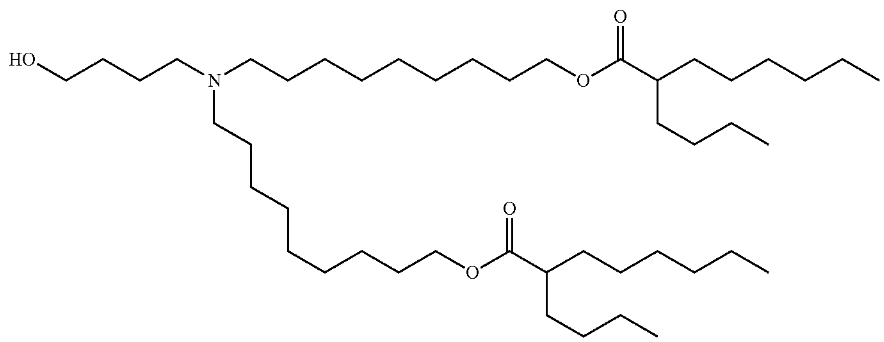 [SMILES: CCCCCCC(CCCC)C(=O)OCCCCCCCCCN(CCCCO)CCCCCCCCCOC(=O)C(CCCC)CCCCCC] |
| LNP-III-26 | 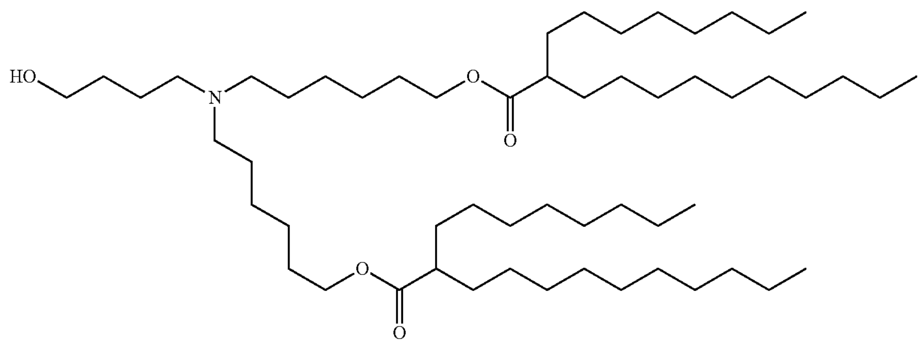 [SMILES: CCCCCCCCCCC(CCCCCCCC)C(=O)OCCCCCCN(CCCCO)CCCCCCOC(=O)C(CCCCCCCC)CCCCCCCCCC] |
| LNP-III-27 | 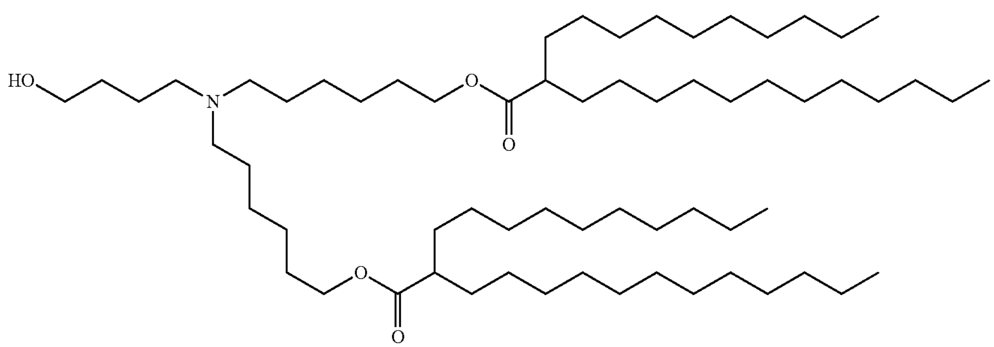 [SMILES: CCCCCCCCCCCCC(CCCCCCCCCC)C(=O)OCCCCCCN(CCCCO)CCCCCCOC(=O)C(CCCCCCCCCC)CCCCCCCCCCCC] |
| LNP-III-28 | 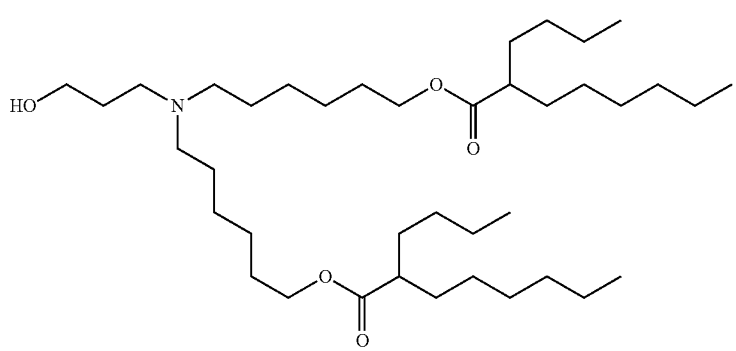 [SMILES: CCCCCCC(CCCC)C(=O)OCCCCCCN(CCCO)CCCCCCOC(=O)C(CCCC)CCCCCC] |

TABLE 6-continued

Representative lipid compounds derived from Formula (LNP-III)

| No. | Structure |
|---|---|
| LNP-III-29 | 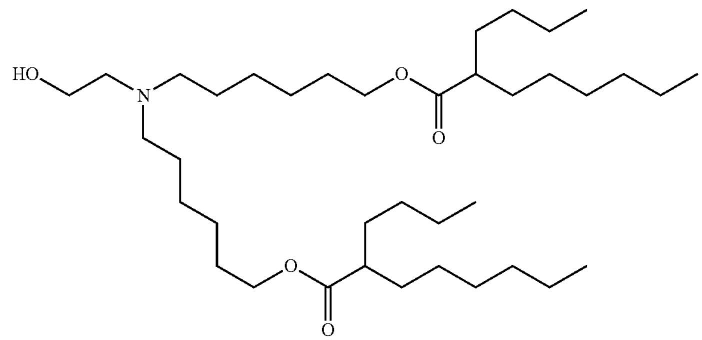 [SMILES: CCCCCCC(CCCC)C(=O)OCCCCCCN(CCO)CCCCCCOC(=O)C(CCCC)CCCCCC] |
| LNP-III-30 | 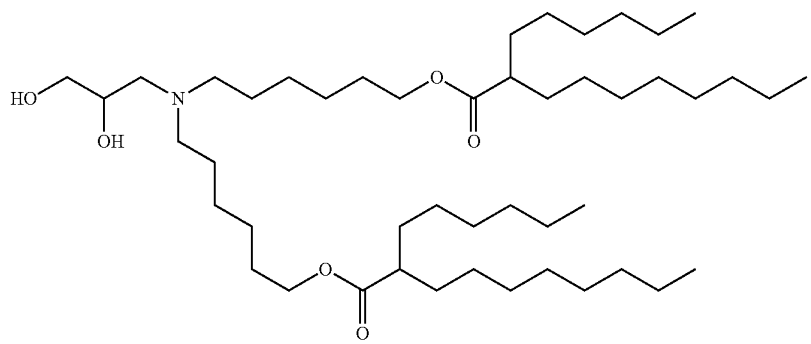 [SMILES: CCCCCCCCC(CCCCCC)C(=O)OCCCCCCN(CCCCCCOC(=O)C(CCCCCC)CCCCCCCC)CC(O)CO] |
| LNP-III-31 | 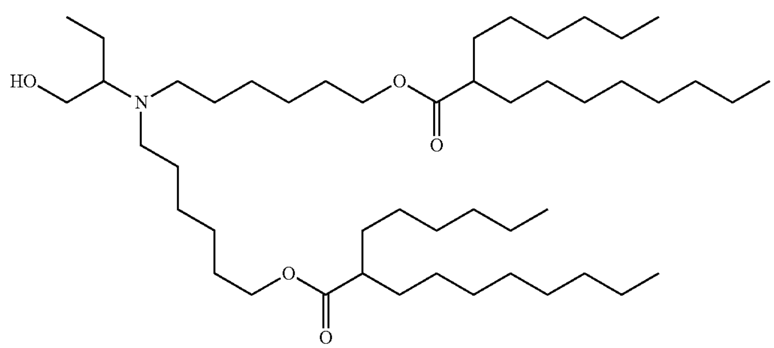 [SMILES: CCCCCCCCC(CCCCCC)C(=O)OCCCCCCN(CCCCCCOC(=O)C(CCCCCC)CCCCCCCC)C(CC)CO] |
| LNP-III-32 | 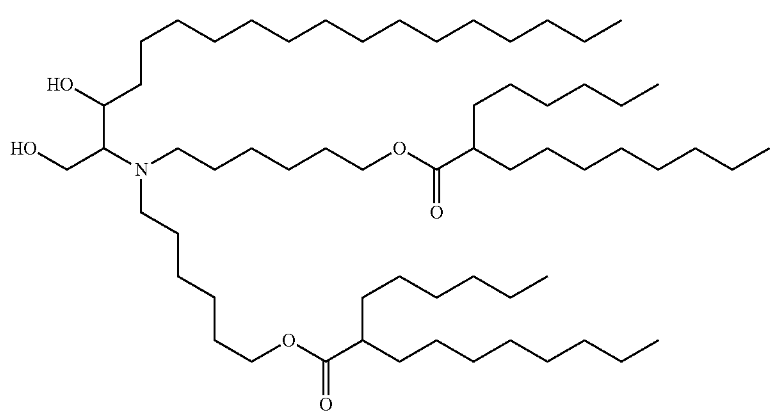 [SMILES: CCCCCCCCCCCCCCCC(O)C(CO)N(CCCCCCOC(=O)C(CCCCCC)CCCCCCCC)CCCCCCOC(=O)C(CCCCCC)CCCCCCCC] |

TABLE 6-continued

Representative lipid compounds derived from Formula (LNP-III)

| No. | Structure |
| --- | --- |
| LNP-III-33 | 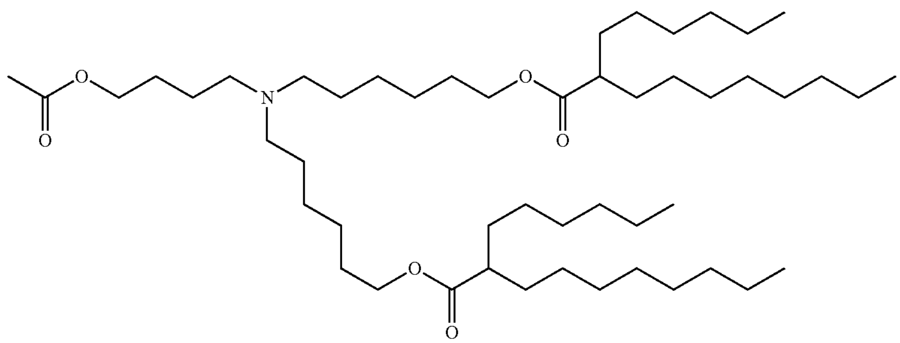 [SMILES: CCCCCCCCC(CCCCCC)C(=O)OCCCCCCN(CCCCCCOC(=O)C(CCCCCC)CCCCCCCC)CCCCOC(C)=O] |
| LNP-III-34 | 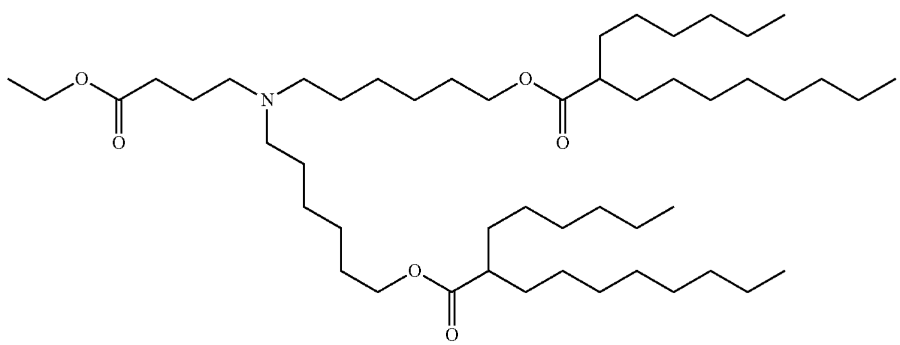 [SMILES: CCCCCCCCC(CCCCCC)C(=O)OCCCCCCN(CCCCCCOC(=O)C(CCCCCC)CCCCCCCC)CCCC(=O)OCC] |
| LNP-III-35 | 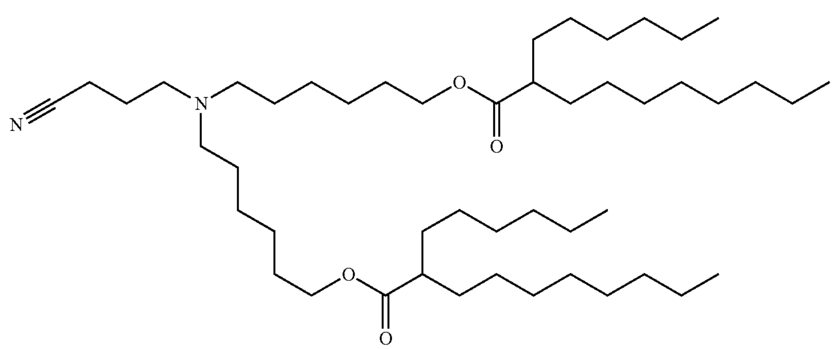 [SMILES: CCCCCCCCC(CCCCCC)C(=O)OCCCCCCN(CCCC#N)CCCCCCOC(=O)C(CCCCCC)CCCCCCCC] |
| LNP-III-36 | 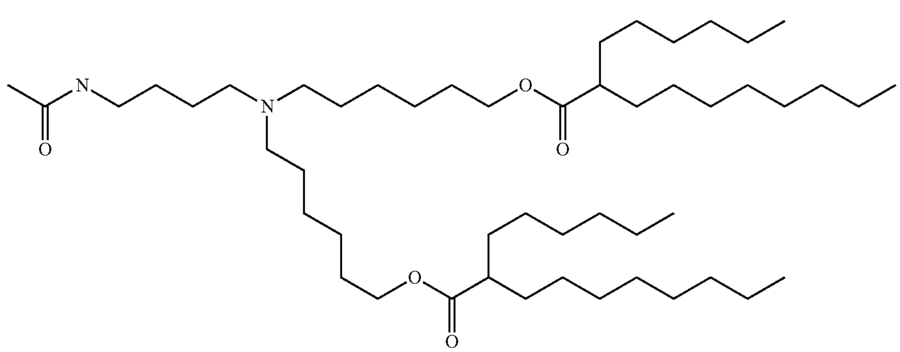 |

In some embodiments, the LNPs comprise a lipid of Formula (LNP-III), an artificial nucleic acid, preferably RNA of the first aspect, and one or more excipient selected from neutral lipids, steroids and PEGylated lipids. In some embodiments the lipid of Formula (LNP-III) is compound (LNP-III-3). In some embodiments the lipid of Formula (LNP-III) is compound (LNP-III-7).

In preferred embodiments, the LNP comprises a cationic lipid selected from:

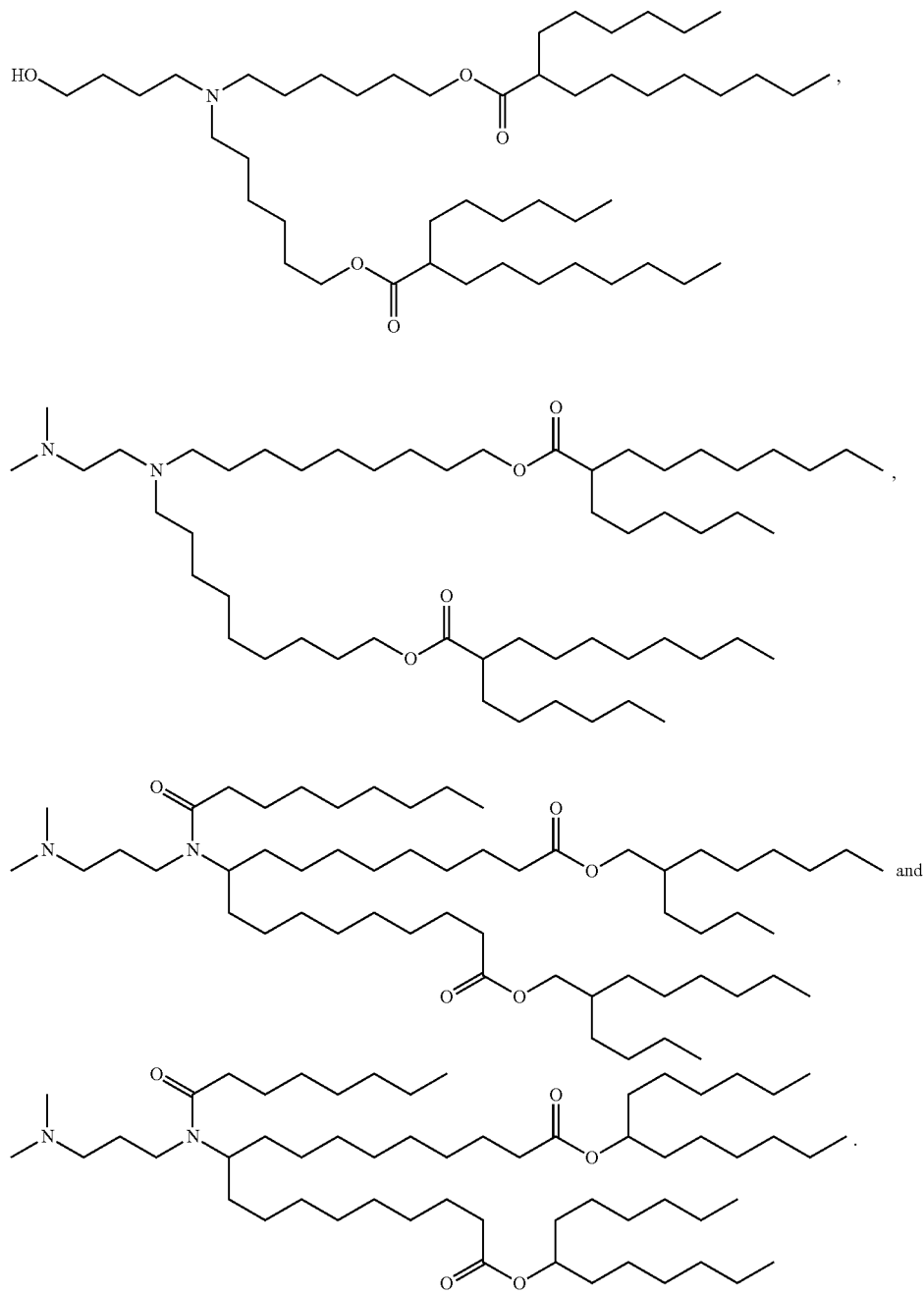

In particularly preferred embodiment, the artificial nucleic acid, preferably RNA of the first aspect is complexed with one or more lipids thereby forming lipid nanoparticles (LNP), wherein the LNP comprises the following cationic lipid (lipid according to Formula LNP-III-3 of Table 6):

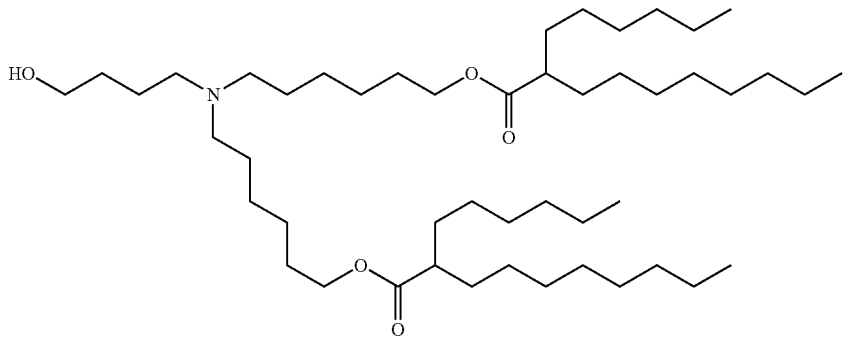 [SMILES: CCCCCCCCC(CCCCCC)C(=O)OCCCCCCN(CCCCO)CCCCCCOC(=O)C(CCCCCC)CCCCCCCC]

In certain embodiments, the cationic lipid as defined herein, preferably as disclosed in Table 6, more preferably cationic lipid compound LNP-III-3, is present in the LNP in an amount from about 30 to about 95 mole percent, relative to the total lipid content of the LNP. If more than one cationic lipid is incorporated within the LNP, such percentages apply to the combined cationic lipids.

In one embodiment, the cationic lipid is present in the LNP in an amount from about 30 to about 70 mole percent. In one embodiment, the cationic lipid is present in the LNP in an amount from about 40 to about 60 mole percent, such as about 40, 41, 42, 43, 44, 45, 46, 47, 48, 49, 50, 51, 52, 53, 54, 55, 56, 57, 58, 59 or 60 mole percent, respectively. In embodiments, the cationic lipid is present in the LNP in an amount from about 47 to about 48 mole percent, such as about 47.0, 47.1, 47.2, 47.3, 47.4, 47.5, 47.6, 47.7, 47.8, 47.9, 50.0 mole percent, respectively, wherein 47.7 mole percent are particularly preferred.

In some embodiments, the cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the lipid nanoparticle). In some embodiments, the ratio of cationic lipid to nucleic acid, preferably to the artificial RNA of the first aspect, is from about 3 to about 15, such as from about 5 to about 13 or from about 7 to about 11.

In some embodiments of the invention the LNP comprises a combination or mixture of any the lipids described above. Other suitable (cationic) lipids are disclosed in WO2009/086558, WO2009/127060, WO2010/048536, WO2010/054406, WO2010/088537, WO2010/129709, WO2011/153493, US2011/0256175, US2012/0128760, US2012/0027803, U.S. Pat. No. 8,158,601, WO2016118724, WO2016118725, WO2017070613, WO2017070620, WO2017099823, and WO2017112865. In that context, the disclosures of WO2009/086558, WO2009/127060, WO2010/048536, WO2010/054406, WO2010/088537, WO2010/129709, WO2011/153493, US2011/0256175, US2012/0128760, US2012/0027803, U.S. Pat. No. 8,158,601, WO2016118724, WO2016118725, WO2017070613, WO2017070620, WO2017099823, and WO2017112865 specifically relating to (cationic) lipids suitable for LNPs are incorporated herewith by reference.

In some embodiments, amino or cationic lipids as defined herein have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of lipids have to be present in the charged or neutral form. Lipids having more than one protonatable or deprotonatable group, or which are zwitterionic, are not excluded and may likewise suitable in the context of the present invention.

In some embodiments, the protonatable lipids have a pKa of the protonatable group in the range of about 4 to about 11, e.g., a pKa of about 5 to about 7.

LNPs can comprise two or more (different) cationic lipids. The cationic lipids may be selected to contribute different advantageous properties. For example, cationic lipids that differ in properties such as amine pKa, chemical stability, half-life in circulation, half-life in tissue, net accumulation in tissue, or toxicity can be used in the LNP. In particular, the cationic lipids can be chosen so that the properties of the mixed-LNP are more desirable than the properties of a single-LNP of individual lipids.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the RNA which is used as cargo. The N/P ratio may be calculated on the basis that, for example, 1 μg RNA typically contains about 3 nmol phosphate residues, provided that the RNA exhibits a statistical distribution of bases. The "N"-value of the lipid or lipidoid may be calculated on the basis of its molecular weight and the relative content of permanently cationic and—if present—cationisable groups.

LNP in vivo characteristics and behavior can be modified by addition of a hydrophilic polymer coating, e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids).

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

Other suitable amino lipids include those having alternative fatty acid groups and other dialkylamino groups, including those in which the alkyl substituents are different (e.g., N-ethyl-N-methylamino-, and N-propyl-N-ethylamino-). In general, amino lipids having less saturated acyl chains are more easily sized, particularly when the complexes must be sized below about 0.3 microns, for purposes of filter sterilization. Amino lipids containing unsaturated fatty acids with carbon chain lengths in the range of $C_{14}$ to $C_{22}$ may be used. Other scaffolds can also be used to separate the amino group and the fatty acid or fatty alkyl portion of the amino lipid.

Amino or cationic lipids may have at least one protonatable or deprotonatable group, such that the lipid is positively charged at a pH at or below physiological pH (e.g. pH 7.4), and neutral at a second pH, preferably at or above physiological pH. It will, of course, be understood that the addition or removal of protons as a function of pH is an equilibrium process, and that the reference to a charged or a neutral lipid refers to the nature of the predominant species and does not require that all of the lipid be present in the charged or neutral form. Lipids that have more than one protonatable or deprotonatable group, or which are zwitterionic, are not excluded from use in the invention.

The protonatable lipids may have a pKa of the protonatable group in the range of about 4 to about 11, e.g., a pKa of about 5 to about 7.

LNPs may include two or more cationic lipids. The cationic lipids may be selected to contribute different advantageous properties. For example, cationic lipids that differ in properties such as amine pKa, chemical stability, half-life in circulation, half-life in tissue, net accumulation in tissue, or toxicity may be used in the LNP. In particular, the cationic lipids may be chosen so that the properties of the mixed-LNP are more desirable than the properties of a single-LNP of individual lipids.

The cationic lipid may be present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. LNPs may comprise from about 25% to about 75% on a molar basis of cationic lipid, e.g., from about 20 to about 70%, from about 35 to about 65%, from about 45 to about 65%, about 60%, about 50% or about 40% on a molar basis (based upon 100% total moles of lipid in the lipid nanoparticle). The ratio of cationic lipid to nucleic acid may be from about 3 to about 15, such as from about 5 to about 13 or from about 7 to about 11. Specifically, the liposome may have a molar ratio of nitrogen atoms in the cationic lipid to the phosphates in the RNA (N:P ratio) of between 1:1 and 20:1 as described in International Publication No. WO 2013/006825 A1, herein incorporated by reference in its entirety. Alternatively, the liposome may have a N:P ratio of greater than 20:1 or less than 1:1.

(ii) Neutral and Non-Cationic Lipids

The non-cationic lipid may be a neutral lipid, an anionic lipid, or an amphipathic lipid. Neutral lipids, when present, may be selected any of a number of lipid species which exist either in an uncharged or neutral zwitterionic form at physiological pH. Such lipids include, for example, diacylphosphatidylcholine, diacylphosphatidylethanolamine, ceramide, sphingomyelin, dihydrosphingomyelin, cephalin, and cerebrosides. The selection of neutral lipids for use in the particles described herein is generally guided by consideration of, e.g., LNP size and stability of the LNP in the bloodstream. Preferably, the neutral lipid is a lipid having two acyl groups (e.g., diacylphosphatidylcholine and diacylphosphatidylethanolamine).

Neutral lipids may contain saturated fatty acids with carbon chain lengths in the range of $C_{10}$ to $C_{20}$. In other embodiments, neutral lipids with mono or diunsaturated fatty acids with carbon chain lengths in the range of $C_{10}$ to $C_{20}$ are used. Additionally or alternatively, neutral lipids having mixtures of saturated and unsaturated fatty acid chains may be used.

Suitable neutral lipids include, but are not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), dimyristoyl phosphatidylcholine (DMPC), distearoyl-phosphatidyl-ethanolamine (DSPE), SM, 16-O-monomethyl PE, 16-O-dimethyl PE, 18-1-trans PE, 1-stearoyl-2-oleoyl-phosphatidyethanolamine (SOPE), cholesterol, or a mixture thereof. Anionic lipids suitable for use in LNPs include, but are not limited to, phosphatidylglycerol, cardiolipin, diacyl-phosphatidylserine, diacylphosphatidic acid, N-dodecanoyl phosphatidylethanoloamine, N-succinyl phosphatidyl-ethanolamine, N-glutaryl phosphatidylethanolamine, lysylphosphatidylglycerol, and other anionic modifying groups joined to neutral lipids.

Amphipathic lipids refer to any suitable material, wherein the hydrophobic portion of the lipid material orients into a hydrophobic phase, while the hydrophilic portion orients toward the aqueous phase. Such compounds include, but are not limited to, phospholipids, aminolipids, and sphingolipids. Representative phospholipids include sphingomyelin, phosphatidylcholine, phosphatidylethanolamine, phosphatidylserine, phosphatidylinositol, phosphatidic acid, palmitoyloleoyl phosphatidylcholine, lysophosphatidylcholine, lysophosphatidylethanolamine, dipalmitoylphosphatidylcholine, dioleoylphosphatidylcholine, distearoylphosphatidylcholine, or dilinoleoylphosphatidylcholine. Other phosphorus-lacking compounds, such as sphingolipids, glycosphingolipid families, diacylglycerols, and beta-acyloxyacids, can also be used.

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

In preferred embodiments the neutral lipid is 1,2-distearoyl-sn-glycero-3-phosphocholine (DSPC). The molar ratio of the cationic lipid to DSPC may be in the range from about 2:1 to 8:1.

The non-cationic lipid may be present in a ratio of from about 5 mol % to about 90 mol %, about 5 mol % to about 10 mol %, about 5, 10, 15, 20, 25, 30, 35, 40, 45, 50, 55, 60, 65, 70, 75, 80, 85, or about 90 mol % of the total lipid present in the LNP.

LNPs may comprise from about 0% to about 15 or 45% on a molar basis of neutral lipid, e.g., from about 3 to about 12% or from about 5 to about 10%. For instance, LNPs may include about 15%, about 10%, about 7.5%, or about 7.1% of neutral lipid on a molar basis (based upon 100% total moles of lipid in the LNP).

(iii) Sterols

The sterol may preferably be cholesterol.

The sterol may be present in a ratio of about 10 mol % to about 60 mol % or about 25 mol % to about 40 mol % of the LNP. The sterol may be present in a ratio of about 10, 15, 20, 25, 30, 35, 40, 45, 50, 55, or about 60 mol % of the total lipid present in the LNP. LNPs may comprise from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the LNP).

(iv) Aggregation Reducing Agents

The aggregation reducing agent may be a lipid capable of reducing aggregation.

Examples of such lipids include, but are not limited to, polyethylene glycol (PEG)-modified lipids, monosialoganglioside Gml, and polyamide oligomers (PAO) such as those described in U.S. Pat. No. 6,320,017, which is incorporated by reference in its entirety. Other compounds with uncharged, hydrophilic, steric-barrier moieties, which prevent aggregation during formulation, like PEG, Gml or ATTA, can also be coupled to lipids. ATTA-lipids are described, e.g., in U.S. Pat. No. 6,320,017, and PEG-lipid conjugates are described, e.g., in U.S. Pat. Nos. 5,820,873, 5,534,499 and 5,885,613, each of which is incorporated by reference in its entirety.

The aggregation reducing agent may be, for example, selected from a polyethyleneglycol (PEG)-lipid including, without limitation, a PEG-diacylglycerol (DAG), a PEG-dialkylglycerol, a PEG-dialkyloxypropyl (DAA), a PEG-phospholipid, a PEG-ceramide (Cer), or a mixture thereof (such as PEG-Cer$_{14}$ or PEG-Cer$_{20}$). The PEG-DAA conjugate may be, for example, a PEG-dilauryloxypropyl (C$_{12}$), a PEG-dimyristyloxypropyl (C$_{14}$), a PEG-dipalmityloxypropyl (C$_{16}$), or a PEG-distearyloxypropyl (C$_{18}$). Other pegylated-lipids include, but are not limited to, polyethylene glycol-didimyristoyl glycerol (C$_{14}$-PEG or PEG-C$_{14}$, where PEG has an average molecular weight of 2000 Da) (PEG-DMG); (R)-2,3-bis(octadecyloxy)propyl-1-(methoxy poly(ethyleneglycol)2000)propylcarbamate) (PEG-DSG); PEG-carbamoyl-1,2-dimyristyloxypropylamine, in which PEG has an average molecular weight of 2000 Da (PEG-cDMA); N-Acetylgalactosamine-((R)-2,3-bis(octadecyloxy)propyl-1-(methoxy poly(ethylene glycol)2000)propylcarbamate)) (GalNAc-PEG-DSG); mPEG (mw2000)-diastearoylphosphatidyl-ethanolamine (PEG-DSPE); and polyethylene glycol-dipalmitoylglycerol (PEG-DPG).

Preferably, the aggregation reducing agent may be selected from PEG-DMG or PEG-c-DMA.

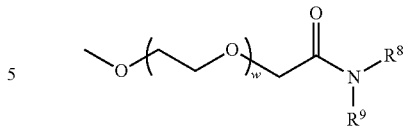
(LNP-IV)

or a pharmaceutically acceptable salt, tautomer or stereoisomer thereof, wherein $R^8$ and $R^9$ are each independently a straight or branched, saturated or unsaturated alkyl chain containing from 10 to 30 carbon atoms, wherein the alkyl chain is optionally interrupted by one or more ester bonds; and w has mean value ranging from 30 to 60.

In some of the foregoing embodiments of the PEGylated lipid according to Formula (LNP-IV), $R^8$ and $R^9$ are not both n-octadecyl when w is 42. In some other embodiments, $R^8$ and $R^9$ are each independently a straight or branched, saturated or unsaturated alkyl chain containing from 10 to 18 carbon atoms. In some embodiments, $R^8$ and $R^9$ are each independently a straight or branched, saturated or unsaturated alkyl chain containing from 12 to 16 carbon atoms. In some embodiments, $R^8$ and $R^9$ are each independently a straight or branched, saturated or unsaturated alkyl chain containing 12 carbon atoms. In some embodiments, $R^8$ and $R^9$ are each independently a straight or branched, saturated or unsaturated alkyl chain containing 14 carbon atoms. In other embodiments, $R^8$ and $R^9$ are each independently a straight or branched, saturated or unsaturated alkyl chain containing 16 carbon atoms. In still more embodiments, $R^8$ and $R^9$ are each independently a straight or branched, saturated or unsaturated alkyl chain containing 18 carbon atoms. In still other embodiments, $R^8$ is a straight or branched, saturated or unsaturated alkyl chain containing 12 carbon atoms and $R^9$ is a straight or branched, saturated or unsaturated alkyl chain containing 14 carbon atoms.

In various embodiments, w spans a range that is selected such that the PEG portion of the PEGylated lipid according to Formula (LNP-IV) has an average molecular weight of about 400 to about 6000 g/mol. In some embodiments, the average w is about 50.

In preferred embodiments of the second aspect, $R^8$ and $R^9$ of the PEGylated lipid according to Formula (LNP-IV) are saturated alkyl chains.

In a particularly preferred embodiment of the second aspect, the artificial RNA of the first aspect is complexed with one or more lipids thereby forming lipid nanoparticles (LNP), wherein the LNP additionally comprises a PEGylated lipid, wherein the PEG lipid is of Formula (LNP-IVa)

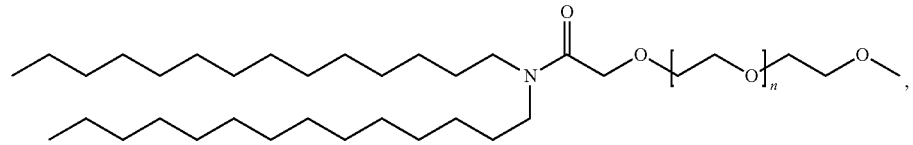
(LNP-IVa)

In preferred embodiments the artificial nucleic acid, preferably RNA of the first aspect is complexed with one or more lipids thereby forming lipid nanoparticles (LNP), wherein the LNP additionally comprises a PEGylated lipid with the Formula (LNP-IV):

wherein n has a mean value ranging from 30 to 60, such as about 28 to about 32, about 30 to about 34, 32 to about 36, about 34 to about 38, 36 to about 40, about 38 to about 42, 40 to about 44, about 42 to about 46, 44 to about 48, about 46 to about 50, 48 to about 52, about 50 to about 54, 52 to about 56, about 54 to about 58, 56 to about 60, about 58 to about 62. In preferred embodiments, n is about 45, 46, 47, 48, 49, 50, 51, 52, 53, 54. In a most preferred embodiment n has a mean value of 49.

In other embodiments, the PEGylated lipid has one of the following structures:

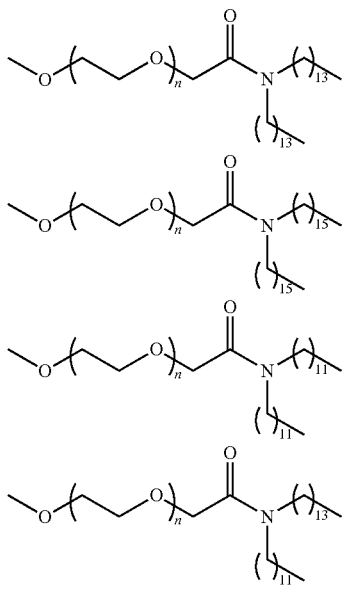

wherein n is an integer selected such that the average molecular weight of the PEGylated lipid is about 2500 g/mol, most preferably n is about 49.

Further examples of PEG-lipids suitable in that context are provided in US20150376115A1 and WO2015199952, each of which is incorporated by reference in its entirety.

In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2,5%, about 2%, about 1.5%, about 1%, about 0.5%, or about 0.3% on a molar basis (based on 100% total moles of lipids in the LNP). In preferred embodiments, LNPs comprise from about 1.0% to about 2.0% of the PEG-modified lipid on a molar basis, e.g., about 1.2 to about 1.9%, about 1.2 to about 1.8%, about 1.3 to about 1.8%, about 1.4 to about 1.8%, about 1.5 to about 1.8%, about 1.6 to about 1.8%, in particular about 1.4%, about 1.5%, about 1.6%, about 1.7%, about 1.8%, about 1.9%, most preferably 1.7% (based on 100% total moles of lipids in the LNP).

In various embodiments, the molar ratio of the cationic lipid to the PEGylated lipid ranges from about 100:1 to about 25:1.

LNP Composition

The composition of LNPs may be influenced by, inter alia, the selection of the cationic lipid component, the degree of cationic lipid saturation, the nature of the PEGylation, the ratio of all components and biophysical parameters such as its size. In one example by Semple et al. (Semple et al. Nature Biotech. 2010 28: 172-176; herein incorporated by reference in its entirety), the LNP composition was composed of 57.1% cationic lipid, 7.1% dipalmitoylphosphatidylcholine, 34.3% cholesterol, and 1.4% PEG-c-DMA (Basha et al. Mol Ther. 2011 19:2186-2200; herein incorporated by reference in its entirety).

LNPs may comprise from about 35 to about 45% cationic lipid, from about 40% to about 50% cationic lipid, from about 50% to about 60% cationic lipid and/or from about 55% to about 65% cationic lipid. The ratio of lipid to nucleic acid may range from about 5:1 to about 20: 1, from about 10:1 to about 25: 1, from about 15:1 to about 30: 1 and/or at least 30: 1.

The average molecular weight of the PEG moiety in the PEG-modified lipids can range from about 500 to about 8,000 Daltons (e.g., from about 1,000 to about 4,000 Daltons). In one preferred embodiment, the average molecular weight of the PEG moiety is about 2,000 Daltons.

The concentration of the aggregation reducing agent may range from about 0.1 to about 15 mol %, per 100% total moles of lipid in the LNP. In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 1.5%, about 0.5%, or about 0.3% on a molar basis (based on 100% total moles of lipids in the LNP).

Different LNPs having varying molar ratios of cationic lipid, non-cationic (or neutral) lipid, sterol (e.g., cholesterol), and aggregation reducing agent (such as a PEG-modified lipid) on a molar basis (based upon the total moles of lipid in the lipid nanoparticles) as depicted in Table 7 below. In preferred embodiments, the lipid nanoparticle formulation of the invention consists essentially of a lipid mixture in molar ratios of about 20-70% cationic lipid: 5-45% neutral lipid: 20-55% cholesterol, 0.5-15% PEG-modified lipid, more preferably in molar ratios of about 20-60% cationic lipid: 5-25% neutral lipid: 25-55% cholesterol: 0.5-15% PEG-modified lipid.

TABLE 7

Lipid-based formulations

Molar ratio of Lipids
(based upon 100% total moles of lipid in the lipid nanoparticle)

| # | Cationic Lipid | Non-Cationic (or Neutral) Lipid | Sterol | Aggregation Reducing Agent (e.g., PEG-lipid) |
|---|---|---|---|---|
| 1 | from about 35% to about 65% | from about 3% to about 12% or 15% | from about 15% to about 45% | from about 0.1% to about 10% (preferably from about 0.5% to about 2% or 3% |
| 2 | from about 20% to about 70% | from about 5% to about 45% | from about 20% to about 55% | from about 0.1% to about 10% (preferably from about 0.5% to about 2% or 3% |
| 3 | from about 45% to about 65% | from about 5% to about 10% | from about 5% to about 45% | from about 0.1% to about 3% |
| 4 | from about 20% to about 60% | from about 5% to about 25% | from about 25% to about 40% | from about 0.1% to about 5% (preferably from about 0.1% to about 3%) |
| 5 | about 40% | about 10% | from about 25% to about 55% | about 10% |

TABLE 7-continued

Lipid-based formulations

Molar ratio of Lipids
(based upon 100% total moles of lipid in the lipid nanoparticle)

| # | Cationic Lipid | Non-Cationic (or Neutral) Lipid | Sterol | Aggregation Reducing Agent (e.g., PEG-lipid) |
|---|---|---|---|---|
| 6 | about 35% | about 15% | | about 10% |
| 7 | about 52% | about 13% | | about 5% |
| 8 | about 50% | about 10% | | about 1.5% |

LNPs may occur as liposomes or lipoplexes as described in further detail below.

Preferably, lipid nanoparticles (LNPs) comprise: (a) at least one artificial nucleic acid, preferably RNA, (b) a cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In some embodiments, the LNPs comprise a lipid of Formula (LNP-III), an artificial nucleic acid, preferably RNA as defined above, a neutral lipid, a steroid and a PEGylated lipid. In preferred embodiments, the lipid of Formula (LNP-III) is lipid compound (LNP-III-3), the neutral lipid is DSPC, the steroid is cholesterol, and the PEGylated lipid is the compound of Formula (LNP-IVa).

In a preferred embodiment the LNP consists essentially of (i) at least one cationic lipid; (ii) a neutral lipid; (iii) a sterol, e.g., cholesterol; and (iv) a PEG-lipid, e.g. PEG-DMG or PEG-cDMA, in a molar ratio of about 20-60% cationic lipid:5-25% neutral lipid:25-55% sterol; 0.5-15% PEG-lipid.

In particularly preferred embodiments of the second aspect, the artificial nucleic acid, preferably RNA of the first aspect is complexed with one or more lipids thereby forming lipid nanoparticles (LNP), wherein the LNP essentially consists of
  (i) at least one cationic lipid as defined herein, preferably a lipid of Formula (LNP-III), more preferably lipid (LNP-III-3);
  (ii) a neutral lipid as defined herein, preferably 1,2-distearoyl-sn-glycero-3-phosphocholine (DSPC);
  (iii) a steroid or steroid analogue as defined herein, preferably cholesterol; and
  (iv) a PEG-lipid as defined herein, e.g. PEG-DMG or PEG-cDMA, preferably a PEGylated lipid of Formula (LNP-IVa),
  wherein (i) to (iv) are in a molar ratio of about 20-60% cationic lipid:5-25% neutral lipid:25-55% sterol; 0.5-15% PEG-lipid.

In one preferred embodiment, the lipid nanoparticle comprises: a cationic lipid with Formula (LNP-III) and/or PEG lipid with Formula (LNP-IV), optionally a neutral lipid, preferably 1,2-distearoyl-sn-glycero-3-phosphocholine (DSPC) and optionally a steroid, preferably cholesterol, wherein the molar ratio of the cationic lipid to DSPC is optionally in the range from about 2:1 to 8:1, wherein the molar ratio of the cationic lipid to cholesterol is optionally in the range from about 2:1 to 1:1.

In a particular preferred embodiment, the lipid nanoparticles (LNPs), have a molar ratio of approximately 50:10:38.5:1.5, preferably 47.5:10:40.8:1.7 or more preferably 47.4:10:40.9:1.7 (i.e. proportion (mol %) of cationic lipid (preferably lipid LNP-III-3), DSPC, cholesterol and PEG-lipid ((preferably PEG-lipid of Formula (LNP-IVa) with n=49); solubilized in ethanol).

The total amount of nucleic acid, preferably RNA in the lipid nanoparticles may vary and is defined depending on the e.g. RNA to total lipid w/w ratio. In one embodiment of the invention the artificial nucleic acid, preferably RNA to total lipid ratio is less than 0.06 w/w, preferably between 0.03 w/w and 0.04 w/w.

LNP Size

According to some embodiments, LNPs have a median diameter size of from about 50 nm to about 300 nm, such as from about 50 nm to about 250 nm, for example, from about 50 nm to about 200 nm.

According to some embodiments, smaller LNPs may be used. Such particles may comprise a diameter from below 0.1 um up to 100 nm such as, but not limited to, less than 0.1 um, less than 1.0 um, less than 5 um, less than 10 um, less than 15 um, less than 20 um, less than 25 um, less than 30 um, less than 35 um, less than 40 um, less than 50 um, less than 55 um, less than 60 um, less than 65 um, less than 70 um, less than 75 um, less than 80 um, less than 85 um, less than 90 um, less than 95 um, less than 100 um, less than 125 um, less than 150 um, less than 175 um, less than 200 um, less than 225 um, less than 250 um, less than 275 um, less than 300 um, less than 325 um, less than 350 um, less than 375 um, less than 400 um, less than 425 um, less than 450 um, less than 475 um, less than 500 um, less than 525 um, less than 550 um, less than 575 um, less than 600 um, less than 625 um, less than 650 um, less than 675 um, less than 700 um, less than 725 um, less than 750 um, less than 775 um, less than 800 um, less than 825 um, less than 850 um, less than 875 um, less than 900 um, less than 925 um, less than 950 um, less than 975 um. In another embodiment, nucleic acids may be delivered using smaller LNPs which may comprise a diameter from about 1 nm to about 100 nm, from about 1 nm to about 10 nm, about 1 nm to about 20 nm, from about 1 nm to about 30 nm, from about 1 nm to about 40 nm, from about 1 nm to about 50 nm, from about 1 nm to about 60 nm, from about 1 nm to about 70 nm, from about 1 nm to about 80 nm, from about 1 nm to about 90 nm, from about 5 nm to about from 100 nm, from about 5 nm to about 10 nm, about 5 nm to about 20 nm, from about 5 nm to about 30 nm, from about 5 nm to about 40 nm, from about 5 nm to about 50 nm, from about 5 nm to about 60 nm, from about 5 nm to about 70 nm, from about 5 nm to about 80 nm, from about 5 nm to about 90 nm, about 10 to about 50 nM, from about 20 to about 50 nm, from about 30 to about 50 nm, from about 40 to about 50 nm, from about 20 to about 60 nm, from about 30 to about 60 nm, from about 40 to about 60 nm, from about 20 to about 70 nm, from about 30 to about 70 nm, from about 40 to about 70 nm, from about 50 to about 70 nm, from about 60 to about 70 nm, from about 20 to about 80 nm, from about 30 to about 80 nm, from about 40 to about 80 nm, from about 50 to about 80 nm, from about 60 to about 80 nm, from about 20 to about 90 nm, from about 30 to about 90 nm, from about 40 to about 90 nm, from about 50 to about 90 nm, from about 60 to about 90 nm and/or from about 70 to about 90 nm.

According to some embodiments, the LNP may have a diameter greater than 100 nm, greater than 150 nm, greater than 200 nm, greater than 250 nm, greater than 300 nm, greater than 350 nm, greater than 400 nm, greater than 450 nm, greater than 500 nm, greater than 550 nm, greater than 600 nm, greater than 650 nm, greater than 700 nm, greater than 750 nm, greater than 800 nm, greater than 850 nm, greater than 900 nm, greater than 950 nm or greater than 1000 nm.

According to other embodiments, LNPs have a single mode particle size distribution (i.e., they are not bi- or poly-modal).

Other Components

LNPs may further comprise one or more lipids and/or other components in addition to those mentioned above.

Other lipids may be included in the liposome compositions for a variety of purposes, such as to prevent lipid oxidation or to attach ligands onto the liposome surface. Any of a number of lipids may be present in LNPs, including amphipathic, neutral, cationic, and anionic lipids. Such lipids can be used alone or in combination.

Additional components that may be present in a LNP include bilayer stabilizing components such as polyamide oligomers (see, e.g., U.S. Pat. No. 6,320,017, which is incorporated by reference in its entirety), peptides, proteins, and detergents.

Liposomes

In some embodiments, artificial nucleic acid molecules, preferably RNAs, or any other nucleic acid disclosed herein, are formulated/provided as liposomes.

Cationic lipid-based liposomes are able to complex with negatively charged nucleic acids (e.g. RNAs) via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the nucleic acid is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9: 1833-1843).

Liposomes typically consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposomes may have one or more lipid membranes. Liposomes can be single-layered, referred to as unilamellar, or multi-layered, referred to as multilamellar.

Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are typically present as spherical vesicles and can range in size from 20 nm to a few microns.

Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

As a non-limiting example, liposomes such as synthetic membrane vesicles may be prepared by the methods, apparatus and devices described in US Patent Publication No. US20130177638, US20130177637, US20130177636, US20130177635, US20130177634, US20130177633, US20130183375, US20130183373 and US20130183372, the contents of each of which are herein incorporated by reference in its entirety. The artificial nucleic acid molecule, preferably RNA, of the invention, and/or any other nucleic acid disclosed herein, may be encapsulated by the liposome and/or it may be contained in an aqueous core which may then be encapsulated by the liposome (see International Pub. Nos. WO2012031046, WO2012031043, WO2012030901 and WO2012006378 and US Patent Publication No. US20130189351, US20130195969 and US20130202684; the contents of each of which are herein incorporated by reference in their entirety).

In some embodiments, the artificial nucleic acid molecule, preferably RNA, of the invention or any other nucleic acid disclosed herein herein, may be formulated in liposomes such as, but not limited to, DiLa2 liposomes (Marina Biotech, Bothell, Wash.), SMARTICLES® (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); herein incorporated by reference in its entirety) and hyaluronan-coated liposomes (Quiet Therapeutics, Israel).

Lipoplexes

According to some embodiments, artificial nucleic acid molecule, preferably RNAs, and/or any other nucleic acid disclosed herein, are provided/formulated as lipoplexes, i.e. cationic lipid bilayers sandwiched between nucleic acid layers.

Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency.

Nanoliposomes

According to some embodiments, artificial nucleic acid molecule, preferably RNAs, or any other nucleic acid disclosed herein, are provided/formulated as neutral lipid-based nanoliposomes such as 1,2-dioleoyl-sn-glycero-3-phosphatidylcholine (DOPC)-based nanoliposomes (Adv Drug Deliv Rev. 2014 February; 66: 110-116.).

Emulsions

According to some embodiments, artificial nucleic acid molecule, preferably RNAs, and/or any other nucleic acid disclosed herein, are provided/formulated as emulsions. In another embodiment, said artificial nucleic acid molecule, preferably RNAs, or any other nucleic acid disclosed herein, are formulated in a cationic oil-in-water emulsion where the emulsion particle comprises an oil core and a cationic lipid which can interact with the nucleic acid(s) anchoring the molecule to the emulsion particle (see International Pub. No. WO2012006380; herein incorporated by reference in its entirety). In some embodiments, said artificial nucleic acid molecule, preferably RNA, or any other nucleic acid disclosed herein, is formulated in a water-in-oil emulsion comprising a continuous hydrophobic phase in which the hydrophilic phase is dispersed. As a non-limiting example, the emulsion may be made by the methods described in International Publication No. WO201087791, the contents of which are herein incorporated by reference in its entirety.

(Poly-)Cationic Compounds and Polymeric Carriers

According to preferred embodiments, the artificial nucleic acid molecule, preferably RNA, of the invention, and/or any other nucleic acid disclosed herein, is complexed or associated with a cationic or polycationic compound ("(poly-)cationic compound") and/or a polymeric carrier.

The term "(poly-)cationic compound" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4.

Accordingly, a "(poly-)cationic compound" may be any positively charged compound or polymer, preferably a cationic peptide or protein, which is positively charged under physiological conditions, particularly under physiological conditions in vivo. A "(poly-)cationic peptide or protein" may contain at least one positively charged amino acid, or more than one positively charged amino acid, e.g. selected from Arg, His, Lys or Orn, as described below.

(Poly-)Cationic Amino Acids, Peptides and Proteins (Poly-)cationic compounds being particularly preferred agents for complexation or association of the artificial nucleic acid molecule, preferably RNA, of the invention, or any other nucleic acid disclosed herein, include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila antennapedia*), pAntp, plsl, FGF, Lactoferrin, Transportan, Buforin-2, Bac715-24, SynB, SynB(1), pVEC, hCT-derived peptides, SAP, or histones. More preferably, the artificial nucleic acid molecule, preferably RNA, of the invention, or any other nucleic acid disclosed herein, is complexed with protamine or oligofectamine, most preferably with protamine. Alternatively or additionally, such cationic or polycationic peptides or proteins may be selected from proteins or peptides of the following general formula (CAT-I):

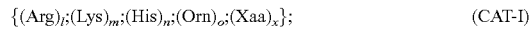

{(Arg)$_l$;(Lys)$_m$;(His)$_n$;(Orn)$_o$;(Xaa)$_x$}; (CAT-I)

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. Arg$_7$, Arg$_8$, Arg$_9$, H$_3$R$_9$, R$_9$H$_3$, H$_3$R$_9$H$_3$, YSSR$_9$SSY, (RKH)$_4$, Y(RKH)$_2$R, etc.

In this context the disclosure of WO 2009/030481 is incorporated herewith by reference.

(Poly-)Cationic Polysaccharides

Further preferred (poly-)cationic compounds for complexation of or association with the artificial nucleic acid molecule, preferably RNA, of the invention or any other nucleic acid disclosed herein include (poly-)cationic polysaccharides, e.g. chitosan, polybrene, cationic polymers, e.g. polyethyleneimine (PEI).

(Poly-)Cationic Lipids

Further preferred (poly-)cationic compounds for complexation of or association with the artificial nucleic acid molecule, preferably RNA, of the invention or any other nucleic acid disclosed herein include (poly-)cationic lipids, e.g. DOTMA: [1-(2,3-sioleyloxy)propyl)]-N,N,N-trimethyl-ammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(alpha-trimethylammonio-acetyl)-diethanolamine chloride, CLIP1: rac-[(2,3-dioctadecyloxypropyl)(2-hydroxyethyl)]-dimethylammonium chloride, CLIP6: rac-[2(2,3-dihexadecyloxy-propyl-oxymethyloxy)ethyl]trimethylammonium, CLIP9: rac-[2(2,3-dihexadecyl-oxypropyl-oxysuccinyloxy)ethyl]-trimethylammonium, or oligofectamine.

(Poly-)Cationic Polymers

Further preferred (poly-)cationic compounds for complexation of or association with the artificial nucleic acid molecule, preferably RNA, of the invention or any other nucleic acid disclosed herein, include (poly-)cationic polymers, e.g. modified polyaminoacids, such as beta-amino acid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., or block polymers consisting of a combination of one or more cationic blocks (e.g. selected from a cationic polymer as mentioned above) and of one or more hydrophilic or hydrophobic blocks (e.g. polyethyleneglycole).

Polymeric Carriers

According to preferred embodiments, artificial nucleic acid molecule, preferably RNA, of the invention or any other nucleic acid disclosed herein, may be complexed or associated with a polymeric carrier.

A "polymeric carrier" used according to the invention might be a polymeric carrier formed by disulfide-crosslinked cationic components. The disulfide-crosslinked cationic components may be the same or different from each other. The polymeric carrier may also contain further components.

It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable (poly-)cationic peptide, protein or polymer suitable for this purpose, particular any (poly-)cationic peptide, protein or polymer capable of complexing, and thereby preferably condensing, the artificial nucleic acid molecule, preferably RNA, of the invention, or any other nucleic acid as disclosed herein. The (poly-)cationic peptide, protein or polymer, is preferably a linear molecule, however, branched (poly-)cationic peptides, proteins or polymers may also be used.

Every disulfide-crosslinking (poly-)cationic protein, peptide or polymer of the polymeric carrier, which may be used to complex the artificial nucleic acid molecule, preferably RNA, or any other nucleic acid disclosed herein, preferably contains at least one —SH moiety, most preferably at least one cysteine residue or any further chemical group exhibiting an —SH moiety, capable of forming a disulfide linkage upon condensation with at least one further (poly-)cationic protein, peptide or polymer as cationic component of the polymeric carrier as mentioned herein. The polymeric carrier, which may be used to complex the artificial nucleic acid molecule, preferably RNA, of the invention, or any other nucleic acid disclosed herein, may thus preferably be formed by disulfide-crosslinked (poly-)cationic components Polymeric Carriers Comprising (Poly-)Cationic Peptides or Proteins According to one first alternative, at least one (poly-)cationic component of the polymeric carrier, which may be used to complex the artificial nucleic acid molecule, preferably RNA, or any other nucleic acid disclosed herein, may be selected from (poly-)cationic peptides or proteins. Such (poly-)cationic peptides or proteins preferably exhibit a length of about 3 to 100 amino acids, preferably a length of about 3 to 50 amino acids, more preferably a length of about 3 to 25 amino acids, e.g. a length of about 3 to 10, 5 to 15, 10 to 20 or 15 to 25 amino acids. Alternatively or additionally, such (poly-)cationic peptides or proteins may exhibit a molecular weight of about 0.01 kDa to about 100 kDa, including a molecular weight of about 0.5 kDa to about 100 kDa, preferably of about 10 kDa to about 50 kDa, even more preferably of about 10 kDa to about 30 kDa.

In the specific case that the cationic component of the polymeric carrier comprises a (poly-)cationic peptide or protein, the cationic properties of the (poly-)cationic peptide or protein or of the entire polymeric carrier, if the polymeric carrier is entirely composed of (poly-)cationic peptides or proteins, may be determined upon its content of cationic amino acids. Preferably, the content of cationic amino acids in the (poly-)cationic peptide or protein and/or the polymeric carrier is at least 10%, 20%, or 30%, preferably at least 40%, more preferably at least 50%, 60% or 70%, but also preferably at least 80%, 90%, or even 95%, 96%, 97%, 98%, 99% or 100%, most preferably at least 30%, 40%, 50%, 60%, 70%, 80%, 90%, 95%, 96%, 97%, 98%, 99% or 100%, or may be in the range of about 10% to 90%, more preferably in the range of about 15% to 75%, even more preferably in the range of about 20% to 50%, e.g. 20, 30, 40 or 50%, or in a range formed by any two of the aforementioned values, provided, that the content of all amino acids, e.g. cationic, lipophilic, hydrophilic, aromatic and further amino acids, in the (poly-)cationic peptide or protein, or in the entire polymeric carrier, if the polymeric carrier is entirely composed of cationic or polycationic peptides or proteins, is 100%.

According to a preferred embodiment, the (poly-)cationic peptide or protein of the polymeric carrier, when defined according to formula $\{(Arg)_l; (Lys)_m; (His)_n; (Orn)_o; (Xaa)_x\}$ (formula (CAT-I)) as shown above and which comprise or are additionally modified to comprise at least one —SH moeity, may be, without being restricted thereto, selected from subformula (CAT-Ia):

$$\{(Arg)_l;(Lys)_m;(His)_n;(Orn)_o;(Xaa')_x(Cys)_y\} \quad \text{(CAT-Ia)}$$

wherein $(Arg)_l$; $(Lys)_m$; $(His)_n$; $(Orn)_o$; and x are as defined herein, Xaa' is any amino acid selected from native (=naturally occurring) or non-native amino acids except of Arg, Lys, His, Orn or Cys and y is any number selected from 0, 1, 2, 3, 4, 5, 6, 7, 8, 9, 10, 11, 12, 13, 14, 15, 16, 17, 18, 19, 20, 21-30, 31-40, 41-50, 51-60, 61-70, 71-80 and 81-90, provided that the overall content of Arg (Arginine), Lys (Lysine), His (Histidine) and Orn (Ornithine) represents at least 10% of all amino acids of the oligopeptide.

This embodiment may apply to situations, wherein the (poly-)cationic peptide or protein of the polymeric carrier, e.g. when defined according to empirical formula $(Arg)_l$; $(Lys)_m$; $(His)_n$; $(Orn)_o$; $(Xaa)_x$ (formula (CAT-I)) as shown above, comprises or has been modified with at least one cysteine as —SH moiety in the above meaning such that the cationic or polycationic peptide as cationic component carries at least one cysteine, which is capable to form a disulfide bond with other components of the polymeric carrier.

Examples may comprise any of the following sequences: Cys($Arg_7$) (SEQ ID NO: 3048), Cys($Arg_8$) (SEQ ID NO: 3049), Cys($Arg_9$) (SEQ ID NO: 3050), Cys($Arg_{10}$) (SEQ ID NO: 3051), Cys($Arg_{11}$) (SEQ ID NO: 3052), Cys($Arg_{12}$) (SEQ ID NO: 3047), Cys($Arg_{13}$) (SEQ ID NO: 3053), Cys($Arg_{14}$) (SEQ ID NO: 3054), Cys($Arg_{15}$) (SEQ ID NO: 3055), Cys($Arg_{16}$) (SEQ ID NO: 3056), Cys($Arg_{17}$) (SEQ ID NO: 3057), Cys($Arg_{18}$) (SEQ ID NO: 3058), Cys($Arg_{19}$) (SEQ ID NO: 3059), Cys($Arg_{20}$) (SEQ ID NO: 3060).

According to another particularly preferred embodiment, the (poly-)cationic peptide or protein of the polymeric carrier, when defined according to formula $\{(Arg)_l; (Lys)_m; (His)_n; (Orn)_o; (Xaa)_x\}$ (formula (CAT-I)) as shown above, may be, without being restricted thereto, selected from subformula (CAT-Ib):

$$\text{Cys1}\{(Arg)_l;(Lys)_m;(His)_n;(Orn)_o;(Xaa)_x\}\text{Cys2} \quad \text{(CAT-Ib)}$$

wherein empirical formula $\{(Arg)_l; (Lys)_m; (His)_n; (Orn)_o; (Xaa)_x\}$ (formula (CAT-I) is as defined herein and forms a core of an amino acid sequence according to (semiempirical) formula (CAT-II) and wherein Cys1 and Cys2 are cysteines proximal to, or terminal to $(Arg)_l$; $(Lys)_m$; $(His)_n$; $(Orn)_o$; $(Xaa)_x$. Examples may comprise any of the above sequences flanked by two Cys and following sequences:

Cys($Arg_7$)Cys (SEQ ID NO: 3033), Cys($Arg_8$)Cys (SEQ ID NO: 3034), Cys($Arg_9$)Cys (SEQ ID NO: 3035), Cys($Arg_{10}$)Cys (SEQ ID NO: 3036), Cys($Arg_{11}$)Cys (SEQ ID NO: 3037), Cys($Arg_{12}$)Cys (SEQ ID NO: 3046), Cys($Arg_{13}$)Cys (SEQ ID NO: 3038), Cys($Arg_{14}$)Cys (SEQ ID NO: 3039), Cys($Arg_{15}$)Cys (SEQ ID NO: 3040), Cys($Arg_{16}$)Cys (SEQ ID NO: 3041), Cys($Arg_{17}$)Cys (SEQ ID NO: 3042), Cys($Arg_{18}$)Cys (SEQ ID NO: 3043), Cys($Arg_{19}$)Cys (SEQ ID NO: 3044), Cys($Arg_{20}$)Cys (SEQ ID NO: 3045).

This embodiment may apply to situations, wherein the (poly-)cationic peptide or protein of the polymeric carrier, e.g. when defined according to empirical formula $(Arg)_l$; $(Lys)_m$; $(His)_n$; $(Orn)_o$; $(Xaa)_x$ (CAT-I) as shown above, has been modified with at least two cysteines as —SH moieties in the above meaning such that the cationic or polycationic peptide of the polymeric carrier cargo complex as cationic component carries at least two (terminal) cysteines, which are capable to form a disulfide bond with other components of the polymeric carrier.

In a preferred embodiment, the polymeric carrier is formed by, comprises or consists of the peptide CysArg$_{12}$Cys (CRRRRRRRRRRRRC) (SEQ ID NO: 3046) or CysArg$_{12}$ (CRRRRRRRRRRRR) (SEQ ID NO: 3047).

Polymeric Carriers Comprising Non-Peptidic Polymers

According to a second alternative, at least one (poly-)cationic component of the polymeric carrier may be selected from e.g. any (non-peptidic) (poly-)cationic polymer suitable in this context, provided that this (non-peptidic) (poly-)cationic polymer exhibits or is modified to exhibit at least one —SH-moiety, which provides for a disulfide bond linking the (poly-)cationic polymer with another component of the polymeric carrier as defined herein. Thus, likewise as defined herein, the polymeric carrier may comprise the same or different (poly-)cationic polymers.

In the specific case that the cationic component of the polymeric carrier comprises a (non-peptidic) (poly-)cationic polymer the cationic properties of the (non-peptidic) (poly-)cationic polymer may be determined upon its content of cationic charges when compared to the overall charges of the components of the cationic polymer. Preferably, the content of cationic charges in the cationic polymer at a (physiological) pH as defined herein is at least 10%, 20%, or 30%, preferably at least 40%, more preferably at least 50%, 60% or 70%, but also preferably at least 80%, 90%, or even 95%, 96%, 97%, 98%, 99% or 100%, most preferably at least 30%, 40%, 50%, 60%, 70%, 80%, 90%, 95%, 96%, 97%, 98%, 99% or 100%, or may be in the range of about 10% to 90%, more preferably in the range of about 30% to 100%, even preferably in the range of about 50% to 100%, e.g. 50, 60, 70, 80%, 90% or 100%, or in a range formed by any two of the afore mentioned values, provided, that the content of all charges, e.g. positive and negative charges at a (physiological) pH as defined herein, in the entire cationic polymer is 100%.

Preferably, the (non-peptidic) cationic component of the polymeric carrier represents a (poly-)cationic polymer, typically exhibiting a molecular weight of about 0.1 or 0.5 kDa to about 100 kDa, preferably of about 1 kDa to about 75 kDa, more preferably of about 5 kDa to about 50 kDa, even more preferably of about 5 kDa to about 30 kDa, or a molecular weight of about 10 kDa to about 50 kDa, even more preferably of about 10 kDa to about 30 kDa. Additionally, the (non-peptidic) (poly-)cationic polymer typically exhibits at least one —SH-moiety, which is capable to form a disulfide linkage upon condensation with either other cationic components or other components of the polymeric carrier as defined herein.

In the above context, the (non-peptidic) cationic component of the polymeric carrier may be selected from acrylates, modified acrylates, such as pDMAEMA (poly(dimethylaminoethyl methylacrylate)), chitosanes, aziridines or 2-ethyl-2-oxazoline (forming oligo ethylenimines or modified oligoethylenimines), polymers obtained by reaction of bisacrylates with amines forming oligo beta aminoesters or poly amido amines, or other polymers like polyesters, polycarbonates, etc. Each molecule of these (non-peptidic) cationic or polycationic polymers typically exhibits at least one —SH-moiety, wherein these at least one —SH-moiety may be introduced into the (non-peptidic) cationic or polycationic polymer by chemical modifications, e.g. using imonothiolan, 3-thio propionic acid or introduction of —SH-moieties containing amino acids, such as cysteine or any further (modified) amino acid. Such —SH-moieties are preferably as already defined above.

The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable to complex the artificial nucleic acid molecule, preferably RNA, of the invention and/or any other nucleic acid disclosed herein for use as described herein, and thereby preferably condensing said artificial nucleic acid, and/or said other nucleic acid. The cationic or polycationic peptide, protein or polymer, is preferably a linear molecule. However, branched cationic or polycationic peptides, proteins or polymers may also be used.

Every disulfide-crosslinking cationic or polycationic protein, peptide or polymer of the polymeric carrier, which may be used to complex the artificial nucleic acid molecule, preferably RNA, of the invention and/or any other nucleic acid disclosed herein for use as described herein contains at least one —SH moiety, most preferably at least one cysteine residue or any further chemical group exhibiting an —SH moiety, capable to form a disulfide linkage upon condensation with at least one further cationic or polycationic protein, peptide or polymer as cationic component of the polymeric carrier as mentioned herein.

As defined above, the polymeric carrier, which may be used to complex the artificial nucleic acid molecule, preferably RNA, of the invention and/or any other nucleic acid disclosed herein for use as described herein may be formed by disulfide-crosslinked cationic (or polycationic) components.

A complex of a nucleic acid, such as the artificial nucleic acid, preferably RNA, of the invention and/or any other nucleic acid disclosed herein for use as described herein, complexed with such polymeric carriers are also referred to herein as "polymeric carrier cargo complexes". According to preferred embodiments, the artificial nucleic acid molecule, preferably RNA, of the invention or any other nucleic acid disclosed herein (preferably an isRNA, preferably comprising or consisting of an RNA sequence corresponding to SEQ ID NO: 2938-3032), may be provided in the form of a polymeric carrier cargo complex, formed by a polymeric carrier, preferably comprising disulfide-crosslinked cationic peptides, preferably Cys-Arg$_{12}$, and/or Cys-Arg$_{12}$-Cys, and said artificial nucleic acid molecule, preferably RNA, or said other nucleic acid.

According to further embodiments, the polymeric carrier may be selected from a polymeric carrier molecule according to generic formula (CAT-II):

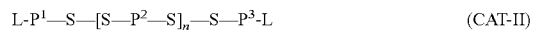
$$L\text{-}P^1\text{---}S\text{---}[S\text{---}P^2\text{---}S]_n\text{---}S\text{---}P^3\text{-}L \qquad (\text{CAT-II})$$

wherein, $P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), (AA)$_x$, or [(AA)$_x$]z if such components are used as a linker between $P^1$ and $P^2$ or $P^3$ and $P^2$) and/or with further components (e.g. (AA), (AA)$_x$, [(AA)$_x$]$_z$ or L), the linear or branched hydrophilic polymer chain selected independent from each other from polyethylene glycol (PEG), poly-N-(2-hydroxypropyl) methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a (poly-)cationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a (poly-)cationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa;

each $P^2$ exhibiting at least two —SH-moieties, capable to form a disulfide linkage upon condensation with further components $P^2$ or component(s) $P^1$ and/or $P^3$ or alternatively with further components (e.g. (AA), $(AA)_x$, or $[(AA)_x]z$);

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components $P^1$ and $P^2$, $P^2$ and $P^2$, or $P^2$ and $P^3$, or optionally of further components as defined herein (e.g. L, (AA), $(AA)_x$, $[(AA)_x]z$, etc); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/026641 is incorporated herewith by reference. Each of hydrophilic polymers $P^1$ and $P^3$ typically exhibits at least one —SH-moiety, wherein the at least one —SH-moiety is capable to form a disulfide linkage upon reaction with component $P^2$ or with component (AA) or $(AA)_x$, if used as linker between $P^1$ and $P^2$ or $P^3$ and $P^2$ as defined below and optionally with a further component, e.g. L and/or (AA) or $(AA)_x$, e.g. if two or more —SH-moieties are contained. The following subformulae "$P^1$—S—S—$P^2$" and "$P^2$—S—S—$P^3$" within generic formula (CAT-II) above (the brackets are omitted for better readability), wherein any of S, $P^1$ and $P^3$ are as defined herein, typically represent a situation, wherein one-SH-moiety of hydrophilic polymers $P^1$ and $P^3$ was condensed with one —SH-moiety of component $P^2$ of generic formula (CAT-II) above, wherein both sulphurs of these —SH-moieties form a disulfide bond —S—S— as defined herein in formula (CAT-II). These —SH-moieties are typically provided by each of the hydrophilic polymers $P^1$ and $P^3$, e.g. via an internal cysteine or any further (modified) amino acid or compound which carries a —SH moiety. Accordingly, the subformulae "$P^1$—S—S—$P^2$" and "$P^2$—S—S—$P^3$" may also be written as "$P^1$-Cys-Cys-$P^2$" and "$P^2$-Cys-Cys-$P^3$", if the —SH— moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "—Cys-S" indicate a disulfide bond between a —SH containing moiety and a cysteine, which may also be written as "—S—(S-Cys)" and "-(Cys-S)—S". Alternatively, the hydrophilic polymers $P^1$ and $P^3$ may be modified with a —SH moiety, preferably via a chemical reaction with a compound carrying a —SH moiety, such that each of the hydrophilic polymers $P^1$ and $P^3$ carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers $P^1$ and $P^3$ as defined herein. Such non-amino compounds may be attached to the hydrophilic polymers $P^1$ and $P^3$ of formula (CAT-II) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g. maleinimide moieties, α,β-unsatured carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

Weight Ratio and N/P Ratio

In some embodiments of the invention, the artificial nucleic acid molecule, preferably RNA (or said other nucleic acid) is associated with or complexed with a (poly-)cationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of nucleic acid to (poly-)cationic compound and/or polymeric carrier; or optionally in a nitrogen/phosphate (N/P) ratio of nucleic acid to (poly-)cationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one artificial nucleic acid molecule, preferably RNA, to the one or more polycations is in the range of about 0.1 to 10, including a range of about 0.3 to 4, of about 0.5 to 2, of about 0.7 to 2 and of about 0.7 to 1.5.

The artificial nucleic acid molecule, preferably RNA, of the invention can also be associated with a vehicle, transfection or complexation agent for increasing the transfection efficiency of said artificial nucleic acid molecule, preferably RNA. In this context, it is particularly preferred that the inventive (pharmaceutical) composition comprises the artificial nucleic acid molecule, preferably RNA that is complexed at least partially with a (poly-)cationic compound and/or a polymeric carrier, preferably cationic proteins or peptides. In this context, the disclosure of WO 2010/037539 and WO 2012/113513 is incorporated herewith by reference. "Partially" means that only a part of said artificial nucleic acid molecule, preferably RNA is complexed with a (poly-)cationic compound and/or polymeric carrier, while the rest of said artificial nucleic acid molecule, preferably RNA is present in uncomplexed form ("free").

Preferably, the molar ratio of the complexed artificial nucleic acid molecule, preferably RNA to the free artificial nucleic acid molecule, preferably RNA is selected from a molar ratio of about 0.001:1 to about 1:0.001, including a ratio of about 1:1. More preferably the ratio of complexed artificial nucleic acid molecule, preferably RNA to free artificial nucleic acid molecule, preferably RNA is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed artificial nucleic acid molecule, preferably RNA to free artificial nucleic acid molecule, preferably RNA is selected from a ratio of about 1:1 (w/w).

The complexed artificial nucleic acid molecule, preferably RNA, of the invention is preferably prepared according to a first step by complexing the artificial nucleic acid molecule, preferably RNA with a (poly-)cationic compound and/or with a polymeric carrier, preferably as defined herein, in a specific ratio to form a stable complex. In this context, it is highly preferable, that no free (poly-)cationic compound or polymeric carrier or only a negligibly small amount thereof remains in the fraction of the complexed artificial nucleic acid molecule, preferably RNA after complexing said artificial nucleic acid molecule, preferably RNA. Accordingly, the ratio of the artificial nucleic acid molecule, preferably RNA and the (poly-)cationic compound and/or the polymeric carrier in the fraction of the complexed RNA is typically selected in a range so that the artificial nucleic acid molecule, preferably RNA is entirely complexed and no free (poly-)cationic compound or polymeric carrier or only a negligibly small amount thereof remains in said fraction.

Preferably, the ratio of the artificial nucleic acid molecule, preferably RNA, to the (poly-)cationic compound and/or the polymeric carrier, preferably as defined herein, is selected from a range of about 6:1 (w/w) to about 0,25:1 (w/w), more preferably from about 5:1 (w/w) to about 0,5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

Alternatively, the ratio of the artificial nucleic acid molecule, preferably RNA, to the (poly-)cationic compound and/or the polymeric carrier may also be calculated on the basis of the nitrogen/phosphate ratio (N/P-ratio) of the entire complex. In the context of the present invention, an N/P-ratio is preferably in the range of about 0.1-10, preferably in a range of about 0.3-4 and most preferably in a range of about 0.5-2 or 0.7-2 regarding the ratio of artificial nucleic acid molecule, preferably RNA, to (poly-)cationic compound and/or polymeric carrier, preferably as defined herein, in the complex, and most preferably in a range of about 0.7-1,5, 0.5-1 or 0.7-1, and even most preferably in a range of about 0.3-0.9 or 0.5-0.9, preferably provided that the (poly-)cationic compound in the complex is a (poly-)cationic protein or peptide and/or the polymeric carrier as defined above.

In other embodiments, artificial nucleic acid molecule, preferably RNA, may be provided and used in free or naked form without being associated with any further vehicle, transfection or complexation agent.

(Pharmaceutical) Composition

In a further aspect, the present invention provides a composition comprising the artificial nucleic acid molecule, preferably RNA, according to the invention, and at least one pharmaceutically acceptable carrier and/or excipient. The composition according to the invention is preferably provided as a pharmaceutical composition or as a vaccine.

A "vaccine" is typically understood to be a prophylactic or therapeutic material providing at least one antigen, preferably an antigenic peptide or protein. "Providing at least on antigen" means, for example, that the vaccine comprises the antigen or that the vaccine comprises a molecule that, e.g., codes for the antigen.

The (pharmaceutical) composition or vaccine according to the invention comprises at least one artificial nucleic acid molecule, preferably RNA, comprising at least one coding sequence encoding an antigenic peptide or protein. Said antigenic peptide or protein may preferably be derived from a tumor antigen, a bacterial, viral, fungal or protozoal antigen, an autoantigen, an allergen, or an allogenic antigen. Its expression and presentation to the immune system may preferably induce an immune response towards the tumor antigen, or the bacterial, viral, fungal or protozoal antigen, or may induce immune tolerance towards the autoantigen, allergen or allogenic antigen.

The (pharmaceutical) composition or vaccines of the invention preferably comprises at least one, preferably a plurality of at least two artificial nucleic acid molecules, preferably RNAs, as described herein. Said plurality of at least two artificial nucleic acid molecules, preferably RNAs, may be monocistronic, bicistronic or multicistronic as described herein.

Each of the artificial nucleic acid molecules, preferably RNAs, of the (pharmaceutical) composition or vaccine of the invention may encode at least one, or a plurality of at least two (identical or different) antigenic fusion proteins as defined herein. "Different" artificial nucleic acid species in a pharmaceutical composition may encode "different" $IRST_{epm}$-derived amino acid sequences, "different" signal peptides, "different" T helper epitopes, "different" linkers, or preferably "different" antigenic peptides or proteins"

Accordingly, in some embodiments of the invention, the (pharmaceutical) composition or vaccine of the invention comprises a plurality of at least two artificial nucleic acid molecules, preferably RNAs, as described herein, wherein preferably at least two of said plurality of artificial nucleic acid molecules encode a different antigenic peptide or protein, preferably as described herein, or fragment, variant or derivative thereof.

The (pharmaceutical) composition or vaccine of the invention may further comprise at least one pharmaceutically acceptable excipient, carrier, adjuvant or further component (e.g. additional active agents, and the like), as described herein.

Pharmaceutically Acceptable Excipients and Carriers

Preferably, the (pharmaceutical) composition according to the invention comprises at least one pharmaceutically acceptable carrier and/or excipient. The term "pharmaceutically acceptable" refers to a compound or agent that is compatible with the one or more active agent(s) (here: artificial nucleic acid molecule, preferably RNA) and does not interfere with and/or substantially reduce their pharmaceutical activities. Pharmaceutically acceptable carriers and/or excipient preferably have sufficiently high purity and sufficiently low toxicity to make them suitable for administration to a subject to be treated.

Excipients

Pharmaceutically acceptable excipients can exhibit different functional roles and include, without limitation, diluents, fillers, bulking agents, carriers, disintegrants, binders, lubricants, glidants, coatings, solvents and co-solvents, buffering agents, preservatives, adjuvants, anti-oxidants, wetting agents, anti-foaming agents, thickening agents, sweetening agents, flavouring agents and humectants.

For (pharmaceutical) compositions in liquid form, useful pharmaceutically acceptable excipients in general include solvents, diluents or carriers such as (pyrogen-free) water, (isotonic) saline solutions such phosphate or citrate buffered saline, fixed oils, vegetable oils, such as, for example, groundnut oil, cottonseed oil, sesame oil, olive oil, corn oil, ethanol, polyols (for example, glycerol, propylene glycol, polyetheylene glycol, and the like); lecithin; surfactants; preservatives such as benzyl alcohol, parabens, chlorobutanol, phenol, ascorbic acid, thimerosal, and the like; isotonic agents such as sugars, polyalcohols such as manitol, sorbitol, or sodium chloride; aluminum monostearate or gelatin; antioxidants such as ascorbic acid or sodium bisulfite; chelating agents such as ethylenediaminetetraacetic acid (EDTA); buffers such as acetates, citrates or phosphates and agents for the adjustment of tonicity such as sodium chloride or dextrose. pH can be adjusted with acids or bases, such as hydrochloric acid or sodium hydroxide. Buffers may be hypertonic, isotonic or hypotonic with reference to the specific reference medium, i.e. the buffer may have a higher, identical or lower salt content with reference to the specific reference medium, wherein preferably such concentrations of the aforementioned salts may be used, which do not lead to damage of cells due to osmosis or other concentration effects. Reference media are e.g. liquids occurring in "in vivo" methods, such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

For (pharmaceutical) compositions in (semi-)solid form, useful pharmaceutically acceptable excipients include binders such as microcrystalline cellulose, gum tragacanth or gelatin; starch or lactose; sugars, such as, for example, lactose, glucose and sucrose; starches, such as, for example, corn starch or potato starch; cellulose and its derivatives, such as, for example, sodium carboxymethylcellulose, ethylcellulose, cellulose acetate; disintegrants such as alginic acid; lubricants such as magnesium stearate; glidants such as stearic acid, magnesium stearate; calcium sulphate, colloidal silicon dioxide and the like; sweetening agents such as sucrose or saccharin; and/or flavoring agents such as peppermint, methyl salicylate, or orange flavoring.

Carriers

Suitable pharmaceutically acceptable carriers are typically chosen based on the formulation of the (pharmaceutical) composition.

Liquid (pharmaceutical) compositions administered via injection and in particular via i.v. injection should be sterile and stable under the conditions of manufacture and storage. Such compositions are typically formulated as parenterally acceptable aqueous solutions that are pyrogen-free, have suitable pH, are isotonic and maintain stability of the active ingredient(s).

Particularly useful pharmaceutically acceptable carriers for liquid (pharmaceutical) compositions according to the invention include water, typically pyrogen-free water; isotonic saline or buffered (aqueous) solutions, e.g phosphate, citrate etc. buffered solutions. Particularly for injection of the inventive (pharmaceutical) compositions, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt.

According to preferred embodiments, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, K2CO3, $KHCO_3$, $K_2SO_4$, and examples of calcium salts include e.g. $CaCl_2$, $CaI_2$, $CaBr_2$, $CaCO_3$, CaSO4, $Ca(OH)_2$. Furthermore, organic anions of the aforementioned cations may be contained in the buffer.

According to more preferred embodiments, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride (CaCl$_2$). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

Complexation

The artificial nucleic acid molecule, preferably RNA, of the invention, and/or optionally any other nucleic acid, forming part of the inventive (pharmaceutical) composition or vaccine may be provided in "complexed" or "naked" form as described elsewhere herein, or a mixture thereof.

According to preferred embodiments, the artificial nucleic acid molecule(s), preferably RNA(s), of the (pharmaceutical) composition or vaccine of the invention, or any other nucleic acid disclosed herein, is/are complexed with one or more cationic or polycationic compounds, preferably with cationic or polycationic polymers, cationic or polycationic peptides or proteins, e.g. protamine, cationic or polycationic polysaccharides and/or cationic or polycationic lipids.

Means and methods for providing "complexed" artificial nucleic acid molecules, preferably RNAs, are described in the section headed "Complexation" and are equally applicable to the (pharmaceutical) compositions and vaccines of the invention, mutatis mutandis. Specifically, artificial nucleic acid molecule(s), preferably RNA(s), and/or optionally any other nucleic acid, forming part of the inventive (pharmaceutical) composition or vaccine may be complexed with lipids, (poly-)cationic compounds and carriers, preferably selected from (poly-)cationic amino acids, peptides and proteins, (poly-)cationic polysaccharides, (poly-)cationic lipids, (poly-)cationic polymers, or polymeric carriers as described above.

According to preferred embodiments, the artificial nucleic acid molecule(s), preferably RNA(s), and/or optionally any other nucleic acid, forming part of the inventive (pharmaceutical) composition or vaccine may be complexed with a polymeric carrier formed by disulfide-crosslinked cationic components, preferably disulfide-crosslinked cationic peptides, preferably comprising peptides according to formula (CAT-I), (CAT-Ia) and/or (CAT-Ib) and/or a compound according to formula (Cat-II) (L-P$^1$—S—[S—P$^2$—S]n-S—P$^3$-L) as described above.

Formulation

Generally, (pharmaceutical) compositions for topical administration can be formulated as creams, ointments, gels, pastes or powders. (Pharmaceutical) compositions for oral administration can be formulated as tablets, capsules, liquids, powders or in a sustained release format. However, according to preferred embodiments, the inventive (pharmaceutical) composition is administered parenterally, in particular via intradermal or intramuscular injection, and is accordingly formulated in liquid or lyophilized form for parenteral administration as discussed elsewhere herein. Parenteral formulations are typically stored in vials, IV bags, ampoules, cartridges, or prefilled syringes and can be administered as injections, inhalants, or aerosols, with injections being preferred.

Lyophilized Formulations

In further preferred embodiments, the (pharmaceutical) composition or vaccine is provided in lyophilized form. Preferably, the lyophilized (pharmaceutical) composition or vaccine is reconstituted in a suitable buffer, advantageously based on an aqueous carrier, prior to administration, e.g. Ringer-Lactate solution, which is preferred, Ringer solution, a phosphate buffer solution. In some embodiments, the (pharmaceutical) composition according to the invention contains at least two, three, four, five, six or more artificial nucleic acid molecules, preferably RNAs, which are provided separately in lyophilized form (optionally together with at least one further additive) and which are preferably reconstituted separately in a suitable buffer (such as Ringer-Lactate solution) prior to their use so as to allow individual administration of each of said artificial nucleic acid molecule, preferably RNAs.

Liquid Formulations

In further preferred embodiments, the (pharmaceutical) composition is provided in the form of a saline or a lipid-based formulation. Lipid-based formulations may comprise liposomes, lipoplexes, nanoliposomes and lipid nanoparticles which are described above in the section headed "Complexation".

Adjuvants

According to further embodiments, the (pharmaceutical) composition or vaccine of the invention may further comprise at least one adjuvant.

An "adjuvant" or "adjuvant component" in the broadest sense is typically a pharmacological and/or immunological agent that may modify, e.g. enhance, the effect of other active agents, e.g. therapeutic agents or vaccines. In this context, an "adjuvant" may be understood as any compound, which is suitable to support administration and delivery of the composition according to the invention. Specifically, an adjuvant may preferably enhance the immunostimulatory properties of the (pharmaceutical) composition or vaccine to which it is added. Furthermore, such adjuvants may, without being bound thereto, initiate or increase an immune response of the innate immune system, i.e. a non-specific immune response.

"Adjuvants" typically do not elicit an adaptive immune response. Insofar, "adjuvants" do not qualify as antigens. In other words, when administered, the inventive (pharmaceutical) composition or vaccine typically initiates an adaptive immune response due to an antigenic peptide or protein, which is encoded by the at least one coding sequence of the artificial nucleic acid molecule, preferably RNA, contained in said (pharmaceutical) composition or vaccine. Additionally, an adjuvant present in the (pharmaceutical) composition or vaccine may generate an (supportive) innate immune response.

Suitable adjuvants may be selected from any adjuvant known to a skilled person and suitable for the present case, i.e. supporting the induction of an immune response in a mammal, and include, without limitation, TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl-dodecanoyl-amide hydroacetate); CALCITRIOL™ (1-alpha,25-dihydroxy-vitamin D3); calcium phosphate gel; CAP™ (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i)N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L-alanyl-D-isoglutamine); imiquimod (1-(2-methypropyl)-1H-imidazo[4,5-c]quinoline-4-amine); ImmTher™ (N-acetylglucosaminyl-N-acetylmuramyl-L-Ala-D-isoGlu-L-Ala-glycerol dipalmitate); DRVs (immunoliposomes prepared from dehydration-rehydration vesicles); interferon-gamma; interleukin-1beta; interleukin-2; interleukin-7; interleukin-12; ISCOMS™; ISCOPREP 7.0.3.™; liposomes; LOXOR-IBINE™ (7-allyl-8-oxoguanosine); LT oral adjuvant (*E. coli* labile enterotoxin-protoxin); microspheres and microparticles of any composition; MF59™; (squalene-water emulsion); MONTANIDE ISA 51™ (purified incomplete Freund's adjuvant); MONTANIDE ISA720™ (metabolisable oil adjuvant); MPL™ (3-Q-desacyl-4"-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (β-glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, Ala.); STIMULON™ (QS-21); Quil-A (Quil-A saponin); S-28463 (4-amino-otec-dimethyl-2-ethoxymethyl-1H-imidazo[4,5-c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethyltetracosan and 2,6,10,15,19,23-hexamethyl-2,6,10,14,18,22-tetracosahexane); stearyltyrosine (octadecyltyrosine hydrochloride); Theramid® (N-acetylglucosaminyl-N-acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Suitable adjuvants may also be selected from (poly-)cationic compounds as described herein as complexation agents (cf. section headed "complexation"), in particular the (poly-)cationic peptides or proteins, (poly-)cationic polysaccharides, (poly-)cationic lipids, or polymeric carriers described herein. Associating or complexing the artificial nucleic acid molecule of the (pharmaceutical) composition or vaccine with (poly-)cationic compounds as defined may preferably provide adjuvant properties and confer a stabilizing effect.

The ratio of the artificial nucleic acid molecule, preferably RNA, to the (poly-)cationic compound in the adjuvant component may be calculated on the basis of the nitrogen/phosphate ratio (N/P-ratio) of the entire complex, i.e. the ratio of positively charged (nitrogen) atoms of the (poly-)cationic compound to the negatively charged phosphate atoms of the artificial nucleic acid molecule, preferably RNA.

In the following, when referring to "RNA", it will be understood that the respective disclosure is applicable to other artificial nucleic acid molecules as well, mutatis mutandis.

For example, 1 μg of RNA may contain about 3 nmol phosphate residues, provided said RNA exhibits a statistical distribution of bases. Additionally, 1 μg of peptide typically contains about x nmol nitrogen residues, dependent on the molecular weight and the number of basic amino acids. When exemplarily calculated for $(Arg)_9$ (molecular weight 1424 g/mol, 9 nitrogen atoms), 1 μg $(Arg)_9$ contains about 700 pmol $(Arg)_9$ and thus 700×9=6300 pmol basic amino acids=6.3 nmol nitrogen atoms. For a mass ratio of about 1:1 RNA/(Arg)9 an N/P ratio of about 2 can be calculated. When exemplarily calculated for protamine (molecular weight about 4250 g/mol, 21 nitrogen atoms, when protamine from salmon is used) with a mass ratio of about 2:1 with 2 μg of RNA, 6 nmol phosphate are to be calculated for the RNA; 1 μg protamine contains about 235 pmol protamine molecules and thus 235×21=4935 pmol basic nitrogen atoms=4.9 nmol nitrogen atoms. For a mass ratio of about 2:1 RNA/protamine an N/P ratio of about 0.81 can be calculated. For a mass ratio of about 8:1 RNA/protamine an N/P ratio of about 0.2 can be calculated. In the context of the present invention, an N/P-ratio is preferably in the range of about 0.1-10, preferably in a range of about 0.3-4 and most preferably in a range of about 0.5-2 or 0.7-2 regarding the ratio of RNA:peptide in the complex, and most preferably in the range of about 0.7-1.5.

The (pharmaceutical) composition or vaccine of the present invention may be obtained in two separate steps in order to obtain both, an efficient immunostimulatory effect and efficient translation of the artificial nucleic acid molecule, preferably RNA, comprised in said (pharmaceutical) composition or vaccine.

In a first step, an RNA is complexed with a (poly-)cationic compound in a specific ratio to form a stable complex ("complexed (RNA)"). In this context, it is important, that no free (poly-)cationic compound or only a negligibly small amount remains in the fraction of the complexed RNA. Accordingly, the ratio of the RNA and the (poly-)cationic compound is typically selected in a range that the RNA is entirely complexed and no free (poly-)cationic compound or only a neglectably small amount remains in the composition. Preferably the ratio of the RNA to the (poly-)cationic compound is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

In a second step, an RNA is added to the complexed RNA in order to obtain the (pharmaceutical) composition or vaccine of the invention. Therein, said added RNA is present as free RNA, preferably as free mRNA, which is not complexed by other compounds. Prior to addition, the free RNA is not complexed and will preferably not undergo any detectable or significant complexation reaction upon the addition to the complexed RNA. This is due to the strong binding of the (poly-)cationic compound to the complexed RNA. In other words, when the free RNA is added to the complexed RNA, preferably no free or substantially no free (poly-)cationic compound is present, which could form a complex with said free RNA. Accordingly, the free RNA of the inventive (pharmaceutical) composition or vaccine can efficiently be transcribed in vivo.

It may be preferred that the free RNA may be identical or different to the complexed RNA, depending on the specific requirements of therapy. Even more preferably, the free RNA, which is comprised in the inventive combination, (pharmaceutical) composition or vaccine, is identical to the complexed RNA, in other words, the combination, (pharmaceutical) composition or vaccine comprises an otherwise identical RNA in both free and complexed form.

In particularly preferred embodiments, the inventive (pharmaceutical) composition or vaccine thus comprises the RNA as defined herein, wherein said RNA is present in said (pharmaceutical) composition or vaccine partially as free RNA and partially as complexed RNA. Preferably, the RNA as defined herein, preferably an mRNA, is complexed as described above and the same (m)RNA is then added in the form of free RNA, wherein preferably the compound, which is used for complexing the epitope-encoding RNA is not present in free form in the composition at the moment of addition of the free RNA.

The ratio of the complexed RNA and the free RNA may be selected depending on the specific requirements of a particular therapy. Typically, the ratio of the complexed RNA and the free RNA is selected such that a significant stimulation of the innate immune system is elicited due to the presence of the complexed RNA. In parallel, the ratio is selected such that a significant amount of the free RNA can be provided in vivo leading to an efficient translation and concentration of the expressed antigenic fusion protein in vivo. Preferably the ratio of the complexed RNA to free RNA in the inventive (pharmaceutical) composition or vaccine is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably about 1:1 (w/w).

Additionally or alternatively, the ratio of the complexed RNA and the free RNA may be calculated on the basis of the nitrogen/phosphate ratio (N/P-ratio) of the entire RNA complex. In the context of the present invention, an N/P-ratio is preferably in the range of about 0.1-10, preferably in a range of about 0.3-4 and most preferably in a range of about 0.5-2 or 0.7-2 regarding the ratio of RNA:peptide in the complex, and most preferably in the range of about 0.7-1.5.

Additionally or alternatively, the ratio of the complexed RNA and the free RNA may also be selected on the basis of the molar ratio of both RNAs to each other. Typically, the molar ratio of the complexed RNA to the free RNA may be selected such, that the molar ratio suffices the above (w/w) and/or N/P-definitions. More preferably, the molar ratio of the complexed RNA to the free RNA may be selected e.g. from a molar ratio of about 0.001:1, 0.01:1, 0.1:1, 0.2:1, 0.3:1, 0.4:1, 0.5:1, 0.6:1, 0.7:1, 0.8:1, 0.9:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.001:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.9 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.9:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, or a range of about 0.01:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, etc.

Even more preferably, the molar ratio of the complexed RNA to the free RNA may be selected e.g. from a range of about 0.01:1 to 1:0.01. Most preferably, the molar ratio of the complexed RNA to the free RNA may be selected e.g. from a molar ratio of about 1:1. Any of the above definitions with regard to (w/w) and/or N/P ratio may also apply.

According to preferred embodiments, the (pharmaceutical) composition or vaccine comprises another nucleic acid, preferably as an adjuvant.

Accordingly, the (pharmaceutical) composition or vaccine of the invention further comprises a non-coding nucleic acid, preferably RNA, selected from the group consisting of small interfering RNA (siRNA), antisense RNA (asRNA), circular RNA (circRNA), ribozymes, aptamers, riboswitches, immunostimulating RNA (isRNA), transfer RNA (tRNA), ribosomal RNA (rRNA), small nuclear RNA (snRNA), small nucleolar RNA (snoRNA), microRNA (miRNA), and Piwi-interacting RNA (piRNA).

In the context of the present invention, non-coding nucleic acids, preferably RNAs, of particular interest include "immune-stimulatory" or "is" nucleic acids, preferably RNAs. "Immune-stimulatory" or "is" nucleic acids or RNAs are typically employed as adjuvants in the (pharmaceutical) composition or vaccine according to the invention.

According to a particularly preferred embodiment, the adjuvant nucleic acid comprises a nucleic acid of the following formula (IS-I) or (IS-II):

$$G_l X_m G_n \qquad \text{(IS-I)}$$

wherein:
G is a nucleotide comprising guanine, uracil or an analogue of guanine or uracil;
X is a nucleotide comprising guanine, uracil, adenine, thymine, cytosine or an analogue thereof;
l is an integer from 1 to 40,
  wherein
  when l=1 G is a nucleotide comprising guanine or an analogue thereof,
  when l>1 at least 50% of the nucleotides comprise guanine or an analogue thereof;
m is an integer and is at least 3;
  wherein
  when m=3, X is a nucleotide comprising uracil or an analogue thereof,
  when m>3, at least 3 successive nucleotides comprising uracils or analogues of uracil occur;
n is an integer from 1 to 40,
  wherein
  when n=1, G is a nucleotide comprising guanine or an analogue thereof,
  when n>1, at least 50% of the nucleotides comprise guanine or an analogue thereof;

$$C_l X_m C_n \qquad \text{(IS-II)}$$

wherein:
C is a nucleotide comprising cytosine, uracil or an analogue of cytosine or uracil;
X is a nucleotide comprising guanine, uracil, adenine, thymine, cytosine or an analogue thereof;
l is an integer from 1 to 40,
  wherein
  when l=1, C is a nucleotide comprising cytosine or an analogue thereof,
  when l>1, at least 50% of the nucleotides comprise cytosine or an analogue thereof;
m is an integer and is at least 3;
  wherein
  when m=3, X comprises uracil or an analogue thereof,
  when m>3, at least 3 successive nucleotides comprise uracils or analogues of uracil occur;
n is an integer from 1 to 40,
  wherein
  when n=1, C is a nucleotide comprising cytosine or an analogue thereof,
  when n>1, at least 50% of the nucleotides comprise cytosine or an analogue thereof.

The nucleic acids of formula (IS-I) or (IS-III), which may be used as isRNA may be relatively short nucleic acid molecules with a typical length of approximately from 5 to 100 (but may also be longer than 100 nucleotides for specific embodiments, e.g. up to 200 nucleotides), from 5 to 90 or from 5 to 80 nucleotides, preferably a length of approximately from 5 to 70, more preferably a length of approximately from 8 to 60 and, more preferably a length of approximately from 15 to 60 nucleotides, more preferably from 20 to 60, most preferably from 30 to 60 nucleotides. If the isRNA has a maximum length of, for example, 100 nucleotides, m will typically be ≤98.

The number of nucleotides "G" in the nucleic acid of (IS-I) is determined by l or n. l and n, independently of one another, are each an integer from 1 to 40, wherein when l or n=1 G is a nucleotide comprising guanine or an analogue thereof, and when l or n>1 at least 50% of the nucleotides comprise guanine, or an analogue thereof.

For example, without implying any limitation, when l or n=4 Gl or Gn can be, for example, a GUGU, GGUU, UGUG, UUGG, GUUG, GGGU, GGUG, GUGG, UGGG or GGGG, etc.; when l or n=5 Gl or Gn can be, for example, a GGGUU, GGUGU, GUGGU, UGGGU, UGGUG, UGUGG, UUGGG, GUGUG, GGGGU, GGGUG, GGUGG, GUGGG, UGGGG, or GGGGG, etc.; etc.

A nucleotide adjacent to $X_m$ in the nucleic acid of formula (IS-I) preferably does not comprise uracil. Similarly, the number of nucleotides "C" in the nucleic acid of formula (IS-III) is determined by l or n. l and n, independently of one another, are each an integer from 1 to 40, wherein when l or n=1 C is a nucleotide comprising cytosine or an analogue thereof, and when l or n>1 at least 50% of the nucleotides comprise cytosine or an analogue thereof.

For example, without implying any limitation, when l or n=4, Cl or $C_n$ can be, for example, a CUCU, CCUU, UCUC, UUCC, CUUC, CCCU, CCUC, CUCC, UCCC or CCCC, etc.; when l or n=5 Cl or $C_n$ can be, for example, a CCCUU, CCUCU, CUCCU, UCCCU, UCCUC, UCUCC, UUCCC, CUCUC, CCCCU, CCCUC, CCUCC, CUCCC, UCCCC, or CCCCC, etc.

A nucleotide adjacent to $X_m$ in the nucleic acid of formula (IS-III) preferably does not comprise uracil. Preferably, for formula (IS-I), when l or n>1, at least 60%, 70%, 80%, 90% or even 100% of the nucleotides comprise guanine or an analogue thereof, as defined above.

The remaining nucleotides to 100% (when nucleotides comprising guanine constitutes less than 100% of the nucleotides) in the flanking sequences G1 and/or $G_n$ are uridine or an analogue thereof, as defined hereinbefore. Also preferably, l and n, independently of one another, are each an integer from 2 to 30, more preferably an integer from 2 to 20 and yet more preferably an integer from 2 to 15. The lower limit of l or n can be varied if necessary and is at least 1, preferably at least 2, more preferably at least 3, 4, 5, 6, 7, 8, 9 or 10. This definition applies correspondingly to formula (IS-III).

According to a further preferred embodiment, the isRNA as described herein consists of or comprises a nucleic acid of formula (IS-III) or (IS-IV):

$$(N_u G_l X_m G_n N_v)_a \qquad \text{(IS-III)}$$

wherein:
G is a nucleotide comprising guanine, uracil or an analogue of guanine or uracil, preferably comprising guanine or an analogue thereof;
X is a nucleotide comprising guanine, uracil, adenine, thymine, cytosine, or an analogue thereof, preferably comprising uracil or an analogue thereof;
N is a nucleic acid sequence having a length of about 4 to 50, preferably of about 4 to 40, more preferably of about 4 to 30 or 4 to 20 nucleic acids, each N independently being selected from a nucleotide comprising guanine, uracil, adenine, thymine, cytosine or an analogue thereof;
a is an integer from 1 to 20, preferably from 1 to 15, most preferably from 1 to 10;
l is an integer from 1 to 40,
  wherein when l=1, G is a nucleotide comprising guanine or an analogue thereof, when l>1, at least 50% of these nucleotides comprise guanine or an analogue thereof;
m is an integer and is at least 3;
  wherein when m=3, X is a nucleotide comprising uracil or an analogue thereof, and
  when m>3, at least 3 successive nucleotides comprising uracils or analogues of uracils occur;

n is an integer from 1 to 40,
  wherein when n=1, G is a nucleotide comprising guanine or an analogue thereof,
  when n>1, at least 50% of these nucleotides comprise guanine or an analogue thereof;
u,v may be independently from each other an integer from 0 to 50, preferably wherein when u=0, v≥1, or when v=0, u≥1; wherein the nucleic acid molecule of (IS-III) has a length of at least 50 nucleotides, preferably of at least 100 nucleotides, more preferably of at least 150 nucleotides, even more preferably of at least 200 nucleotides and most preferably of at least 250 nucleotides.

  (IS-IV)

wherein:
C is a nucleotide comprising cytosine, uracil or an analogue of cytosine or uracil, preferably cytosine or an analogue thereof;
X is a nucleotide comprising guanine, uracil, adenine, thymine, cytosine or an analogue thereof, preferably comprising uracil or an analogue thereof;
N is each a nucleic acid sequence having independent from each other a length of about 4 to 50, preferably of about 4 to 40, more preferably of about 4 to 30 or 4 to 20 nucleic acids, each N independently being selected from a nucleotide comprising guanine, uracil, adenine, thymine, cytosine or an analogue thereof;
a is an integer from 1 to 20, preferably from 1 to 15, most preferably from 1 to 10;
l is an integer from 1 to 40,
  wherein when l=1, C is a nucleotide comprising cytosine or an analogue thereof,
  when l>1, at least 50% of these nucleotides comprise cytosine or an analogue thereof;
m is an integer and is at least 3;
  wherein when m=3, X is a nucleotide comprising uracil or an analogue thereof,
  when m>3, at least 3 successive nucleotides comprising uracils or analogues of uracil occur;
n is an integer from 1 to 40,
  wherein when n=1, C is a nucleotide comprising cytosine or an analogue thereof,
  when n>1, at least 50% of these nucleotides comprise cytosine or an analogue thereof.
u, v may be independently from each other an integer from 0 to 50,
  preferably wherein when u=0, v≥1, or when v=0, u≥1;
wherein the nucleic acid molecule of (IS-IV) according to the invention has a length of at least 50 nucleotides, preferably of at least 100 nucleotides, more preferably of at least 150 nucleotides, even more preferably of at least 200 nucleotides and most preferably of at least 250 nucleotides.

For formula (IS-IV), any of the definitions given above for elements N (i.e. $N_u$ and $N_v$) and X ($X_m$), particularly the core structure as defined above, as well as for integers a, l, m, n, u and v, similarly apply to elements of formula (CAT-II) correspondingly, wherein in formula (IS-IV) the core structure is defined by $C_lX_mC_n$. The definition of bordering elements $N_u$ and $N_v$ is identical to the definitions given above for $N_u$ and $N_v$.

In particular in the context of formulas (IS-I)-(IS-IV) above, a "nucleotide" is understood as a molecule comprising or preferably consisting of a nitrogenous base (preferably selected from adenine (A), cytosine (C), guanine (G), thymine (T), or uracil (U), a pentose sugar (ribose or deoxyribose), and at least one phosphate group. "Nucleosides" consist of a nucleobase and a pentose sugar (i.e. could be referred to as "nucleotides without phosphate groups"). Thus, a "nucleotide" comprising a specific base (A, C, G, T or U) preferably also comprises the respective nucleoside (adenosine, cytidine, guanosine, thymidine or uridine, respectively) in addition to one (two, three or more) phosphate groups That is, the term "nucleotides" includes nucleoside monophosphates (AMP, CMP, GMP, TMP and UMP), nucleoside diphosphates (ADP, CDP, GDP, TDP and UDP), nucleoside triphosphates (ATP, CTP, GTP, TTP and UTP). In the context of formulas (IS-I)-(IS-IV) above, nucleoside monophosphates are particularly preferred. The expression "a nucleotide comprising ( . . . ) or an analogue thereof" refers to modified nucleotides comprising a modified (phosphate) backbone, pentose sugar(s), or nucleobases. In this context, modifications of the nucleobases are particularly preferred. By way of example, when referring "to a nucleotide comprising guanine, uracil, adenine, thymine, cytosine or an analogue thereof", the term "analogue thereof" refers to both the nucleotide and the recited nucleobases, preferably to the recited nucleobases.

In preferred embodiments, the (pharmaceutical) composition or vaccine of the invention comprises at least one immunostimulating RNA comprising or consisting of a nucleic acid sequence according to formula (IS-I) (GiXmGn), formula (IS-III) ($C_lX_mC_n$), formula (IS-III) ($N_uG_lX_mG_nN_v)_a$, and/or formula (IS-IV) ($N_uC_lX_mC_nN_v)_a$. In particularly preferred embodiments, the (pharmaceutical) composition or vaccine of the invention comprises at least one immunostimulating RNA comprising or consisting of a nucleic acid sequence according to any one of SEQ ID NOs: 2938-3032.

In particularly preferred embodiments, the (pharmaceutical) composition or vaccine of the invention comprises a polymeric carrier cargo complex, formed by a polymeric carrier, preferably comprising disulfide-crosslinked cationic peptides, preferably Cys-Arg$_{12}$, and/or Cys-Arg$_{12}$-Cys, and at least one isRNA, preferably comprising or consisting of a nucleic acid sequence according to any one of SEQ ID NO: 2938-3032.

The (pharmaceutical) composition or vaccine of the invention may additionally contain one or more auxiliary substances in order to increase its immunogenicity or immunostimulatory capacity, if desired. A synergistic action of the inventive polymeric carrier cargo complex as defined herein and of an auxiliary substance, which may be optionally contained in the (pharmaceutical) composition or vaccine of the invention as defined herein, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response to be enhanced and/or influenced in a targeted manner.

Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, INF-alpha, IFN-beta, INF-gamma, GM-CSF, G-CSF, M-CSF, LT-beta or TNF-alpha, growth factors, such as hGH.

The (pharmaceutical) composition or vaccine of the invention may additionally contain any further compound, which is known to be immunostimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

The (pharmaceutical) composition or vaccine of the invention may additionally contain CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

Kit

In a further aspect, the present invention relates to a kit or kit-of-parts comprising the artificial nucleic acid molecule, preferably RNA, and/or the (pharmaceutical) composition or vaccine of the invention, and optionally a liquid vehicle and/or optionally technical instructions with information on the administration and dosage of the artificial nucleic acid molecule or the composition.

Optionally, the kit-of-parts may comprise at least one further agent as defined herein in the context of the pharmaceutical composition, antimicrobial agents, RNAse inhibitors, solubilizing agents, buffers, or the like. In preferred embodiments, the kit may contain as a part Ringer-Lactate solution.

The kit or kit-of-parts may be a kit of two or more parts and typically comprises each of the components described herein in suitable containers. For example, each container may be in the form of vials, bottles, squeeze bottles, jars, sealed sleeves, envelopes or pouches, tubes or blister packages or any other suitable form provided the container is configured so as to prevent premature mixing of components. Each of the different components may be provided separately, or some of the different components may be provided together (i.e. in the same container). A container may also be a compartment or a chamber within a vial, a tube, a jar, or an envelope, or a sleeve, or a blister package or a bottle, provided that the contents of one compartment are not able to associate physically with the contents of another compartment prior to their deliberate mixing by a pharmacist or physician.

The kit may furthermore contain technical instructions with information on the administration and dosage of any of its components.

Medical Use and Treatment

In a further aspect, the present invention provides the artificial nucleic acid molecule, preferably RNA, the (pharmaceutical) composition or vaccine, or the kit of the invention for human and also for veterinary medical purposes, preferably for human medical purposes.

According to a further aspect, the invention thus relates to the artificial nucleic acid molecule, preferably RNA, or the (pharmaceutical) composition or vaccine, or kit-of-parts for use as a medicament.

The artificial nucleic acid molecule, preferably RNA, or the (pharmaceutical) composition or kit-of-parts are inter alia provided for use in treatment and/or prophylaxis of cancer, infectious diseases including viral, bacterial, fungal or protozoal infections, autoimmune diseases, Graft-versus-host disease (GvHD) or allergies.

The term "treatment" or "treating" of a disease includes preventing or protecting against the disease (that is, causing the clinical symptoms not to develop); inhibiting the disease (i.e., arresting or suppressing the development of clinical symptoms; and/or relieving the disease (i.e., causing the regression of clinical symptoms). As will be appreciated, it is not always possible to distinguish between "preventing" and "suppressing" a disease or disorder since the ultimate inductive event or events may be unknown or latent. Accordingly, the term "prophylaxis" will be understood to constitute a type of "treatment" that encompasses both "preventing" and "suppressing". The term "treatment" thus includes "prophylaxis".

The term "subject", "patient" or "individual" as used herein generally includes humans and non-human animals and preferably mammals (e.g., non-human primates, including marmosets, tamarins, spider monkeys, owl monkeys, vervet monkeys, squirrel monkeys, and baboons, macaques, chimpanzees, orangutans, gorillas; cows; horses; sheep; pigs; chicken; cats; dogs; mice; rat; rabbits; guinea pigs; etc.), including chimeric and transgenic animals and disease models. In the context of the present invention, the term "subject" preferably refers a non-human primate or a human, most preferably a human.

According to preferred embodiments, treatment of cancer, infectious diseases including viral, bacterial, fungal or protozoal infections, autoimmune diseases, Graft-versus-host disease (GvHD) or allergies is accomplished by administering, to a subject in need thereof, at least one artificial nucleic acid molecule, preferably RNA, (pharmaceutical) composition or vaccine, or kit according to the invention. Preferably, administration is accomplished parenterally, preferably intradermally, intramuscularly, intranodally, transdermally, subcutaneous or intratumorally. Preferably, injection is carried out by injection, e.g. using conventional needle injection or (needle-free) jet injection, preferably by using (needle-free) jet injection. Prior to administration, treatment may include an optional step of preparing said artificial nucleic acid molecule, preferably RNA, or the (pharmaceutical) composition or vaccine or kit. The invention further relates to a method of treating cancer, infectious diseases including viral, bacterial, fungal or protozoal infections, autoimmune diseases, Graft-versus-host disease (GvHD) or allergies comprising the steps of (a) optionally preparing the artificial nucleic acid molecule, preferably RNA, or the (pharmaceutical) composition or vaccine or kit of the invention and (b) administering, to a subject in need thereof, at least one artificial nucleic acid molecule, preferably RNA, (pharmaceutical) composition or vaccine, or kit according to the invention.

The invention further relates to the use of the inventive artificial nucleic acid molecule, preferably RNA, or the (pharmaceutical) composition or kit, preferably for manufacturing a medicament for treating cancer, infectious diseases including viral, bacterial, fungal or protozoal infections, autoimmune diseases, Graft-versus-host disease (GvHD) or allergies.

Administration Routes

The inventive artificial nucleic acid molecule, preferably RNA, or the (pharmaceutical) composition or vaccine or kit can be administered, for example, systemically or locally.

Routes for systemic administration in general include, for example, transdermal, oral, parenteral routes, including subcutaneous, intravenous, intramuscular, intraarterial, intradermal and intraperitoneal injections and/or intranasal administration routes.

Routes for local administration in general include, for example, topical administration routes but also intradermal, transdermal, subcutaneous, or intramuscular injections or intralesional, intratumoral, peritumoral, imaging guided loco-regional administration, intracranial, intrapulmonal, intracardial, intranodular and sublingual injections.

It is further conceivable to use different administration routes for different artificial nucleic acid molecules, preferably RNAs, of the invention, and/or different parts of the kit.

According to preferred embodiments, the artificial nucleic acid molecule, preferably RNA, or the (pharmaceutical) composition or vaccine or kit is administered parenterally, preferably intradermally, intramuscularly, intranodally, transdermally, imaging guided loco-regional administration or intratumorally. Preferably, said artificial nucleic acid molecule, preferably RNA, or the (pharmaceutical) composition or vaccine or kit is administered by injection, e.g. subcutaneous, intramuscular, intradermal or intratumoral injection, which may be needle-free and/or needle injection. Accordingly, in preferred embodiments, the medical use and/or method of treatment according to the present invention involves administration of said artificial nucleic acid molecule, preferably RNA, or the (pharmaceutical) composition or vaccine or kit by subcutaneous, intramuscular, intradermal or intratumoral injection. Such injection may be carried out by using conventional needle injection or (needle-free) jet injection, preferably by using (needle-free) jet injection.

Administration Regimen

The artificial nucleic acid molecule, preferably RNA, (pharmaceutical) composition or vaccine or kit of the invention (or their components or parts) may be administered to a subject in need thereof several times a day, daily, every other day, weekly, or monthly; and may be administered sequentially or simultaneously, optionally via different administration routes as defined above.

According to some preferred embodiments, the artificial nucleic acid molecule, preferably RNA, (pharmaceutical) composition or vaccine or kit of the invention (or their components or parts) are administered simultaneously (i.e. at the same time via the same or different administrations routes).

According to other preferred embodiments, the artificial nucleic acid molecule, preferably RNA, (pharmaceutical) composition or vaccine or kit of the invention (or their components or parts) are administered separately (i.e. sequentially at different time points and/or via different administrations routes). Such a sequential administration scheme is also referred to as "time-staggered" administration.

Dose

The artificial nucleic acid molecule, preferably RNA, (pharmaceutical) composition or vaccine or kit of the invention (or their components or parts) is/are preferably administered in a safe and therapeutically effective amount.

As used herein, "safe and therapeutically effective amount" means an amount of the active agent(s) that is sufficient to elicit a desired biological or medicinal response in a tissue, system, animal or human that is being sought. A "safe and therapeutically effective amount" is preferably sufficient for the inducing a positive modification of the disease to be treated, i.e. for alleviation of the symptoms of the disease being treated, reduction of disease progression, or prophylaxis of the symptoms of the disease being prevented. At the same time, however, a "safe and therapeutically effective amount" is small enough to avoid serious side-effects, that is to say to permit a sensible relationship between advantage and risk.

A "safe and therapeutically effective amount" will furthermore vary in connection with the particular condition to be treated and also with the age, physical condition, body weight, sex and diet of the patient to be treated, the severity of the condition, the duration of the treatment, the nature of the accompanying therapy, of the particular pharmaceutically acceptable carrier or excipient used, the treatment regimen and similar factors. It may further vary depending on whether the employed artificial nucleic acid molecule, preferably RNA, is monocistronic, bi- or even multicistronic.

Therapeutic efficacy and toxicity of active agents can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and can be expressed as the ratio LD50/ED50. Active agents which exhibit large therapeutic indices are generally preferred. The data obtained from the cell culture assays and animal studies can be used in formulating a range of dosage for use in humans. The dosage of such compounds lies preferably within a range of circulating concentrations that include the ED50 with little or no toxicity.

For instance, therapeutically effective doses of the inventive artificial nucleic acid molecule, preferably RNA, (pharmaceutical) composition or vaccine or kit described herein may range from about 0.001 mg to 10 mg, preferably from about 0.01 mg to 5 mg, more preferably from about 0.1 mg to 2 mg per dosage unit or from about 0.01 nmol to 1 mmol per dosage unit, in particular from 1 nmol to 1 mmol per dosage unit, preferably from 1 pmol to 1 mmol per dosage unit. It is also envisaged that the therapeutically effective dose of the inventive artificial nucleic acid molecule, preferably RNA, (pharmaceutical) composition or vaccine or kit may range (per kg body weight) from about 0.01 mg/kg to 10 g/kg, preferably from about 0.05 mg/kg to 5 g/kg, more preferably from about 0.1 mg/kg to 2.5 g/kg. Safe and therapeutically effective amounts of the inventive artificial nucleic acid molecule, preferably RNA, (pharmaceutical) composition or vaccine or kit to be administered can be determined by routine experiments, e.g. by using animal models. Such models include, without implying any limitation, rabbit, sheep, mouse, rat, dog and non-human primate models.

Diseases

Cancer

In preferred embodiments, the artificial nucleic acid, preferably RNA, (pharmaceutical) composition or kit is used for treatment or prophylaxis of cancer.

In some embodiments, the artificial nucleic acid, preferably RNA, (pharmaceutical) composition or kit according to the invention may be used as a medicament, in particular for treatment of tumor or cancer diseases. In this context, treatment preferably involves intratumoral application, especially by intratumoral injection. Accordingly, the artificial nucleic acid, preferably RNA, (pharmaceutical) composition or kit according to the invention may be used for preparation of a medicament for treatment of tumor or cancer diseases, said medicament being particularly suitable for intratumoral application (administration) for treatment of tumor or cancer diseases.

Preferably, tumor and cancer diseases as mentioned herein are selected from tumor or cancer diseases which preferably include e.g. Acute lymphoblastic leukemia, Acute myeloid leukemia, Adrenocortical carcinoma, AIDS-related cancers, AIDS-related lymphoma, Anal cancer, Appendix cancer, Astrocytoma, Basal cell carcinoma, Bile duct cancer, Bladder cancer, Bone cancer, Osteosarcoma/Malignant fibrous histiocytoma, Brainstem glioma, Brain tumor, cerebellar astrocytoma, cerebral astrocytoma/malignant glioma, ependymoma, medulloblastoma, supratentorial primitive neuroectodermal tumors, visual pathway and hypothalamic glioma, Breast cancer, Bronchial adenomas/carcinoids, Burkitt lymphoma, childhood Carcinoid tumor, gastrointestinal Carcinoid tumor, Carcinoma of unknown primary, primary Central nervous system lymphoma, childhood Cerebellar astrocytoma, childhood Cerebral astrocytoma/Malignant glioma, Cervical cancer, Childhood cancers, Chronic lymphocytic leukemia, Chronic myelogenous leukemia, Chronic myeloproliferative disorders, Colon Cancer, Cutaneous T-cell lymphoma, Desmoplastic small round cell tumor, Endometrial cancer, Ependymoma, Esophageal cancer, Ewing's sarcoma in the Ewing family of tumors, Childhood Extracranial germ cell tumor, Extragonadal Germ cell tumor, Extrahepatic bile duct cancer, Intraocular melanoma, Retinoblastoma, Gallbladder cancer, Gastric (Stomach) cancer, Gastrointestinal Carcinoid Tumor, Gastrointestinal stromal tumor (GIST), extracranial, extragonadal, or ovarian Germ cell tumor, Gestational trophoblastic tumor, Glioma of the brain stem, Childhood Cerebral Astrocytoma, Childhood Visual Pathway and Hypothalamic Glioma, Gastric carcinoid, Hairy cell leukemia, Head and neck cancer, Heart cancer, Hepatocellular (liver) cancer, Hodgkin lymphoma, Hypopharyngeal cancer, childhood Hypothalamic and visual pathway glioma, Intraocular Melanoma, Islet Cell Carcinoma (Endocrine Pancreas), Kaposi sarcoma, Kidney cancer (renal cell cancer), Laryngeal Cancer, Leukemias, acute lymphoblastic Leukemia, acute myeloid Leukemia, chronic lymphocytic Leukemia, chronic myelogenous Leukemia, hairy cell Leukemia, Lip and Oral Cavity Cancer, Liposarcoma, Liver Cancer, Non-Small Cell Lung Cancer, Small Cell Lung Cancer, Lymphomas, AIDS-related Lymphoma, Burkitt Lymphoma, cutaneous T-Cell Lymphoma, Hodgkin Lymphoma, Non-Hodgkin Lymphomas, Primary Central Nervous System Lymphoma, Waldenström Macroglobulinemia, Malignant Fibrous Histiocytoma of Bone/Osteosarcoma, Childhood Medulloblastoma, Melanoma, Intraocular (Eye) Melanoma, Merkel Cell Carcinoma, Adult Malignant Mesothelioma, Childhood Mesothelioma, Metastatic Squamous Neck Cancer with Occult Primary, Mouth Cancer, Childhood Multiple Endocrine Neoplasia Syndrome, Multiple Myeloma/Plasma Cell Neoplasm, Mycosis Fungoides, Myelodysplastic Syndromes, Myelodysplastic/Myeloproliferative Diseases, Chronic Myelogenous Leukemia, Adult Acute Myeloid Leukemia, Childhood Acute Myeloid Leukemia, Multiple Myeloma (Cancer of the Bone-Marrow), Chronic Myeloproliferative Disorders, Nasal cavity and paranasal sinus cancer, Nasopharyngeal carcinoma, Neuroblastoma, Oral Cancer, Oropharyngeal cancer, Osteosarcoma/malignant fibrous histiocytoma of bone, Ovarian cancer, Ovarian epithelial cancer (Surface epithelial-stromal tumor), Ovarian germ cell tumor, Ovarian low malignant potential tumor, Pancreatic cancer, islet cell Pancreatic cancer, Paranasal sinus and nasal cavity cancer, Parathyroid cancer, Penile cancer, Pharyngeal cancer, Pheochromocytoma, Pineal astrocytoma, Pineal germinoma, childhood Pineoblastoma and supratentorial primitive neuroectodermal tumors, Pituitary adenoma, Plasma cell neoplasia/Multiple myeloma, Pleuropulmonary blastoma, Primary central nervous system lymphoma, Prostate cancer, Rectal cancer, Renal cell carcinoma (kidney cancer), Cancer of the Renal pelvis and ureter, Retinoblastoma, childhood Rhabdomyosarcoma, Salivary gland cancer, Sarcoma of the Ewing family of tumors, Kaposi Sarcoma, soft tissue Sarcoma, uterine Sarcoma, Sezary syndrome, Skin cancer (non-melanoma), Skin cancer (melanoma), Merkel cell Skin carcinoma, Small intestine cancer, Squamous cell carcinoma, metastatic Squamous neck cancer with occult primary, childhood Supratentorial primitive neuroectodermal tumor, Testicular cancer, Throat cancer, childhood Thymoma, Thymoma and Thymic carcinoma, Thyroid cancer, childhood Thyroid cancer, Transitional cell cancer of the renal pelvis and ureter, gestational Trophoblastic tumor, Urethral cancer, endometrial Uterine cancer, Uterine sarcoma, Vaginal cancer, childhood Visual pathway and hypothalamic glioma, Vulvar cancer, Waldenström macroglobulinemia, and childhood Wilms tumor (kidney cancer).

Especially preferred examples of tumors or cancers that are suitable for intratumoral administration are prostate cancer, lung cancer, breast cancer, brain cancer, head and neck cancer, thyroid cancer, colon cancer, stomach cancer, liver cancer, pancreas cancer, ovary cancer, skin cancer, urinary bladder, uterus and cervix.

Infectious Diseases

The inventive combination, pharmaceutical composition or kit may be used for treating infectious diseases. The term "infection" or "infectious disease" relates to the invasion and multiplication of microorganisms such as bacteria, viruses, and parasites that are not normally present within the body. An infection may cause no symptoms and be subclinical, or it may cause symptoms and be clinically apparent. An infection may remain localized, or it may spread through the blood or lymphatic system to become systemic. Infectious diseases in this context, preferably include viral, bacterial, fungal or protozoological infectious diseases.

Combination Therapy

According to some preferred embodiments, the medical uses and treatment methods of the invention may include subjecting the patient to a combination therapy. Any therapy amenable for treating or preventing the diseases, disorders and conditions described herein (in particular cancer, infectious diseases, autoimmune diseases, graft-versus-host disease and allergies) may be combined with/employed in addition to the administration of the inventive artificial nucleic acid molecules, preferably RNAs, (pharmaceutical) composition or kit. Combination therapy may generally be effected prior to, simultaneously with, or subsequently to the administration of said artificial nucleic acid molecule, (pharmaceutical) composition or vaccine, or kit of the invention, and inter alia depends on the type and severity of the disease, disorder, or condition to be treated.

Cancer

Treatment of cancer may, in addition to administration of the artificial nucleic acid molecule, (pharmaceutical) composition or vaccine, or kit of the invention, comprise one or more of the following: chemotherapy (e.g. first-line or second-line chemotherapy), radiotherapy, chemoradiation (combination of chemotherapy and radiotherapy), kinase inhibitors, antibody therapy and/or checkpoint modulators (e.g. CTLA4 inhibitors, PD1 pathway inhibitors) or inhibitors inducing expression of T cell epitopes associated with impaired peptide processing (TEIPPs) as disclosed in WO2012/089225. Accordingly, in some embodiments the subject receiving the inventive artificial nucleic acid molecule, (pharmaceutical) composition or vaccine may be a patient with cancer or tumor, who received or receives chemotherapy (e.g. first-line or second-line chemotherapy), radiotherapy, chemoradiation (combination of chemotherapy and radiotherapy), kinase inhibitors, antibody therapy and/or checkpoint modulators (e.g. CTLA4 inhibitors, PD1 pathway inhibitors) or inhibitors inducing expression of T cell epitopes associated with impaired peptide processing (TEIPPs) as disclosed in WO2012/089225, or a patient, who has achieved partial response or stable disease after having received one or more of the treatments specified above.

For instance, the subject receiving the inventive artificial nucleic acid molecule, preferably RNA, (pharmaceutical) composition or kit-of-parts may be a patient with cancer, preferably as defined herein, or a related condition, receiving chemotherapy (e.g. first-line or second-line chemotherapy), radiotherapy, chemoradiation (combination of chemotherapy and radiotherapy), tyrosine kinase inhibitors (e.g. EGFR tyrosine kinase inhibitors), antibody therapy and/or inhibitory and/or stimulatory checkpoint molecules (e.g. PD1, PD-L1 or CTLA4 inhibitors), or a patient, who has achieved partial response or stable disease after having received one or more of the treatments specified above. Or, the subject receiving the inventive artificial nucleic acid molecule, preferably RNA, (pharmaceutical) composition or kit-of-parts may be a patient with an infectious disease, preferably as defined herein, receiving antibiotic, antifungal or antiviral therapy.

In a further aspect, the present invention thus also relates to the use of the inventive artificial nucleic acid molecule, preferably RNA, (pharmaceutical) composition or kit-of-parts for supporting another therapy of cancer, an infectious disease, or any other disease amenable by treatment with said artificial nucleic acid molecule, (pharmaceutical) composition or kit.

"Support" of the treatment or prophylaxis of cancer may be any combination of a conventional cancer therapy method of such as surgery, radiation therapy, chemotherapy (e.g. first-line or second-line chemotherapy), chemoradiation, treatment with tyrosine kinase inhibitors, treatment with inhibitory and/or stimulatory checkpoint molecules, preferably PD1, PD-L1 or CTLA4 inhibitors, antibody therapy or any combination of these, and a therapy using the inventive inventive artificial nucleic acid molecule, preferably RNA, (pharmaceutical) composition or kit-of-parts as defined herein. Administration of the inventive artificial nucleic acid molecule, preferably RNA, (pharmaceutical) composition or kit-of-parts may be accomplished prior to, simultaneously and/or subsequently to administering another therapeutic or subjecting the patient to another therapy that is useful for treatment of the particular disease or condition to be treated.

In Vitro Methods

In a further aspect, the invention relates to an in vitro cell culture or cell treatment method comprising (a) providing cells in vitro, (b) contacting said cells with the artificial nucleic acid molecule, preferably RNA, the (pharmaceutical) composition or vaccine, or the kit of the invention.

Without wishing to be bound by specific theory, said cell culture/treatment method is envisaged to be particularly useful for preparing antigen-presenting cells (APCs), such as dendritic cells (DCs), for subsequent T cell expansion in vitro or in vivo. The cells are preferably contacted with said artificial nucleic acid molecule, preferably RNA, (pharmaceutical) composition or vaccine or kit in a suitable cell culture medium. Step (b) may in particular include a step of transfecting the cells with the artificial nucleic acid molecules, preferably RNAs, optionally comprised by said (pharmaceutical) composition or vaccine, or kit. Transfection, i.e. the act of deliberately introducing the artificial nucleic acid molecules, preferably RNAs, into living cells, may for instance involve microinjection or electroporation. Upon introduction into the recipient cells, the artificial nucleic acid molecules, preferably RNAs, are preferably translated, yielding the antigenic fusion proteins of the invention, which are subsequently presented via the MHC complex.

EXAMPLES

Example 1

C57BL/6 mice were injected intradermally (i.d.) at 4 sites with RNA constructs encoding an Trp2 epitope connected to a T cell helper epitope (PADRE) (64 µg RNA in 50 µl PBS). The Trp2 peptide SVYDFFVWL is a confirmed CD8+ T cell epitope.

Figure 1:
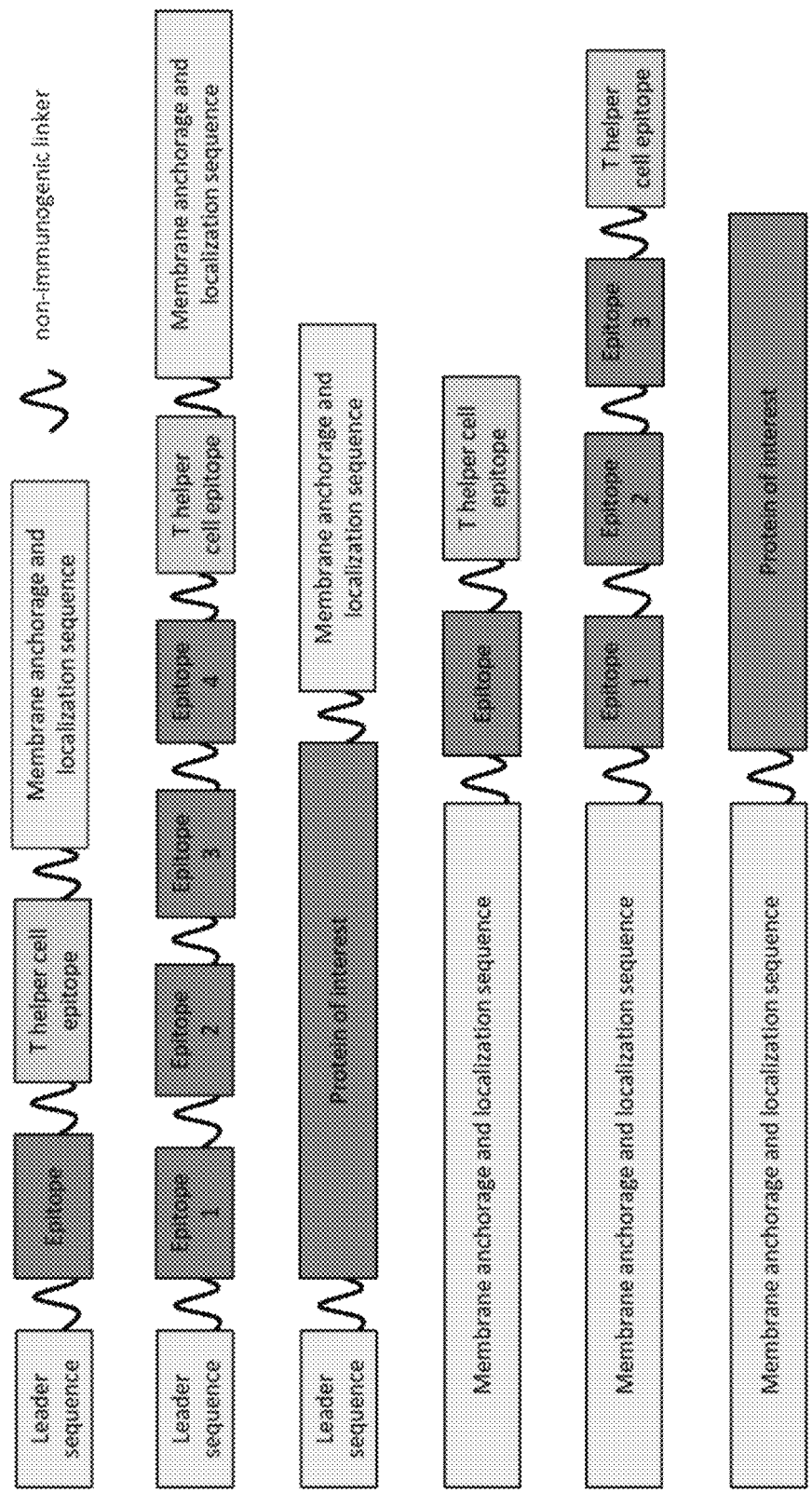
FIG. 1: General design of RNA constructs enabling the targeting of epitopes or antigens to MHC class I and II-containing cellular compartments.
Figure 2:
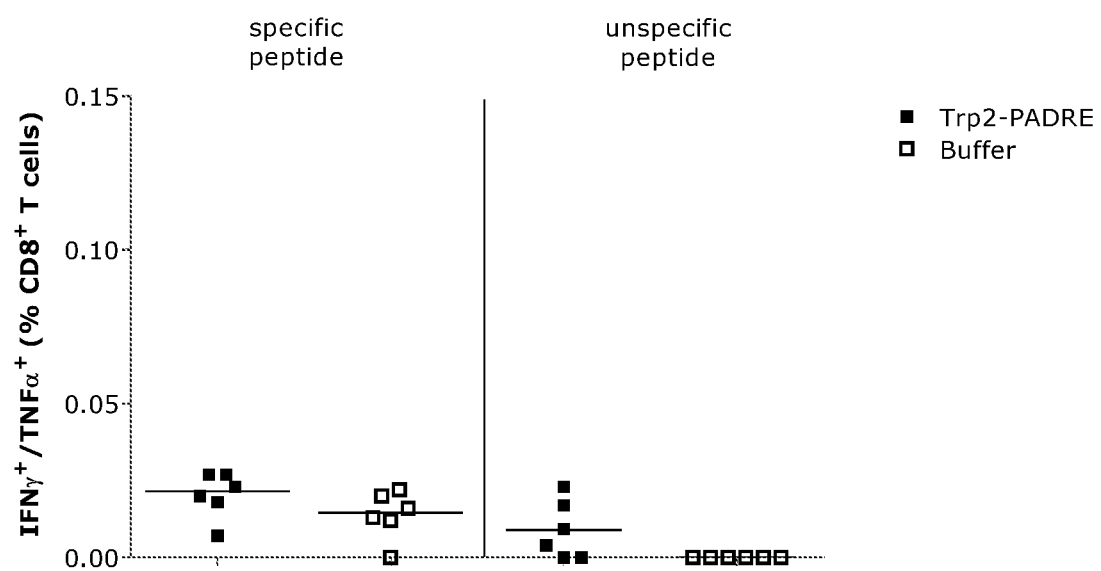
FIG. 2: Induction of epitope-specific CD8+ T cells after vaccination with RNA encoding a murine Trp2 epitope with PADRE.

On days 0, 3, 7, 10 and 14 of the experiment mice were injected i.d. with mRNA solved in Ringer Lactate buffer according to the Table 8 below. The total volume for intradermal vaccination was 80 µl and was distributed to 4 sites of injection. 6 days after the last vaccination an ICS was performed to evaluate epitope-specific CD8+ T cell responses. Therefore CD8+ T cells were stimulated with the corresponding peptide and as a control with an irrelevant peptide. In none of the groups epitope-specific CD8+ T cell responses were observed (FIG. 2).

TABLE 8

| Groups, treatment and RNA dilution | | | |
|---|---|---|---|
| Groups | Constructs (amount of RNA) | No. of mice | SEQ ID NOs: |
| A | Trp2-PADRE (64 µg) | 6 | 2931 |
| B | Buffer | 6 | — |

Example 2

C57BL/6 mice were injected intradermally (i.d.) at 4 sites with RNA constructs encoding an ovalbumin or Trp2 epitope connected to a T cell helper epitope (PADRE) with the CTLA4 targeting approach (64 µg RNA in 50 µl PBS). Peptides of ovalbumin (LESIINFEKLTE) and Trp2 (SVYDFFVWL) are known CD8+ T cell epitopes.

Figure 3:
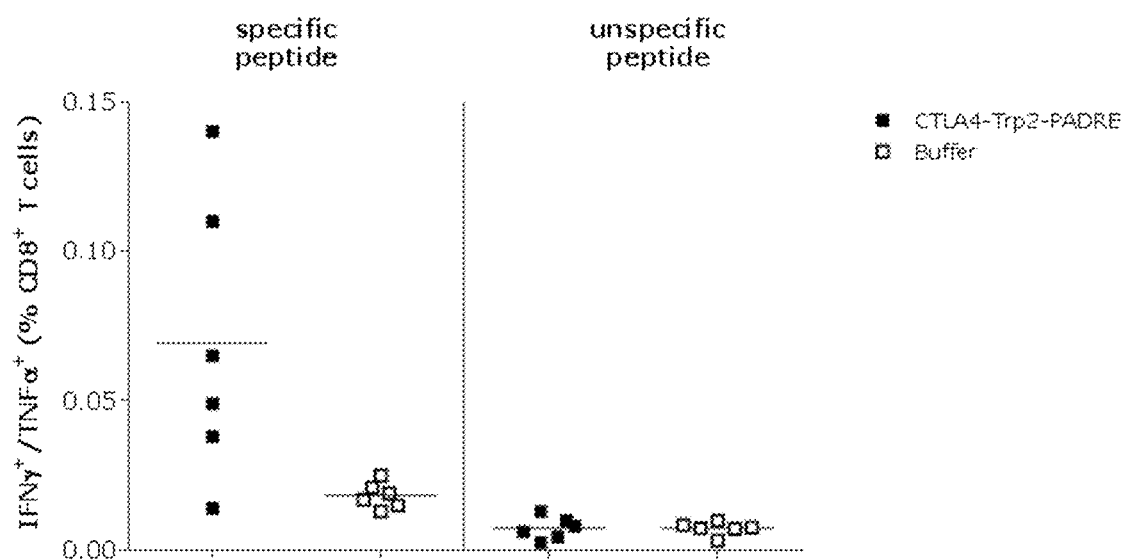
FIG. 3: Induction of epitope-specific CD8+ T cells after vaccination with RNA encoding a murine Trp2 epitope with $IRST_{epm}$-(CTLA4) derived targeting sequence.
Figure 4:
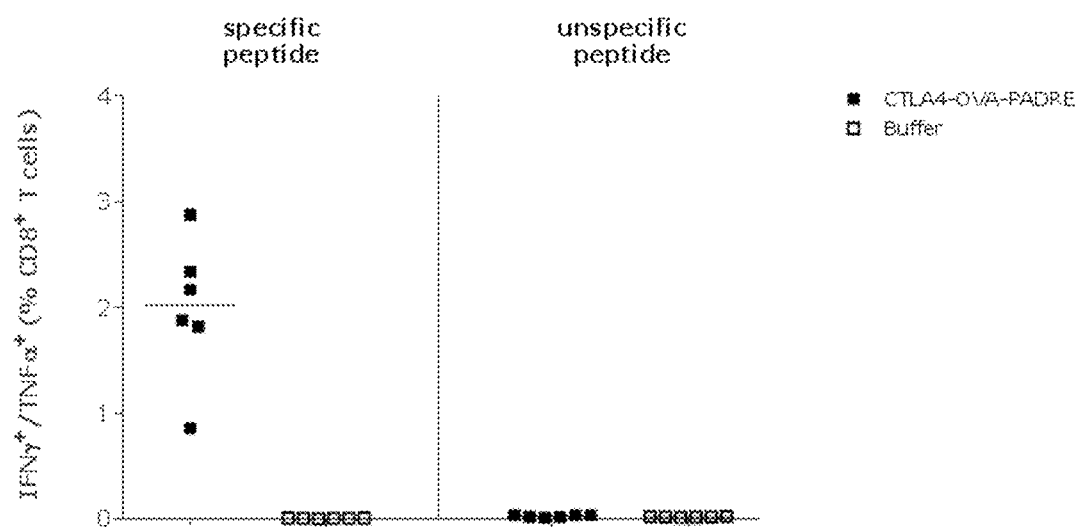
FIG. 4: Induction of epitope-specific CD8+ T cells after vaccination with RNA encoding an ovalbumin epitope with $IRST_{epm}$-(CTLA4) derived targeting sequence.

On days 0, 3, 7, 10 and 14 of the experiment mice were injected i.d. with RNA solved in Ringer Lactate buffer according to the Table 9 below. The total volume for intradermal vaccination was 80 µl and was distributed to 4 sites of injection. 6 days after the last vaccination an ICS was performed to evaluate epitope-specific CD8+ T cell responses. Therefore CD8+ T cells were stimulated with the corresponding peptide and as a control with an irrelevant peptide. In both groups epitope-specific CD8+ T cell responses were observed (FIGS. 3 and 4).

TABLE 9

| Groups, treatment and RNA dilution | | | |
|---|---|---|---|
| Groups | Constructs (amount of RNA) | No. of mice | SEQ ID NOs: |
| A* | CTLA4-OVA-PADRE (64 µg) | 6 | 2913 |
| B | CTLA4-Trp2-PADRE (64 µg) | 6 | 2914 |
| C | Buffer | 6 | |

More specifically, constructs according to A preferably have the following structure: HsCTLA4(1-35)_Linker_GgOva(249-273)_Linker_PADRE_Linker_HsCTLA4(162-223)

Example 3

C57BL/6 mice were injected subcutaneously (s.c.) with 3×10⁵ E.G7-OVA cells per mouse (in a volume of 100 µl PBS) on the right flank on day 0 of the experiment. At day 4 after tumor inoculation C57BL/6 mice were injected i.d. at 4 sites with RNA constructs encoding an epitope of ovalbumin (LESIINFEKLTE) and a T cell helper epitope (PADRE) with the CTLA4 targeting approach (64 µg RNA in 80 µl Ringer Lactate buffer). Two additional groups were vaccinated i.d. with ovalbumin full length protein encoded by mRNA (RNActive) (FIG. 5) or ovalbumin peptide in combination with RNAdjuvant (FIG. 6).

On days 0, 3, 7, 10 and 14 of the experiment mice were injected i.d. with RNA or peptide according to the Table 10 and 11 below.

Tumor growth was monitored by measuring the tumor size in three dimensions using a caliper. Tumor volume was calculated according to the following formula:

$$\text{volume (mm}^3\text{)} = \frac{\text{length (mm)} \times \pi \times \text{width}^2 \text{ (mm}^2\text{)}}{6}$$

Figure 5:
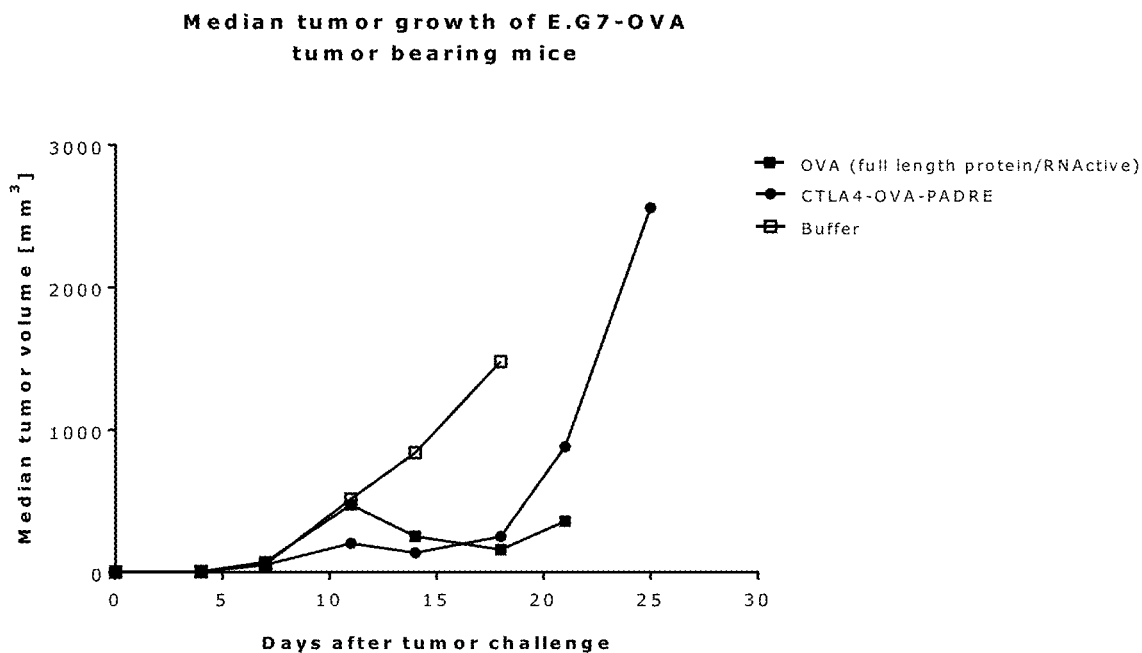
FIG. 5: Vaccination with RNA encoding an OVA epitope with IRSTepm (CTLA4)-derived targeting sequence induces a significant anti-tumor response in E.G7-OVA-tumor-bearing mice.
Figure 6:
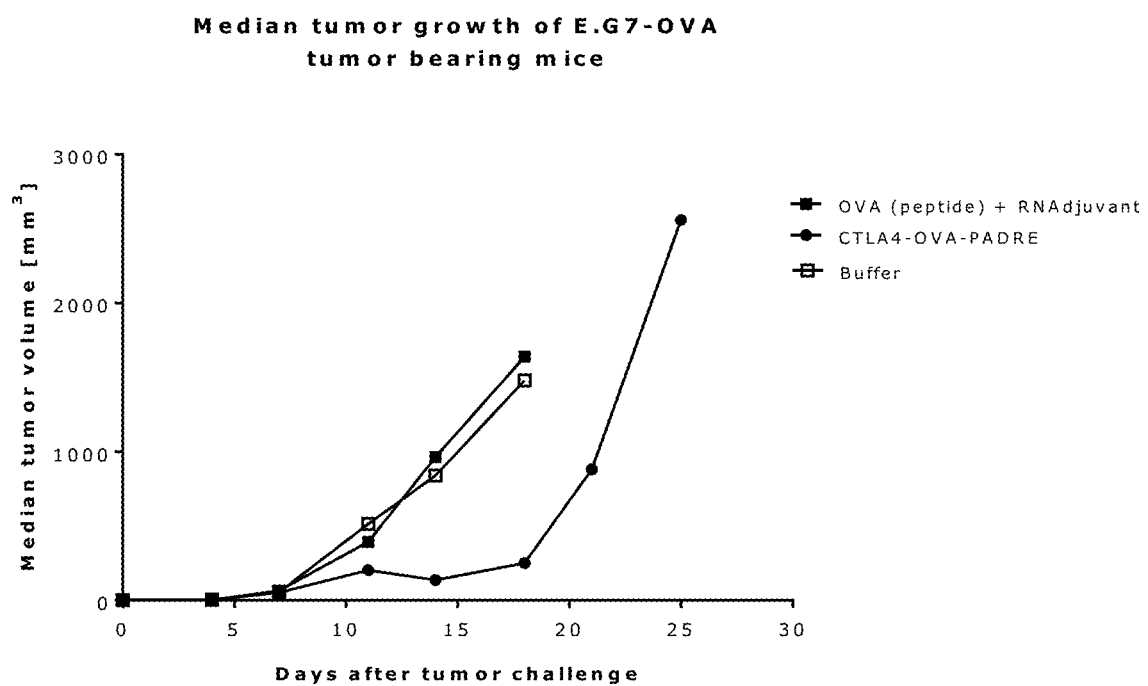
FIG. 6: Anti-tumor response induced by RNA encoding an OVA epitope with $IRST_{epm}$-(CTLA4-) derived targeting sequence is superior in comparison to vaccination with the corresponding peptide plus adjuvant.

Result:

Vaccination with RNA encoding an OVA epitope with the CTLA4 targeting approach induces a significant anti-tumor response in E.G7-OVA-tumor-bearing mice (FIGS. 5 and 6). Anti-tumor response induced by RNA encoding an OVA epitope with the targeting approach is superior in comparison to vaccination with the corresponding peptide plus an RNA-based adjuvant (RNAdjuvant) (FIG. 6).

TABLE 10

| Groups, treatment and RNA dilution | | | |
|---|---|---|---|
| Groups | Constructs (amount of RNA) | No. of mice | SEQ ID NOs: |
| A | OVA RNActive (full length protein) (32 µg) | 8 | 2935 |
| B | CTLA4-OVA-PADRE (64 µg) | 8 | 2913 |
| C | Buffer | 8 | |
| A | OVA (peptide, 50 µg) + RNAdjuvant (50 µg) | 8 | 2927 + 3029 |
| B | CTLA4-OVA-PADRE (64 µg) | 8 | 2913 |
| C | Buffer | 8 | |

Example 4

C57BL/6 mice were injected intradermally (i.d.) at 4 sites with mRNA constructs encoding different ovalbumin epitopes connected to a T cell helper epitope (PADRE) with the CTLA4 targeting approach (32 µg mRNA in 50 µl PBS). Short peptide of ovalbumin (LESIINFEKLTE) and long epitope of ovalbumin (EVSGLEQLESIINFEKLTEWTSSNV) covering the known CD8+ T cell epitope of ovalbumin.

Figure 7:
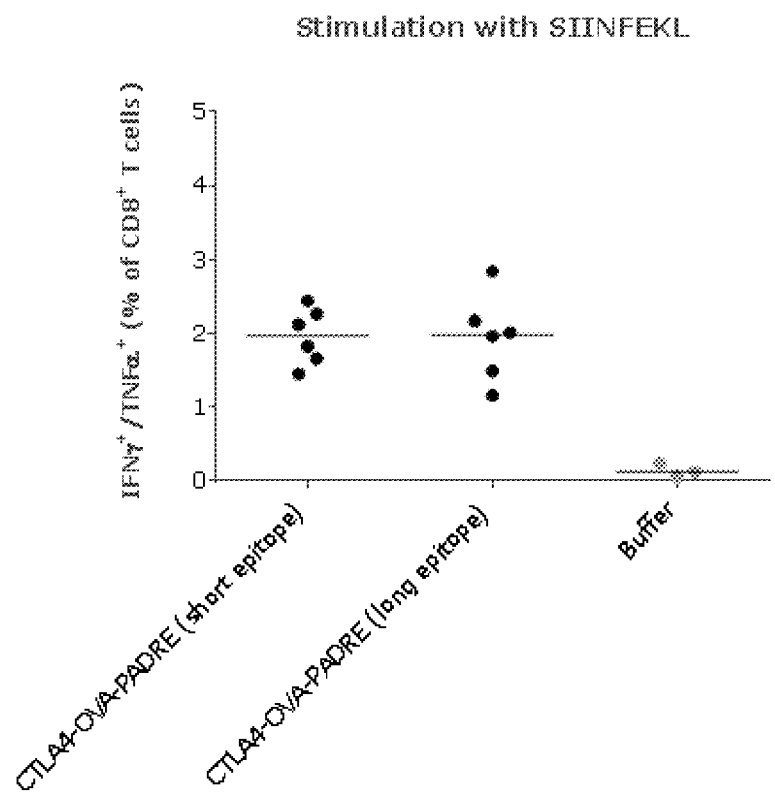
FIG. 7: Induction of epitope-specific CD8+ T cells after vaccination with mRNA encoding different ovalbumin epitopes with the CTLA4 targeting approach.

On days 0, 7 and 14 of the experiment mice were injected i.d. with mRNA solved in Ringer Lactate buffer according to the Table 11 below. The total volume for intradermal vaccination was 80 µl and was distributed to 4 sites of injection. 6 days after the last vaccination an ICS was performed to evaluate epitope-specific CD8+ T cell responses. Therefore CD8+ T cells were stimulated with the corresponding peptide and as a control with media. In both groups epitope-specific CD8+ T cell responses were observed (FIG. 7).

TABLE 11

| Groups, treatment and RNA dilution | | | |
|---|---|---|---|
| Groups | Constructs (amount of RNA) | No. of mice | SEQ ID NOs: |
| A | CTLA4-OVA-PADRE (long peptide) | 6 | 77062 |
| B | CTLA4-OVA-PADRE (short peptide) | 6 | 2913 |
| C | Buffer | 3 | — |

Items

The present invention may be characterized by the following items:
1. An artificial nucleic acid molecule comprising at least one coding region encoding
   a. at least one antigenic peptide or protein,
   and at least one additional amino acid sequence derived from at least one immune response activating signal transduction protein located in the external plasma membrane.
2. The artificial nucleic acid molecule according to item 1, wherein said immune response activating signal transduction protein located in the external plasma membrane (IRST$_{epm}$) is selected from CTLA4 (Cytotoxic T-lymphocyte protein 4), CD36 (Platelet glycoprotein 4), TRBC2 (T-cell receptor beta-2 chain C region), TRDC (T-cell receptor delta chain C region), TLR4 (Toll-like receptor 4), CD4 (T-cell surface glycoprotein CD4), TRBC1 (T-cell receptor beta-1 chain C region), CD3E (T-cell surface glycoprotein CD3 epsilon chain), PTPRC (Receptor-type tyrosine-protein phosphatase C), FCG3A (Low affinity immunoglobulin gamma Fc region receptor LNP-III-A), CD28 (T-cell-specific surface glycoprotein CD28), CD79A (B-cell antigen receptor complex-associated protein alpha chain), CD19 (B-lymphocyte antigen CD19), NKG2D (NKG2-D type II integral membrane protein), FCERG (High affinity immunoglobulin epsilon receptor subunit gamma), CD79B (B-cell antigen receptor complex-associated protein beta chain), CD86 (T-lymphocyte activation antigen CD86), CD226 (CD226 antigen), MUC17 (Mucin-17), CD209 (CD209 antigen), TLR8 (Toll-like receptor 8), or a variant, fragment or derivative of any of these proteins.
3. The artificial nucleic acid molecule according to item 1 or 2, wherein said at least one additional amino acid sequence comprises or consists of:
   b. at least one transmembrane domain and optionally
   c. at least one cytoplasmic domain.
4. The artificial nucleic acid molecule according to any one of the preceding items, wherein said at least one coding region further encodes
   d. at least one signal peptide.
5. The artificial nucleic acid molecule according to any one of the preceding items, wherein said at least one antigenic peptide or protein is selected from or derived from tumor antigens, viral, bacterial, protozoal, fungal or allogenic antigens.
6. The artificial nucleic acid molecule according to item 5, wherein said at least one antigenic peptide or protein comprises or consists of an amino acid sequence corresponding to any one of SEQ ID NOs: 3719-27945; 76420-76439, 76440-76474, or a fragment, variant or derivative thereof, and is optionally encoded by a nucleic acid sequence according to any one of SEQ ID NOs: 27946-52172; 76495-76514, 52173-76399; 76570-76589, 76515-76549, 76590-76624 or a fragment, variant or derivative of any one of said sequences.
7. The artificial nucleic acid molecule according to item 5 or 6, wherein said tumor antigen is selected from BRAF, PIK3CA, KRAS, IDH1, TP53, NRAS, AKT1, SF3B1, CDKN2A, RPSAP58, EGFR, NY-ESO1, MUC-1, 5T4, Her2, MAGE-A3, LY6K, CEACAM6, CEA, MCAK, KK-LC1, Gastrin, VEGFR2, MMP-7, MPHOSPH1, MAGE-A4, MAGE-A1, MAGE-C1, PRAME, Survivin, MAGE-A9, MAGE-C2, FGFR2, WT1, PSA, PSMA, Prostate-specific antigen precursor, Kita-kyushu lung cancer antigen 1, Trophoblast glycoprotein, Cyclin-dependent kinase inhibitor 2A, Cyclin-dependent kinase inhibitor 2A, isoforms 1/2/3, multiple tumor suppressor 1/cyclin-dependent kinase 4 inhibitor p16, GTPase NRas or a fragment, variant or derivative of any of said tumor antigens, or any combination thereof.
8. The artificial nucleic acid molecule according to any one of the preceding items wherein said IRST$_{epm}$ comprises or consists of an amino acid sequence corresponding to any one of SEQ ID NOs: 157-179, or a fragment, variant or derivative thereof, and is optionally encoded by a nucleic acid sequence corresponding to any one of SEQ ID NOs: 365-387, 573-595, 781-803, 989-1011, 1197-1219, 1405-1427, 1613-1635, 1821-1843, 2029-2051, 2237-2259, 2445-2467, 2653-2675, 2861-2883, or a fragment, variant or derivative of any one of said sequences.
9. The artificial nucleic acid molecule according to any one of items 3 to 8, wherein the at least one additional amino acid sequence comprises or consists of at least one transmembrane domain and at least one cytoplasmic domain comprising or consisting of an amino acid sequence corresponding to any one of SEQ ID NOs: 76625-76647, or a fragment, variant or derivative thereof and is optionally encoded by a nucleic acid sequence corresponding to any one of SEQ ID NOs: 76648-76947, 77004-77017, 77066 or a fragment, variant or derivative of any one of said sequences.
10. The artificial nucleic acid molecule according to any one of items 3 to 8, wherein the transmembrane domain comprises or consists of an amino acid sequence corresponding to any one of SEQ ID NOs: 180-208, or a fragment, variant or derivative thereof and is optionally encoded by a nucleic acid sequence corresponding to any one of SEQ ID NOs: 388-416, 596-624, 804-832, 1012-1040, 1220-1248, 1428-1456, 1636-1664, 1844-1872, 2052-2080, 2260-2288, 2468-2496, 2676-2704, 2884-2912, or a fragment, variant or derivative of any one of said sequences.
11. The artificial nucleic acid molecule according to any one of items 4 to 10, wherein the signal peptide comprises or consists of an amino acid sequence corresponding to any one of SEQ ID NOs: 1-156, 76948-76951, or a fragment, variant or derivative thereof, and is optionally encoded by a nucleic acid sequence according to any one of SEQ ID NOs: 209-364, 76952-76955, 625-780, 76960-76963, 833-988, 76964-76967, 417-572, 76956-76959, 1249-1404, 76972-76975, 1457-1612, 76976-76979, 1665-1820, 76980-76983, 1873-2028, 76984-76987, 2081-2236, 76988-76991, 2289-2444, 76992-76995, 2497-2652, 76996-76999, 2705-2860, 77000-77003, 1041-1196, or 76968-76971 or a fragment, variant or derivative thereof.
12. The artificial nucleic acid molecule according to any one of the preceding items, further encoding in its at least one coding region
    e. at least one linker.
13. The artificial nucleic acid molecule according to item 12, wherein said linker is a non-immunogenic linker, optionally comprising or consisting of an amino acid sequence according to any one of SEQ ID NOs: 2937, 76400-76418, 77018-77058 optionally encoded by a nucleic acid sequence according to any one of SEQ ID NOs: 2936, 76494, 76569, 76475-76493, 76550-76568, 77059-77061 or a fragment, variant or derivative of any one of said sequences.
14. The artificial nucleic acid molecule according to any one of the preceding items, wherein said at least one coding region further encodes
    f. at least one T helper epitope.
15. The artificial nucleic acid molecule according to item 14, wherein said helper epitope sequence comprises or consists of an amino acid sequence corresponding to any one of SEQ ID NOs: 3083-3294, or a fragment, variant or derivative thereof, and is optionally encoded by a nucleic acid sequence according to any one of SEQ ID NOs: 3295-3506, 3507-3718, or a fragment, variant or derivative of any one of said sequences.

16. The artificial nucleic acid molecule according to any one of the preceding items, comprising at least one coding region of the following Formula (I), preferably in 5'-3' direction:

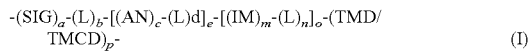

wherein
"SIG" encodes a signal peptide, preferably as defined in item 11,
"L" encodes a linker sequence, preferably as defined in item 13,
each "AN" encodes an identical or different antigenic peptide or protein, preferably as defined in item 5, 6 or 7,
"IM" encodes a helper epitope, preferably as defined in item 14 or 15,
"TMD/TMCD" encodes an amino acid sequence derived from an immune response signal transduction protein located in the external plasma membrane, preferably a transmembrane domain, preferably as defined in item 10, and optionally a cytoplasmic domain, preferably as defined in item 9
b, d, m, n, o is each independently an integer selected from 0, 1, 2, 3, 4, 5, 6, 7, 8, 9, and 10,
a, c, e, p is each independently an integer selected from 1, 2, 3, 4, 5, 6, 7, 8, 9 and 10.

17. The artificial nucleic acid molecule according to any one of the preceding items, encoding in its at least one coding region at least one, or a plurality of at least two, three, four, five, six, seven, eight, nine or ten antigenic peptides or proteins, optionally selected from at least one antigenic peptide or protein according to item 5 or 6, or fragment, variant or derivative thereof, or a combination of said antigenic peptides or proteins, or their fragments, variants or derivatives.

18. The artificial nucleic acid molecule according to any one of items 1 to 17, wherein said artificial nucleic acid molecule is an RNA.

19. The artificial nucleic acid molecule according to item 18, wherein the RNA is an mRNA, a viral RNA, a replicon RNA, or a circular RNA.

20. The artificial nucleic acid molecule, preferably RNA, according to any one of the preceding items, wherein the artificial nucleic acid molecule is mono-, bi-, or multicistronic.

21. The artificial nucleic acid molecule, preferably RNA, according to any one of the preceding items, wherein said artificial nucleic acid molecule is modified, preferably stabilized.

22. The artificial nucleic acid molecule, preferably RNA, according to any one of the preceding items, wherein the G/C content of the at least one coding region is increased compared to the G/C content of the corresponding coding sequence of the corresponding wild-type artificial nucleic acid, and/or wherein
the C content of the at least one coding region is increased compared to the C content of the corresponding coding sequence of the corresponding wild-type artificial nucleic acid, and/or wherein
the codons in the at least one coding region are adapted to human codon usage, wherein the codon adaptation index (CAI) is preferably increased or maximised in the at least one coding sequence of the artificial nucleic acid,
wherein the amino acid sequence encoded by the artificial nucleic acid is preferably not being modified compared to the amino acid sequence encoded by the corresponding wild-type artificial nucleic acid.

23. The artificial nucleic acid molecule, preferably RNA, according to item 22, wherein said at least one coding region comprises or consists of a nucleic acid sequence corresponding to any one of SEQ ID NOs: 417-2912, 76671-76947, 77004-77017, 77066.

24. The artificial nucleic acid molecule, preferably RNA, according to any one of the preceding items, which comprises a 5'-CAP structure, preferably m7GpppN or Cap1.

25. The artificial nucleic acid molecule, preferably RNA, according to any one of the preceding items, which comprises at least one histone stem-loop.

26. The artificial nucleic acid molecule, preferably RNA, according to item 25, wherein the at least one histone stem-loop comprises a nucleic acid sequence according to the following formulae (II) or (III):

formula (II) (stem-loop sequence without stem bordering elements):

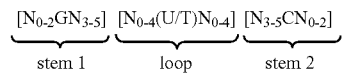

formula (III) (stem-loop sequence with stem bordering elements):

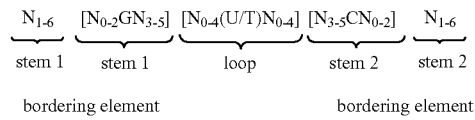

wherein:

| | |
|---|---|
| stem1 or stem2 bordering elements $N_{1-6}$ | is a consecutive sequence of 1 to 6, preferably of 2 to 6, more preferably of 2 to 5, even more preferably of 3 to 5, most preferably of 4 to 5 or 5N, wherein each N is independently from another selected from a nucleotide selected from A, U, T, G and C, or a nucleotide analogue thereof; |
| stem1 $[N_{0-2}GN_{3-5}]$ | is reverse complementary or partially reverse complementary with element stem2, and is a consecutive sequence between of 5 to 7 nucleotides; wherein $N_{0-2}$ is a consecutive sequence of 0 to 2, preferably of 0 to 1, more preferably of 1N, wherein each N is independently from another selected from a nucleotide selected from A, U, T, G and C or a nucleotide analogue thereof; wherein $N_{3-5}$ is a consecutive sequence of 3 to 5, preferably of 4 to 5, more preferably of 4N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine; |

| | |
|---|---|
| loop sequence [N$_{0-4}$(U/T)N$_{0-4}$] | is located between elements stem1 and stem2, and is a consecutive sequence of 3 to 5 nucleotides, more preferably of 4 nucleotides; wherein each N$_{0-4}$ is independent from another a consecutive sequence of 0 to 4, preferably of 1 to 3, more preferably of 1 to 2N, wherein each N is independently from another selected from a nucleotide selected from A, U, T, G and C or a nucleotide analogue thereof; and wherein U/T represents uridine, or optionally thymidine; |
| stem2 [N$_{3-5}$CN$_{0-2}$] | is reverse complementary or partially reverse complementary with element stem1, and is a consecutive sequence between of 5 to 7 nucleotides; wherein N$_{3-5}$ is a consecutive sequence of 3 to 5, preferably of 4 to 5, more preferably of 4N, wherein each N is independently from another selected from a nucleotide selected from A, U, T, G and C or a nucleotide analogue thereof; wherein N$_{0-2}$ is a consecutive sequence of 0 to 2, preferably of 0 to 1, more preferably of 1N, wherein each N is independently from another selected from a nucleotide selected from A, U, T, G and C or a nucleotide analogue thereof; and wherein C is cytidine or an analogue thereof, and may be optionally replaced by a guanosine or an analogue thereof provided that its complementary nucleotide guanosine in stem1 is replaced by cytidine; | wherein
stem1 and stem2 are capable of base pairing with each other forming a reverse complementary sequence, wherein base pairing may occur between stem1 and stem2, or forming a partially reverse complementary sequence, wherein an incomplete base pairing may occur between stem1 and stem2.

27. The artificial nucleic acid molecule, preferably RNA, according to item 25 or 26, wherein the at least one histone stem-loop comprises a nucleic acid sequence according to the following formulae (IIa) or (IIIa):
formula (IIa) (stem-loop sequence without stem bordering elements):

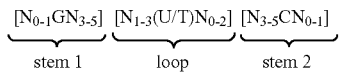

formula (IIIa) (stem-loop sequence with stem bordering elements):

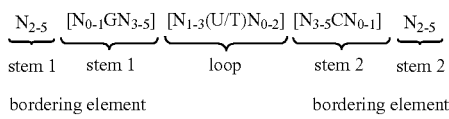

28. The artificial nucleic acid molecule, preferably RNA, according to any one of the preceding items, optionally comprising a poly(A) sequence, preferably comprising 10 to 200, 10 to 100, 40 to 80 or 50 to 70 adenosine nucleotides.

29. The artificial nucleic acid molecule, preferably RNA, according to any one of the preceding items, optionally comprising a poly(C) sequence, preferably comprising 10 to 200, 10 to 100, 20 to 70, 20 to 60 or 10 to 40 cytosine nucleotides.

30. The artificial nucleic acid molecule, preferably RNA, according to any one of the preceding items, which comprises, preferably in 5' to 3' direction, the following elements:
a) a 5'-CAP structure, preferably m7GpppN, an ARCA Cap or Cap1
b) optionally a 5'-UTR element, preferably comprising or consisting of a nucleic acid sequence, corresponding to the nucleic acid sequence according to SEQ ID NOs: 3061 or 3063 or a fragment, variant or corresponding RNA sequence thereof,
c) at least one coding sequence as defined in any one of the preceding items,
d) optionally a 3'-UTR element, preferably comprising or consisting of a nucleic acid sequence corresponding to the nucleic acid sequence according to SEQ ID NOs: 3065; 3067; 3069; 3071; 3073; 3075 or 3077, or a fragment, variant or corresponding RNA sequence thereof,
e) optionally a poly(A) tail, preferably consisting of 10 to 1000, 10 to 500, 10 to 300 10 to 200, 10 to 100, 40 to 80 or 50 to 70 adenosine nucleotides,
f) optionally a poly(C) tail, preferably consisting of 10 to 200, 10 to 100, 20 to 70, 20 to 60 or 10 to 40 cytosine nucleotides, and
g) optionally a histone stem-loop, optionally comprising or consisting of a nucleic acid sequence corresponding to SEQ ID NO: 3079 or 3080.

31. Composition comprising at least one artificial nucleic acid molecule, preferably RNA, according to any one of items 1 to 30 and a pharmaceutically acceptable carrier and/or excipient.

32. Composition according to item 31 comprising a plurality of at least two artificial nucleic acid molecules according to any one of items 1 to 30, wherein preferably at least two of said plurality of artificial nucleic acid molecules encode a different antigenic peptide or protein, optionally selected from an antigenic peptide or protein as defined in item 5, 6 or 7, or a fragment, variant or derivative thereof.

33. Composition according to item 31 or 32, wherein said composition is a pharmaceutical composition, optionally a vaccine.

34. The (pharmaceutical) composition or vaccine according to item 33, wherein the artificial nucleic acid molecule, preferably RNA, is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

35. The (pharmaceutical) composition or vaccine according to item 34, wherein the cationic or polycationic compound is a polymeric carrier.

36. The (pharmaceutical) composition or vaccine according to item 34, wherein the N/P ratio of the artificial nucleic acid molecule, preferably RNA, to the one or more cationic or polycationic compounds is in the range of about 0.1 to 10, including a range of about 0.3 to 4, of about 0.5 to 2, of about 0.7 to 2 and of about 0.7 to 1.5.

37. The (pharmaceutical) composition or vaccine according to any one of items 31 to 36, wherein the artificial nucleic acid molecule, preferably RNA, is complexed with one or more lipids, thereby forming lipid nanoparticles, lipoplexes and/or preferably liposomes.

38. The (pharmaceutical) composition or vaccine according to any one of items 31 to 37, said composition further comprising a non-coding RNA selected from the group consisting of small interfering RNA (siRNA), antisense RNA (asRNA), circular RNA (circRNA), ribozymes, aptamers, riboswitches, immunostimulating RNA (isRNA), transfer RNA (tRNA), ribosomal RNA (rRNA), small nuclear RNA (snRNA), small nucleolar RNA (snoRNA), microRNA (miRNA), and Piwi-interacting RNA (piRNA).

39. The (pharmaceutical) composition or vaccine according to item 38, wherein the immunostimulating RNA comprises at least one RNA sequence according to formula (IS-I) $(GiX_mG_n)$, formula (IS-II) $(C_lX_mC_n)$, formula (IS-IIII) $(N_uG_lX_mG_nN_v)_a$, and/or formula (IS-IV) $(N_uC_lX_mC_nN_v)_a$.

40. The (pharmaceutical) composition or vaccine according to item 39, wherein the immunostimulating RNA comprises at least one RNA sequence corresponding to any one of SEQ ID NOs: 2938-3032.

41. The (pharmaceutical) composition or vaccine of any one of items 31 to 40, wherein the composition comprises a polymeric carrier cargo complex, formed by a polymeric carrier, preferably comprising disulfide-crosslinked cationic peptides, preferably $Cys-Arg_{12}$, and/or $Cys-Arg_{12}-Cys$, and an isRNA, preferably comprising or consisting of an RNA sequence corresponding to SEQ ID NOs: 2938-3032.

42. Kit, preferably kit of parts, comprising the artificial nucleic acid molecule, preferably RNA, according to any one of items 1 to 30 or the (pharmaceutical) composition or vaccine according to any one of items 31 to 41, and optionally a liquid vehicle and/or optionally technical instructions with information on the administration and dosage of the artificial nucleic acid molecule or the composition.

43. The kit according to item 42, wherein the kit contains as a part Ringer-Lactate solution.

44. The artificial nucleic acid molecule, preferably RNA, according to any one of items 1 to 30, the (pharmaceutical) composition or vaccine according to any one of items 31 to 41, or the kit according to item 42 to 43 for use as a medicament.

45. The artificial nucleic acid molecule, preferably RNA, according to any one of items 1 to 30, the (pharmaceutical) composition or vaccine according to any one of items 31 to 41, or the kit according to item 42 to 44 for use in a method of treatment or prophylaxis of cancer, infectious diseases including viral, bacterial, fungal or protozoal infections, autoimmune diseases, Graft-versus-host disease (GvHD) or allergies.

46. The artificial nucleic acid molecule, preferably RNA, for the use according to item 45, wherein said use comprises (a) administering, to a subject in need thereof, said artificial nucleic acid molecule, preferably RNA, said (pharmaceutical) composition or vaccine, or said kit.

47. The artificial nucleic acid molecule, preferably RNA, for the use according to item 46, wherein administration is accomplished parenterally, preferably intradermally, subcutaneously, intravenously, intramuscularly, intranodally, transdermally, or intratumorally.

48. A method of treating or preventing cancer, autoimmune diseases, or infectious diseases including viral, bacterial, fungal or protozoal infections, wherein the method comprises administering, to a patient in need thereof, an effective amount of the artificial nucleic acid molecule, preferably RNA, according to any one of items 1 to 30, the (pharmaceutical) composition or vaccine according to any one of items 31 to 41, or the kit according to item 42 to 43.

49. The use according to any one of items 44 to 47, or the method according to item 48, further comprising subjecting the patient to at least one or more of the following additional therapies: chemotherapy (e.g. first-line or second-line chemotherapy), radiotherapy, chemoradiation (combination of chemotherapy and radiotherapy), kinase inhibitors, antibody therapy and/or checkpoint modulators (e.g. CTLA4 inhibitors, PD1 pathway inhibitors) or inhibitors inducing expression of T cell epitopes associated with impaired peptide processing (TEIPPs).

50. The use according to item 49, wherein said additional therapy is effected prior, simultaneously, or subsequently to the administration of said artificial nucleic acid molecule, (pharmaceutical) composition or vaccine, or kit.

51. An in vitro cell culture or cell treatment method comprising (a) providing cells in vitro, (b) contacting said cells with the artificial nucleic acid molecule, preferably RNA, according to any one of items 1 to 30, the (pharmaceutical) composition or vaccine according to any one of items 31 to 41, or the kit according to item 42 to 43.

SEQUENCE LISTING (77066 sequences)

SEQ ID NO: 1 - protein, 16 aa, Artificial Sequence
  P14207_1-16
MVWKWMPLLLLLVCVA

SEQ ID NO: 2 - protein, 16 aa, Artificial Sequence
  O75787_1-16
MAVFVVLLALVAGVLG

SEQ ID NO: 3 - protein, 16 aa, Artificial Sequence
  P07359_1-16
MPLLLLLLLLPSPLHP

SEQ ID NO: 4 - protein, 16 aa, Artificial Sequence
  P08637_1-16
MWQLLLPTALLLLVSA

SEQ ID NO: 5 - protein, 17 aa, Artificial Sequence
  P07237_1-17
MLRRALLCLAVAALVRA

SEQ ID NO: 6 - protein, 17 aa, Artificial Sequence
  O60911_1-17
MNLSLVLAAFCLGIASA

SEQ ID NO: 7 - protein, 17 aa, Artificial Sequence
  P20138_1-17
MPLLLLLPLLWAGALAM

SEQ ID NO: 8 - protein, 17 aa, Artificial Sequence
  P27797_1-17
MLLSVPLLLGLLGLAVA

SEQ ID NO: 9 - protein, 18 aa, Artificial Sequence
  P10747_1-18
MLRLLLALNLFPSIQVTG

SEQ ID NO: 10 - protein, 18 aa, Artificial Sequence
  O75487_1-18
MARFGLPALLCTLAVLSA

SEQ ID NO: 11 - protein, 18 aa, Artificial Sequence
  P07996_1-18
MGLAWGLGVLFLMHVCGT

SEQ ID NO: 12 - protein, 18 aa, Artificial Sequence
  P22748_1-18
MRMLLALLALSAARPSAS

SEQ ID NO: 13 - protein, 18 aa, Artificial Sequence
  Q15762_1-18
MDYPTLLLALLHVYRALC

SEQ ID NO: 14 - protein, 18 aa, Artificial Sequence
  P30273_1-18
MIPAVVLLLLLLVEQAAA

SEQ ID NO: 15 - protein, 18 aa, Artificial Sequence
  P38570_1-18
MWLFHTLLCIASLALLAA

SEQ ID NO: 16 - protein, 18 aa, Artificial Sequence
  Q01638_1-18
MGFWILAILTILMYSTAA

SEQ ID NO: 17 - protein, 18 aa, Artificial Sequence
  Q9NZQ7_1-18
MRIFAVFIFMTYWHLLNA

SEQ ID NO: 18 - protein, 19 aa, Artificial Sequence
  P13591_1-19
MLQTKDLIWTLFFLGTAVS

SEQ ID NO: 19 - protein, 19 aa, Artificial Sequence
  P26842_1-19
MARPHPWWLCVLGTLVGLS

SEQ ID NO: 20 - protein, 19 aa, Artificial Sequence
  P15391_1-19
MPPPRLLFFLLFLTPMEVR

SEQ ID NO: 21 - protein, 19 aa, Artificial Sequence
  Q8NI17_1-19
MMWTWALWMLPSLCKFSLA

SEQ ID NO: 22 - protein, 19 aa, Artificial Sequence
  P08571_1-19
MERASCLLLLLLPLVHVSA

SEQ ID NO: 23 - protein, 19 aa, Artificial Sequence
  P05154_1-19
MQLFLLLCLVLLSPQGASL

SEQ ID NO: 24 - protein, 19 aa, Artificial Sequence
  P02787_1-19
MRLAVGALLVCAVLGLCLA

SEQ ID NO: 25 - protein, 19 aa, Artificial Sequence
  P02671_1-19
MFSMRIVCLVLSVVGTAWT

SEQ ID NO: 26 - protein, 19 aa, Artificial Sequence
  P04216_1-19
MNLAISIALLLTVLQVSRG

SEQ ID NO: 27 - protein, 19 aa, Artificial Sequence
  P00747_1-19
MEHKEVVLLLLLFLKSGQG

SEQ ID NO: 28 - protein, 19 aa, Artificial Sequence
  P01764_1-19
MEFGLSWLFLVAILKGVQC

SEQ ID NO: 29 - protein, 19 aa, Artificial Sequence
  P16150_1-19
MATLLLLLGVLVVSPDALG

SEQ ID NO: 30 - protein, 19 aa, Artificial Sequence
  Q6DN72_1-19
MLLWTAVLLFVPCVGKTVW

SEQ ID NO: 31 - protein, 19 aa, Artificial Sequence
  Q01151_1-19
MSRGLQLLLLSCAYSLAPA

SEQ ID NO: 32 - protein, 19 aa, Artificial Sequence
  P07093_1-19
MNWHLPLFLLASVTLPSIC

SEQ ID NO: 33 - protein, 19 aa, Artificial Sequence
  Q8WWQ8_1-19
MMLQHLVIFCLGLVVQNFC

SEQ ID NO: 34 - protein, 20 aa, Artificial Sequence
  Q13291_1-20
MDPKGLLSLTFVLFLSLAFG

SEQ ID NO: 35 - protein, 20 aa, Artificial Sequence
  P35225_1-20
MALLLTTVIALTCLGGFASP

SEQ ID NO: 36 - protein, 20 aa, Artificial Sequence
  P25942_1-20
MVRLPLQCVLWGCLLTAVHP

SEQ ID NO: 37 - protein, 20 aa, Artificial Sequence
  P52803_1-20
MLHVEMLTLVFLVLWMCVFS

SEQ ID NO: 38 - protein, 20 aa, Artificial Sequence
  Q15116_1-20
MQIPQAPWPVVWAVLQLGWR

SEQ ID NO: 39 - protein, 20 aa, Artificial Sequence
  P05556_1-20
MNLQPIFWIGLISSVCCVFA

SEQ ID NO: 40 - protein, 20 aa, Artificial Sequence
  Q12891_1-20
MRAGPGPTVTLALVLAVAWA

SEQ ID NO: 41 - protein, 20 aa, Artificial Sequence
  Q8IV16_1-20
MKALGAVLLALLLCGRPGRG

SEQ ID NO: 42 - protein, 20 aa, Artificial Sequence
  Q03167_1-20
MTSHYVIAIFALMSSCLATA

SEQ ID NO: 43 - protein, 20 aa, Artificial Sequence
  Q14246_1-20
MRGFNLLLFWGCCVMHSWEG

SEQ ID NO: 44 - protein, 20 aa, Artificial Sequence
  P16871_1-20
MTILGTTFGMVFSLLQVVSG

SEQ ID NO: 45 - protein, 20 aa, Artificial Sequence
  P61769_1-20
MSRSVALAVLALLSLSGLEA

SEQ ID NO: 46 - protein, 20 aa, Artificial Sequence
  Q9Y6W8_1-20
MKSGLWYFFLFCLRIKVLTG

SEQ ID NO: 47 - protein, 21 aa, Artificial Sequence
  P10966_1-21
MRPRLWLLLAAQLTVLHGNSV

SEQ ID NO: 48 - protein, 21 aa, Artificial Sequence
  Q9BZW8_1-21
MLGQVVTLILLLLLKVYQGKG

SEQ ID NO: 49 - protein, 21 aa, Artificial Sequence
  P02778_1-21
MNQTAILICCLIFLTLSGIQG

SEQ ID NO: 50 - protein, 21 aa, Artificial Sequence
  P18564_1-21
MGIELLCLFFLFLGRNDHVQG

SEQ ID NO: 51 - protein, 21 aa, Artificial Sequence
  O14525_1-21
MALAGLCALLACCWGPAAVLA

SEQ ID NO: 52 - protein, 21 aa, Artificial Sequence
  P01130_1-21
MGPWGWKLRWTVALLLAAAGT

SEQ ID NO: 53 - protein, 21 aa, Artificial Sequence
  P01732_1-21
MALPVTALLLPLALLLHAARP

SEQ ID NO: 54 - protein, 21 aa, Artificial Sequence
  P48061_1-21
MNAKVVVVLVLVLTALCLSDG

SEQ ID NO: 55 - protein, 21 aa, Artificial Sequence
  P01589_1-21
MDSYLLMWGLLTFIMVPGCQA

SEQ ID NO: 56 - protein, 21 aa, Artificial Sequence
  Q86T13_1-21
MRPAFALCLLWQALWPGPGGG

SEQ ID NO: 57 - protein, 21 aa, Artificial Sequence
  Q5DID0_1-21
MLRTSGLALLALVSAVGPSQA

SEQ ID NO: 58 - protein, 22 aa, Artificial Sequence
  P40189_1-22
MLTLQTWLVQALFIFLTTESTG

SEQ ID NO: 59 - protein, 22 aa, Artificial Sequence
  Q86YL7_1-22
MWKVSALLFVLGSASLWVLAEG

SEQ ID NO: 60 - protein, 22 aa, Artificial Sequence
  P55075_1-22
MGSPRSALSCLLLHLLVLCLQA

SEQ ID NO: 61 - protein, 22 aa, Artificial Sequence
  Q30201_1-22
MGPRARPALLLLMLLQTAVLQG

SEQ ID NO: 62 - protein, 22 aa, Artificial Sequence
  P07766_1-22
MQSGTHWRVLGLCLLSVGVWGQ

SEQ ID NO: 63 - protein, 22 aa, Artificial Sequence
  P18827_1-22
MRRAALWLWLCALALSLQPALP

SEQ ID NO: 64 - protein, 22 aa, Artificial Sequence
  P55290_1-22
MQPRTPLVLCVLLSQVLLLTSA

SEQ ID NO: 65 - protein, 22 aa, Artificial Sequence
  P37173_1-22
MGRGLLRGLWPLHIVLWTRIAS

SEQ ID NO: 66 - protein, 22 aa, Artificial Sequence
  Q07325_1-22
MKKSGVLFLLGIILLVLIGVQG

SEQ ID NO: 67 - protein, 22 aa, Artificial Sequence
  P04156_1-22
MANLGCWMLVLFVATWSDLGLC

SEQ ID NO: 68 - protein, 22 aa, Artificial Sequence
  P31785_1-22
MLKPSLPFTSLLFLQLPLLGVG

SEQ ID NO: 69 - protein, 23 aa, Artificial Sequence
  P01579_1-23
MKYTSYILAFQLCIVLGSLGCYC

SEQ ID NO: 70 - protein, 23 aa, Artificial Sequence
  P23229_1-23
MAAAGQLCLLYLSAGLLSRLGAA

SEQ ID NO: 71 - protein, 23 aa, Artificial Sequence
  O60494_1-23
MMNMSLPFLWSLLTLLIFAEVNG

SEQ ID NO: 72 - protein, 23 aa, Artificial Sequence
  P08575_1-23
MYLWLKLLAFGFAFLDTEVFVTG

SEQ ID NO: 73 - protein, 23 aa, Artificial Sequence
  Q8IWY4_1-23
MGAAAVRWHLCVLLALGTRGRLA

SEQ ID NO: 74 - protein, 23 aa, Artificial Sequence
  Q08431_1-23
MPRPRLLAALCGALLCAPSLLVA

SEQ ID NO: 75 - protein, 23 aa, Artificial Sequence
  Q99665_1-23
MAHTFRGCSLAFMFIITWLLIKA

SEQ ID NO: 76 - protein, 23 aa, Artificial Sequence
  Q6Q8B3_1-23
MSAPRLLISIIIMVSASSSSCMG

SEQ ID NO: 77 - protein, 23 aa, Artificial Sequence
  Q07011_1-23
MGNSCYNIVATLLLVLNFERTRS

SEQ ID NO: 78 - protein, 23 aa, Artificial Sequence
  Q8NHL6_1-23
MTPILTVLICLGLSLGPRTHVQA

SEQ ID NO: 79 - protein, 23 aa, Artificial Sequence
  P36894_1-23
MPQLYIYIRLLGAYLFIISRVQG

SEQ ID NO: 80 - protein, 23 aa, Artificial Sequence
  Q16552_1-23
MTPGKTSLVSLLLLLSLEAIVKA

SEQ ID NO: 81 - protein, 23 aa, Artificial Sequence
  P42081_1-23
MDPQCTMGLSNILFVMAFLLSGA

SEQ ID NO: 82 - protein, 23 aa, Artificial Sequence
  P43121_1-23
MGLPRLVCAFLLAACCCCPRVAG

SEQ ID NO: 83 - protein, 23 aa, Artificial Sequence
  O00206_1-23
MMSASRLAGTLIPAMAFLSCVRP

SEQ ID NO: 84 - protein, 23 aa, Artificial Sequence
  P42701_1-23
MEPLVTWVVPLLFLFLLSRQGAA

SEQ ID NO: 85 - protein, 24 aa, Artificial Sequence
  P06729_1-24
MSFPCKFVASFLLIFNVSSKGAVS

SEQ ID NO: 86 - protein, 24 aa, Artificial Sequence
  P15328_1-24
MAQRMTTQLLLLLVWVAVVGEAQT

SEQ ID NO: 87 - protein, 24 aa, Artificial Sequence
  P05112_1-24
MGLTSQLLPPLFFLLACAGNFVHG

SEQ ID NO: 88 - protein, 24 aa, Artificial Sequence
  P06127_1-24
MPMGSLQPLATLYLLGMLVASCLG

SEQ ID NO: 89 - protein, 24 aa, Artificial Sequence
  P32248_1-24
MDLGKPMKSVLVVALLVIFQVCLC

SEQ ID NO: 90 - protein, 24 aa, Artificial Sequence
  Q7Z7D3_1-24
MASLGQILFWSIISIIIILAGAIA

SEQ ID NO: 91 - protein, 24 aa, Artificial Sequence
  P54756_1-24
MRGSGPRGAGRRRPPSGGGDTPIT

SEQ ID NO: 92 - protein, 24 aa, Artificial Sequence
  Q92823_1-24
MQLKIMPKKKRLSAGRVPLILFLC

SEQ ID NO: 93 - protein, 24 aa, Artificial Sequence
  P19320_1-24
MPGKMVVILGASNILWIMFAASQA

SEQ ID NO: 94 - protein, 24 aa, Artificial Sequence
  Q86UN2_1-24
MLRKGCCVELLLLLVAAELPLGGG

SEQ ID NO: 95 - protein, 25 aa, Artificial Sequence
  P33151_1-25
MQRLMMLLATSGACLGLLAVAAVAA

SEQ ID NO: 96 - protein, 25 aa, Artificial Sequence
  P17813_1-25
MDRGTLPLAVALLLASCSLSPTSLA

SEQ ID NO: 97 - protein, 25 aa, Artificial Sequence
  P25445_1-25
MLGIWTLLPLVLTSVARLSSKSVNA

SEQ ID NO: 98 - protein, 25 aa, Artificial Sequence
  P01730_1-25
MNRGVPFRHLLLVLQLALLPAATQG

SEQ ID NO: 99 - protein, 25 aa, Artificial Sequence
  Q685J3_1-25
MPRPGTMALCLLTLVLSLLPPQAAA

SEQ ID NO: 100 - protein, 25 aa, Artificial Sequence
  P17787_1-25
MARRCGPVALLLGFGLLRLCSGVWG

SEQ ID NO: 101 - protein, 25 aa, Artificial Sequence
  Q6UQ28_1-25
MAVFHDMLLQPLGMFLCLSLQLSSA

SEQ ID NO: 102 - protein, 25 aa, Artificial Sequence
  P13987_1-25
MGIQGGSVLFGLLLVLAVFCHSGHS

SEQ ID NO: 103 - protein, 25 aa, Artificial Sequence
  P10721_1-25
MRGARGAWDFLCVLLLLLRVQTGSS

SEQ ID NO: 104 - protein, 25 aa, Artificial Sequence
  P12319_1-25
MAPAMESPTLLCVALLFFAPDGVLA

SEQ ID NO: 105 - protein, 26 aa, Artificial Sequence
  Q9BZR6_1-26
MKRASAGGSRLLAWVLWLQAWQVAAP

SEQ ID NO: 106 - protein, 26 aa, Artificial Sequence
  P25063_1-26
MGRAMVARLGLGLLLLALLLPTQIYS

SEQ ID NO: 107 - protein, 26 aa, Artificial Sequence
  Q9NR97_1-26
MENMFLQSSMLTCIFLLISGSCELCA

SEQ ID NO: 108 - protein, 26 aa, Artificial Sequence
  Q8N131_1-26
MGLGARGAWAALLLGTLQVLALLGAA

SEQ ID NO: 109 - protein, 26 aa, Artificial Sequence
  P49771_1-26
MTVLAPAWSPTTYLLLLLLLSSGLSG

SEQ ID NO: 110 - protein, 26 aa, Artificial Sequence
  P02679_1-26
MSWSLHPRNLILYFYALLFLSSTCVA

SEQ ID NO: 111 - protein, 26 aa, Artificial Sequence
  P14784_1-26
MAAPALSWRLPLLILLLPLATSWASA

SEQ ID NO: 112 - protein, 27 aa, Artificial Sequence
  P05362_1-27
MAPSSPRPALPALLVLLGALFPGPGNA

SEQ ID NO: 113 - protein, 27 aa, Artificial Sequence
  Q13740_1-27
MESKGASSCRLLFCLLISATVFRPGLG

SEQ ID NO: 114 - protein, 28 aa, Artificial Sequence
  Q13443_1-28
MGSGARFPSGTLRVRWLLLLGLVGPVLG

SEQ ID NO: 115 - protein, 28 aa, Artificial Sequence
  P14151_1-28
MIFPWKCQSTQRDLWNIFKLWGWTMLCC

SEQ ID NO: 116 - protein, 28 aa, Artificial Sequence
  P56199_1-28
MAPRPRARPGVAVACCWLLTVVLRCCVS

SEQ ID NO: 117 - protein, 28 aa, Artificial Sequence
  P11279_1-28
MAAPGSARRPLLLLLLLLLLGLMHCASA

SEQ ID NO: 118 - protein, 28 aa, Artificial Sequence
  P40259_1-28
MARLALSPVPSHWMVALLLLLSAEPVPA

SEQ ID NO: 119 - protein, 28 aa, Artificial Sequence
  P43681_1-28
MELGGPGAPRLLPPLLLLLGTGLLRASS

SEQ ID NO: 120 - protein, 28 aa, Artificial Sequence
  P18627_1-28
MWEAQFLGLLFLQPLWVAPVKPLQPGAE

SEQ ID NO: 121 - protein, 28 aa, Artificial Sequence
  Q5ZPR3_1-28
MLRRRGSPGMGVHVGAALGALWFCLTGA

SEQ ID NO: 122 - protein, 28 aa, Artificial Sequence
  P23415_1-28
MYSFNTLRLYLWETIVFFSLAASKEAEA

SEQ ID NO: 123 - protein, 28 aa, Artificial Sequence
  Q8TD46_1-28
MLCPWRTANLGLLLILTIFLVAASSSLC

SEQ ID NO: 124 - protein, 29 aa, Artificial Sequence
  P17301_1-29
MGPERTGAAPLPLLLVLALSQGILNCCLA

SEQ ID NO: 125 - protein, 29 aa, Artificial Sequence
  P12821_1-29
MGAASGRRGPGLLLPLPLLLLLPPQPALA

SEQ ID NO: 126 - protein, 29 aa, Artificial Sequence
  Q14118_1-29
MRMSVGLSLLLPLWGRTFLLLLSVVMAQS

SEQ ID NO: 127 - protein, 29 aa, Artificial Sequence
  P05231_1-29
MNSFSTSAFGPVAFSLGLLLVLPAAFPAP

SEQ ID NO: 128 - protein, 29 aa, Artificial Sequence
  O00602_1-29
MELSGATMARGLAVLLVLFLHIKNLPAQA

SEQ ID NO: 129 - protein, 29 aa, Artificial Sequence
  Q9Y6Q6_1-29
MAPRARRRRPLFALLLLCALLARLQVALQ

SEQ ID NO: 130 - protein, 29 aa, Artificial Sequence
  Q9ULI3_1-29
MASPRASRWPPPLLLLLLPLLLLPPAAPG

SEQ ID NO: 131 - protein, 30 aa, Artificial Sequence
  Q8NBP7_1-30
MGTVSSRRSWWPLPLLLLLLLLLGPAGARA

SEQ ID NO: 132 - protein, 30 aa, Artificial Sequence
  P02675_1-30
MKRMVSWSFHKLKTMKHLLLLLLCVFLVKS

SEQ ID NO: 133 - protein, 30 aa, Artificial Sequence
  P06756_1-30
MAFPPRRRLRLGPRGLPLLLSGLLLPLCRA

SEQ ID NO: 134 - protein, 31 aa, Artificial Sequence
  O60609_1-31
MVRPLNPRPLPPVVLMLLLLLPPSPLPLAAG

SEQ ID NO: 135 - protein, 31 aa, Artificial Sequence
  P50895_1-31
MEPPDAPAQARGAPRLLLLAVLLAAHPDAQA

SEQ ID NO: 136 - protein, 31 aa, Artificial Sequence
  P28906_1-31
MLVRRGARAGPRMPRGWTALCLLSLLPSGFM

SEQ ID NO: 137 - protein, 31 aa, Artificial Sequence
  P08514_1-31
MARALCPLQALWLLEWVLLLLGPCAAPPAWA

SEQ ID NO: 138 - protein, 31 aa, Artificial Sequence
  P00742_1-31
MGRPLHLVLLSASLAGLLLLGESLFIRREQA

SEQ ID NO: 139 - protein, 32 aa, Artificial Sequence
  P26006_1-32
MGPGPSRAPRAPRLMLCALALMVAAGGCVVSA

SEQ ID NO: 140 - protein, 32 aa, Artificial Sequence
  P13726_1-32
METPAWPRVPRPETAVARTLLLGWVFAQVAGA

SEQ ID NO: 141 - protein, 32 aa, Artificial Sequence
  P11912_1-32
MPGGPGVLQALPATIFLLFLLSAVYLGPGCQA

SEQ ID NO: 142 - protein, 32 aa, Artificial Sequence
  Q9H6X2_1-32
MATAERRALGIGFQWLSLATLVLICAGQGGRR

SEQ ID NO: 143 - protein, 33 aa, Artificial Sequence
  Q8IWK6_1-33
MEPPGRRRGRAQPPLLLPLSLLALLALLGGGGG

SEQ ID NO: 144 - protein, 33 aa, Artificial Sequence
  P58335_1-33
MVAERSPARSPGSWLFPGLWLLVLSGPGGLLRA

SEQ ID NO: 145 - protein, 34 aa, Artificial Sequence
  P06731_1-34
MESPSAPPHRWCIPWQRLLLTASLLTFWNPPTTA

SEQ ID NO: 146 - protein, 34 aa, Artificial Sequence
  P33681_1-34
MGHTRRQGTSPSKCPYLNFFQLLVLAGLSHFCSG

SEQ ID NO: 147 - protein, 35 aa, Artificial Sequence
  P38567_1-35
MGVLKFKHIFFRSFVKSSGVSQIVFTFLLIPCCLT

SEQ ID NO: 148 - protein, 35 aa, Artificial Sequence
  P16410_1-35
MACLGFQRHKAQLNLATRTWPCTLLFFLLFIPVFC

SEQ ID NO: 149 - protein, 37 aa, Artificial Sequence
  P15814_1-37
MRPGTGQGGLEAPGEPGPNLRQRWPLLLLGLAVVTHG

SEQ ID NO: 150 - protein, 38 aa, Artificial Sequence
  Q92956_1-38
MEPPGDWGPPPWRSTPKTDVLRLVLYLTFLGAPCYAPA

SEQ ID NO: 151 - protein, 41 aa, Artificial Sequence
  Q86VB7_1-41
MSKLRMVLLEDSGSADFRRHFVNLSPFTITVVLLLSACFVT

SEQ ID NO: 152 - protein, 41 aa, Artificial Sequence
  P08648_1-41
MGSRTPESPLHAVQLRWGPRRRPPLLPLLLLLLPPPPRVGG

SEQ ID NO: 153 - protein, 41 aa, Artificial Sequence
  P16109_1-41
MANCQIAILYQRFQRVVFGISQLLCFSALISELTNQKEVAA

SEQ ID NO: 154 - protein, 44 aa, Artificial Sequence
  O75326_1-44
MTPPPPGRAAPSAPRARVPGPPARLGLPLRLRLLLLLWAAAASA

SEQ ID NO: 155 - protein, 45 aa, Artificial Sequence
  Q8N2Q7_1-45
MALPRCTWPNYVWRAVMACLVHRGLGAPLTLCMLGCLLQAGHVLS

SEQ ID NO: 156 - protein, 46 aa, Artificial Sequence
  Q86UN3_1-46
MLPGLRRLLQAPASACLLLMLLALPLAAPSCPMLCTCYSSPPTVSC

SEQ ID NO: 157 - protein, 179 aa, Artificial Sequence
  A0A5B9
MDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 158 - protein, 154 aa, Artificial Sequence
  B7Z8K6
MSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 159 - protein, 214 aa, Artificial Sequence
  B9A064
MRPKTGQVGCETPEELGPGPRQRWPLLLLGLAMVAHGLLRPMVAPQSGDPDPGASVGSSRSSLRSLWGRLLLQPSPQRADPRCWPRGFWSEPQSLCYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 160 - protein, 839 aa, Artificial Sequence
  O00206
MMSASRLAGTLIPAMAFLSCVRPESWEPCVEVVPNITYQCMELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDYYLDDIIDLFNCLTNVSSFSLVSVTIERVKDFSYNFGWQHLELVNCKFGQFPTLKLKSLKRLTFTSNKGGNAFSEVDLPSLEFLDLSRNGLSFKGCCSQSDFGTTSLKYLDLSFNGVITMSSNFLGLEQLEHLDFQHSNLKQMSEFSVFLSLRNLIYLDISHTHTRVAFNGIFNGLSSLEVLKMAGNSFQENFLPDIFTELRNLTFLDLSQCQLEQLSPTAFNSLSSLQVLNMSHNNFFSLDTFPYKCLNSLQVLDYSLNHIMTSKKQELQHFPSSLAFLNLTQNDFACTCEHQSFLQWIKDQRQLLVEVERMECATPSDKQGMPVLSLNITCQMNKTIIGVSVLSVLVVSVVAVLVYKFYFHLMLLAGCIKYGRGENIYDAFVIYSSQDEDWVRNELVKNLEEGVPPFQLCLHYRDFIPGVAIAANIIHEGFHKSRKVIVVVSQHFIQSRWCIFEYEIAQTWQFLSSRAGIIFIVLQKVEKTLLRQQVELYRLLSRNTYLEWEDSVLGRHIFWRRLRKALLDGKSWNPEGTVGTGCNWQEATSI

SEQ ID NO: 161 - protein, 458 aa, Artificial Sequence
  P01730
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 162 - protein, 178 aa, Artificial Sequence
  P01850
MEDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 163 - protein, 207 aa, Artificial Sequence
  P07766
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 164 - protein, 1304 aa, Artificial Sequence
  P08575
MYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 165 - protein, 254 aa, Artificial Sequence
  P08637
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 166 - protein, 220 aa, Artificial Sequence
  P10747
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 167 - protein, 226 aa, Artificial Sequence
  P11912
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 168 - protein, 556 aa, Artificial Sequence [sequence omitted]

SEQ ID NO: 169 - protein, 223 aa, Artificial Sequence
  P16410
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 170 - protein, 472 aa, Artificial Sequence
  P16671
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 171 - protein, 216 aa, Artificial Sequence
  P26718
MGWIRGRRSRHSWEMSEFHNYNLDLKKSDFSTRWQKQRCPVVKSKCRENASPFFFCCFIAVAMGIRFIIMVAIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 172 - protein, 86 aa, Artificial Sequence
  P30273
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 173 - protein, 378 aa, Artificial Sequence
  P32248
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 174 - protein, 229 aa, Artificial Sequence
  P40259
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 175 - protein, 329 aa, Artificial Sequence
  P42081
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 176 - protein, 336 aa, Artificial Sequence
  Q15762
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 177 - protein, 4493 aa, Artificial Sequence
  Q685J3
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 178 - protein, 404 aa, Artificial Sequence
  Q9NNX6
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 179 - protein, 1041 aa, Artificial Sequence
  Q9NR97
MENMFLQSSMLTCIFLLISGSCELCAEENFSRSYPCDEKKQNDSVIAECSNRRLQEVPQTVGKYVTELDLSDNFITHITNESFQGLQNLTKINLNHNPNVQHQNGNPGIQSNGLNITDGAFLNLKNLRELLLEDNQLPQIPSGLPESLTELSLIQNNIYNITKEGISRLINLKNLYLAWNCYFNKVCEKTNIEDGVFETLTNLELLSLSFNSLSHVPPKLPSSLRKLFLSNTQIKYISEEDFKGLINLTLLDLSGNCPRCFNAPFPCVPCDGGASINIDRFAFQNLTQLRYLNLSSTSLRKINAAWFKNMPHLKVLDLEFNYLVGEIASGAFLTMLPRLEILDLSFNYIKGSYPQHINISRNFSKLLSLRALHLRGYVFQELREDDFQPLMQLPNLSTINLGINFIKQIDFKLFQNFSNLEIIYLSENRISPLVKDTRQSYANSSSFQRHIRKRRSTDFEFDPHSNFYHFTRPLIKPQCAAYGKALDLSLNSIFFIGPNQFENLPDIACLNLSANSNAQVLSGTEFSAIPHVKYLDLTNNRLDFDNASALTELSDLEVLDLSYNSHYFRIAGVTHHLEFIQNFTNLKVLNLSHNNIYTLTDKYNLESKSLVELVFSGNRLDILWNDDDNRYISIFKGLKNLTRLDLSLNRLKHIPNEAFLNLPASLTELHINDNMLKFFNWTLLQQFPRLELLDLRGNKLLFLTDSLSDFTSSLRTLLLSHNRISHLPSGFLSEVSSLKHLDLSSNLLKTINKSALETKTTTKLSMLELHGNPFECTCDIGDFRRWMDEHLNVKIPRLVDVICASPGDQRGKSIVSLELTTCVSDVTAVILFFFTFFITTMVMLAALAHHLFYWDVWFIYNVCLAKVKGYRSLSTSQTFYDAYISYDTKDASVTDWVINELRYHLEESRDKNVLLCLEERDWDPGLAIIDNLMQSINQSKKTVFVLTKKYAKSWNFKTAFYLALQRLMDENMDVIIFILLEPVLQHSQYLRLRQRICKSSILQWPDNPKAEGLFWQTLRNVVLTENDSRYNNMYVDSIKQY

SEQ ID NO: 180 - protein, 22 aa, Artificial Sequence
  P16671_1_8-29
GLIAGAVIGAVLAVFGGILMPV

SEQ ID NO: 181 - protein, 27 aa, Artificial Sequence
  P32248_1_60-86
FLPIMYSIICFVGLLGNGLVVLTYIYF

SEQ ID NO: 182 - protein, 22 aa, Artificial Sequence
  P16671_2_440-461
LLGLIEMILLSVGVVMFVAFMI

SEQ ID NO: 183 - protein, 21 aa, Artificial Sequence
  P32248_2_96-116
YLLNLAVADILFLLTLPFWAY

SEQ ID NO: 184 - protein, 22 aa, Artificial Sequence
  P32248_3_131-152
LIFAIYKMSFFSGMLLLLCISI

SEQ ID NO: 185 - protein, 21 aa, Artificial Sequence
  P32248_4_171-191
VLLISKLSCVGIWILATVLSI

SEQ ID NO: 186 - protein, 28 aa, Artificial Sequence
  P32248_5_220-247
FITIQVAQMVIGFLVPLLAMSFCYLVII

SEQ ID NO: 187 - protein, 26 aa, Artificial Sequence
  P32248_6_264-289
VIIAVVVVFIVFQLPYNGVVLAQTVA

SEQ ID NO: 188 - protein, 18 aa, Artificial Sequence
  P32248_7_314-331
LACVRCCVNPFLYAFIGV

SEQ ID NO: 189 - protein, 23 aa, Artificial Sequence
  A0A5B9_145-167
TILYEILLGKATLYAVLVSALVL

SEQ ID NO: 190 - protein, 23 aa, Artificial Sequence
  B7Z8K6_130-152
LGLRMLFAKTVAVNFLLTAKLFF

SEQ ID NO: 191 - protein, 21 aa, Artificial Sequence
  O00206_632-652
TIIGVSVLSVLVVSVVAVLVY

SEQ ID NO: 192 - protein, 22 aa, Artificial Sequence
  P01730_397-418
MALIVLGGVAGLLLFIGLGIFF

SEQ ID NO: 193 - protein, 21 aa, Artificial Sequence
  P01850_151-171
ILLGKATLYAVLVSALVLMAM

SEQ ID NO: 194 - protein, 26 aa, Artificial Sequence
  P07766_127-152
VMSVATIVIVDICITGGLLLLVYYWS

SEQ ID NO: 195 - protein, 22 aa, Artificial Sequence
  P08575_576-597
ALIAFLAFLIIVTSIALLVVLY

SEQ ID NO: 196 - protein, 21 aa, Artificial Sequence
  P08637_209-229
VSFCLVMVLLFAVDTGLYFSV

SEQ ID NO: 197 - protein, 27 aa, Artificial Sequence
  P10747_153-179
FWVLVVVGGVLACYSLLVTVAFIIFWV

SEQ ID NO: 198 - protein, 22 aa, Artificial Sequence
  P11912_144-165
IITAEGIILLFCAVVPGTLLLF

SEQ ID NO: 199 - protein, 22 aa, Artificial Sequence
  P15391_292-313
VSAVTLAYLIFCLCSLVGILHL

SEQ ID NO: 200 - protein, 21 aa, Artificial Sequence
  P16410_162-182
FLLWILAAVSSGLFFYSFLLT

SEQ ID NO: 201 - protein, 21 aa, Artificial Sequence
  P26718_52-72
PFFFCCFIAVAMGIRFIIMVA

SEQ ID NO: 202 - protein, 21 aa, Artificial Sequence
  P30273_24-44
LCYILDAILFLYGIVLTLLYC

SEQ ID NO: 203 - protein, 21 aa, Artificial Sequence
  P40259_160-180
GIIMIQTLLIILFIIVPIFLL

SEQ ID NO: 204 - protein, 21 aa, Artificial Sequence
  P42081_248-268
WITAVLPTVIICVMVFCLILW

SEQ ID NO: 205 - protein, 21 aa, Artificial Sequence
  Q15762_255-275
GGTVLLLLFVISITTIIVIFL

SEQ ID NO: 206 - protein, 21 aa, Artificial Sequence
  Q685J3_4394-4414
LVGAGVVLMLIILVALLMLVF

SEQ ID NO: 207 - protein, 21 aa, Artificial Sequence
  Q9NNX6_38-58
LGHGPLVLQLLSFTLLAGLLV

SEQ ID NO: 208 - protein, 21 aa, Artificial Sequence
  Q9NR97_828-848
AVILFFFTFFITTMVMLAALA

SEQ ID NO: 209 - RNA, 48 nt, Artificial Sequence
  P14207_1-48
augucacucagugcuuaccagagcgcguugucuacccuguaccgaaga

SEQ ID NO: 210 - RNA, 48 nt, Artificial Sequence
  O75787_1-48
auggcuguguuugucgugcuccuggcguugguggcggguguuuugggg

SEQ ID NO: 211 - RNA, 48 nt, Artificial Sequence
  P07359_1-48
augccucuccuccucuugcugcuccugcugccaagccccuuacacccc

SEQ ID NO: 212 - RNA, 48 nt, Artificial Sequence
  P08637_1-48
auguggcagcugcuccucccaacugcucugcuacuucuaguuucagcu

SEQ ID NO: 213 - RNA, 51 nt, Artificial Sequence
  P07237_1-51
augcugcgccgcgcucugcugugccuggccguggccgcccuggugcgcgcc

SEQ ID NO: 214 - RNA, 51 nt, Artificial Sequence
  O60911_1-51
augaaucuuucgcucguccuggcugccuuuugcuugggaauagccuccgcu

SEQ ID NO: 215 - RNA, 51 nt, Artificial Sequence
  P20138_1-51
augccgcugcugcuacugcugccccugcugugggcaggggcccuggcuaug

SEQ ID NO: 216 - RNA, 51 nt, Artificial Sequence
  P27797_1-51
augcugcuauccgugccgcugcugcucggccuccucggccuggccgucgcc

SEQ ID NO: 217 - RNA, 54 nt, Artificial Sequence
  P10747_1-54
augcucaggcugcucuuggcucucaacuuauucccuucaauucaaguaacagga

SEQ ID NO: 218 - RNA, 54 nt, Artificial Sequence
  O75487_1-54
auggcacgguucggcuugcccgcgcuucucugcacccuggcagugcucagcgcc

SEQ ID NO: 219 - RNA, 54 nt, Artificial Sequence
  P07996_1-54
auggggcuggccuggggacuaggcguccuguuccugaugcauguguguggcacc

SEQ ID NO: 220 - RNA, 54 nt, Artificial Sequence
  P22748_1-54
augcggaugcugcuggcgcuccuggcccucuccgcggcgcggccaucggccagu

SEQ ID NO: 221 - RNA, 54 nt, Artificial Sequence
  Q15762_1-54
auggauuauccuacuuuacuuuuggcucuucuucauguauacagagcucuaugu

SEQ ID NO: 222 - RNA, 54 nt, Artificial Sequence
  P30273_1-54
augauuccagcaguggucuugcucuuacuccuuuugguugaacaagcagcggcc

SEQ ID NO: 223 - RNA, 54 nt, Artificial Sequence
  P38570_1-54
auguggcucuuccacacucugcucugcauagccagccuggcccugcuggccgcu

SEQ ID NO: 224 - RNA, 54 nt, Artificial Sequence
  Q01638_1-54
augggguuuuggaucuuagcaauucucacaauucucauguauuccacagcagca

SEQ ID NO: 225 - RNA, 54 nt, Artificial Sequence
  Q9NZQ7_1-54
augaggauauuugcugucuuuauauucaugaccuacuggcauuugcugaacgca

SEQ ID NO: 226 - RNA, 57 nt, Artificial Sequence
  P13591_1-57
augcugcaaacuaaggaucucaucuggacuuuguuuuuccugggaacugcaguuucu

SEQ ID NO: 227 - RNA, 57 nt, Artificial Sequence
  P26842_1-57
auggcacggccacaucccugguggcugugcguucuggggacccugguggggcucuca

SEQ ID NO: 228 - RNA, 57 nt, Artificial Sequence
  P15391_1-57
augccaccuccucgccuccucuucuuccuccucuuccucacccccauggaagucagg

SEQ ID NO: 229 - RNA, 57 nt, Artificial Sequence
  Q8NI17_1-57
augugcaucaggcaacucaaguuuuucaccacggcaugugucugugaauguccgcaa

SEQ ID NO: 230 - RNA, 57 nt, Artificial Sequence
  P08571_1-57
auggagcgcgcguccugcuuguugcugcugcugcugccgcuggugcacgucucugcg

SEQ ID NO: 231 - RNA, 57 nt, Artificial Sequence
  P05154_1-57
augcagcucuuccuccucuugugccuggugcuucucagcccucagggggccucccuu

SEQ ID NO: 232 - RNA, 57 nt, Artificial Sequence
  P02787_1-57
augaggcucgccgugggagcccugcuggucugcgccguccuggggcugugucuggcu

SEQ ID NO: 233 - RNA, 57 nt, Artificial Sequence
  P02671_1-57
auguuuuccaugaggaucgucugccugguccuaaguguggugggcacagcauggacu

SEQ ID NO: 234 - RNA, 57 nt, Artificial Sequence
  P04216_1-57
augaaccuggccaucagcaucgcucuccugcuaacagucuugcaggucucccgaggg

SEQ ID NO: 235 - RNA, 57 nt, Artificial Sequence
  P00747_1-57
auggaacauaaggaagugguucuucuacuucuuuuauuucugaaaucaggucaagga

SEQ ID NO: 236 - RNA, 57 nt, Artificial Sequence
  P01764_1-57
auggaguuugggcugagcuggcuuuuucuuguggcuauuuuaaaagguaauucaugg

SEQ ID NO: 237 - RNA, 57 nt, Artificial Sequence
  P16150_1-57
auggccacgcuucuccuucuccuuggggugcuggugguaagcccagacgcucugggg

SEQ ID NO: 238 - RNA, 57 nt, Artificial Sequence
  Q6DN72_1-57
augcugcucuggacggcugugcugcucuuuguucccuguguugggaaaacugucugg

SEQ ID NO: 239 - RNA, 57 nt, Artificial Sequence
  Q01151_1-57
augucgcgcggccuccagcuucugcuccugagcugcgccuacagccuggcucccgcg

SEQ ID NO: 240 - RNA, 57 nt, Artificial Sequence
  P07093_1-57
augaacuggcaucucccccucuuccucuuggccucugugacgcugccuuccaucugc

SEQ ID NO: 241 - RNA, 57 nt, Artificial Sequence
  Q8WWQ8_1-57
augaugcuacaacauuuaguaauuuuuugucuuggauugguuguacaaaauuucugc

SEQ ID NO: 242 - RNA, 60 nt, Artificial Sequence
  Q13291_1-60
auggaucccaaggggcuccucuccuugaccuucgugcuguuucucucccuggcuuuuggg

SEQ ID NO: 243 - RNA, 60 nt, Artificial Sequence
  P35225_1-60
augcauccgcuccucaauccucuccuguuggcacugggccucauggcgcuuuuguugacc

SEQ ID NO: 244 - RNA, 60 nt, Artificial Sequence
  P25942_1-60
augguucgucugccucugcagugcguccucuggggcugcuugcugaccgcuguccaucca

SEQ ID NO: 245 - RNA, 60 nt, Artificial Sequence
  P52803_1-60
auguugcacguggagauguugacgcugguguuucuggugcucuggauguguguguucagc

SEQ ID NO: 246 - RNA, 60 nt, Artificial Sequence
  Q15116_1-60
augcagaucccacaggcgcccuggccagucgucugggcggugcuacaacugggcuggcgg

SEQ ID NO: 247 - RNA, 60 nt, Artificial Sequence
  P05556_1-60
augaauuuacaaccaauuuucuggauuggacugaucaguucaguuugcuguguguuugcu

SEQ ID NO: 248 - RNA, 60 nt, Artificial Sequence
  Q12891_1-60
augcgggcaggcccaggccccaccguuacauuggcccuggugcuggcggugucaugggcc

SEQ ID NO: 249 - RNA, 60 nt, Artificial Sequence
  Q8IV16_1-60
augaaggcgcucggggcuguccugcuugcccucuugcuguucgggcggccagggagaggg

SEQ ID NO: 250 - RNA, 60 nt, Artificial Sequence
  Q03167_1-60
augacuucccauuaugugauugccaucuuugcccugaugagcuccuguuuagccacugca

SEQ ID NO: 251 - RNA, 60 nt, Artificial Sequence
  Q14246_1-60
augcguggcuucaaccugcuccucuucuggggauguuguguuaugcacagcugggaaggg

SEQ ID NO: 252 - RNA, 60 nt, Artificial Sequence
  P16871_1-60
augacaauucuagguacaacuuuuggcaugguuuuuucuuuacuucaagucguuucugga

SEQ ID NO: 253 - RNA, 60 nt, Artificial Sequence
  P61769_1-60
augucucgcuccguggccuuagcugugcucgcgcuacucucucuuucuggccuggaggcu

SEQ ID NO: 254 - RNA, 60 nt, Artificial Sequence
  Q9Y6W8_1-60
augaagucaggccucugguauuucuuucucuucugcuugcgcauuaaaguuuuaacagga

SEQ ID NO: 255 - RNA, 63 nt, Artificial Sequence
  P10966_1-63
augcggccgcggcuguggcuccucuuggccgcgcagcugacaguucuccauggcaacucaguc

SEQ ID NO: 256 - RNA, 63 nt, Artificial Sequence
  Q9BZW8_1-63
augcuggggcaaguggucacccucauacuccuccugcuccucaagguguaucagggcaaagga

SEQ ID NO: 257 - RNA, 63 nt, Artificial Sequence
  P02778_1-63
augaaucaaacugccauucugauuugcugccuuaucuuucugacucuaaguggcauucaagga

SEQ ID NO: 258 - RNA, 63 nt, Artificial Sequence
  P18564_1-63
auggggauugaacugcuuugccuguucuuucuauuucuaggaaggaaugaucacguacaaggu

SEQ ID NO: 259 - RNA, 63 nt, Artificial Sequence
  O14525_1-63
auggcuuuagccgggcucugcgcccugcucgccugcugcugggggccggcggcggugcuggcc

SEQ ID NO: 260 - RNA, 63 nt, Artificial Sequence
  P01130_1-63
auggggcccuggggcuggaaauugcgcuggaccgucgccuugcuccucgccgcggcggggacu

SEQ ID NO: 261 - RNA, 63 nt, Artificial Sequence
  P01732_1-63
auggccuuaccagugaccgccuugcuccugccgcuggccuugcugcuccacgccgccaggccg

SEQ ID NO: 262 - RNA, 63 nt, Artificial Sequence
  P48061_1-63
augaacgccaaggucguggucgugcugguccucgugcugaccgcgcucugccucagcgacggg

SEQ ID NO: 263 - RNA, 63 nt, Artificial Sequence
  P01589_1-63
auggauucauaccugcugauguggggacugcucacguucaucauggugccuggcugccaggca

SEQ ID NO: 264 - RNA, 63 nt, Artificial Sequence
  Q86T13_1-63
augaggccggcguucgcccugugccuccucuggcaggcgcucuggcccgggccgggcggcggc

SEQ ID NO: 265 - RNA, 63 nt, Artificial Sequence
  Q5DID0_1-63
augcucaggaccucggggcuggcacugcuggcucuggucagugcugugggcccaagccaggcc

SEQ ID NO: 266 - RNA, 66 nt, Artificial Sequence
  P40189_1-66
augcucaggaccucggggcuggcacugcuggcucuggucagugcugugggcccaagccaggccagc

SEQ ID NO: 267 - RNA, 66 nt, Artificial Sequence
  Q86YL7_1-66
auguugacguugcagacuuggcuagugcaagccuuguuuauuuuccucaccacugaaucuacaggu

SEQ ID NO: 268 - RNA, 66 nt, Artificial Sequence
  P55075_1-66
augggcagcccccgcuccgcgcugagcugccugcuguugcacuugcugguccucugccuccaagcc

SEQ ID NO: 269 - RNA, 66 nt, Artificial Sequence
  Q30201_1-66
augggcccgcgagccaggccggcgcuucuccuccugaugcuuuugcagaccgcgguccugcagggg

SEQ ID NO: 270 - RNA, 66 nt, Artificial Sequence
  P07766_1-66
augcagucgggcacucacuggagaguucugggccucugccucuuaucaguuggcguuugggggcaa

SEQ ID NO: 271 - RNA, 66 nt, Artificial Sequence
  P18827_1-66
augaggcgcgcggcgcucuggcucuggcugugcgcgcuggcgcugagccugcagccggcccugccg

SEQ ID NO: 272 - RNA, 66 nt, Artificial Sequence
  P55290_1-66
augcagccgagaacuccgcucguucugugcguucuccugucccaggugcugcugcuaacaucugca

SEQ ID NO: 273 - RNA, 66 nt, Artificial Sequence
  P37173_1-66
augggucgggggcugcucaggggccuguggccgcugcacaucguccuguggacgcguaucgccagc

SEQ ID NO: 274 - RNA, 66 nt, Artificial Sequence
  Q07325_1-66
augaagaaaagugguguucuuuuccucuugggcaucaucuugcugguucugauuggagugcaagga

SEQ ID NO: 275 - RNA, 66 nt, Artificial Sequence
  P04156_1-66
auggcgaaccuuggcugcuggaugcugguucucuuuguggccacauggagugaccugggccucugc

SEQ ID NO: 276 - RNA, 66 nt, Artificial Sequence
  P31785_1-66
auguugaagccaucauuaccauucacaucccucuuauuccugcagcugccccugcugggagugggg

SEQ ID NO: 277 - RNA, 69 nt, Artificial Sequence
  P01579_1-69
augaaauauacaaguuauaucuuggcuuuucagcucugcaucguuuuggguucucuuggcuguuacugc

SEQ ID NO: 278 - RNA, 69 nt, Artificial Sequence
  P23229_1-69
auggccgccgccgggcagcugugcuugcucuaccugucggcggggcuccugucccggcucggcgcagcc

SEQ ID NO: 279 - RNA, 69 nt, Artificial Sequence
  O60494_1-69
augaugaacaugucuuuaccuuuucuuuggaguuugcuuaccuuauuaauauuugcugaaguaaauggc

SEQ ID NO: 280 - RNA, 69 nt, Artificial Sequence
  P08575_1-69
augaccauguauuuguggcuuaaacucuuggcauuuggcuuugccuuucuggacacagaaguauuugug

SEQ ID NO: 281 - RNA, 69 nt, Artificial Sequence
  Q8IWY4_1-69
augggcgcggcggccgugcgcuggcacuugugcgugcugcuggcccugggcacacgcgggcggcuggcc

SEQ ID NO: 282 - RNA, 69 nt, Artificial Sequence
  Q08431_1-69
augccgcgcccccgccugcuggccgcgcugugcggcgcgcugcucugcgcccccagccuccucgucgcc

SEQ ID NO: 283 - RNA, 69 nt, Artificial Sequence
  Q99665_1-69
auggcacauacuuuuagaggaugcucauuggcauuuauguuuauaaucacguggcuguugauuaaagca

SEQ ID NO: 284 - RNA, 69 nt, Artificial Sequence
  Q6Q8B3_1-69
augucagcuccaagauuacugauuuccaucauuaucauggugucugcuucaaguaguucaugcaugggu

SEQ ID NO: 285 - RNA, 69 nt, Artificial Sequence
  Q07011_1-69
augggaaacagcuguuacaacauaguagccacucuguugcugguccucaacuuugagaggacaagauca

SEQ ID NO: 286 - RNA, 69 nt, Artificial Sequence
  Q8NHL6_1-69
augacccccauccucacgguccugaucugucucgggcugagucugggcccccggacccacgugcaggca

SEQ ID NO: 287 - RNA, 69 nt, Artificial Sequence
  P36894_1-69
augccucagcuauacauuuacaucagauuauugggagccuauuuguucaucauuucucguguucaagga

SEQ ID NO: 288 - RNA, 69 nt, Artificial Sequence
  Q16552_1-69
augacuccugggaagaccucauuggugucacugcuacugcugcugagccuggaggccauagugaaggca

SEQ ID NO: 289 - RNA, 69 nt, Artificial Sequence
  P42081_1-69
auggauccccagugcacuaugggacugaguaacauucucuuugugauggccuuccugcucucuggugcu

SEQ ID NO: 290 - RNA, 69 nt, Artificial Sequence
  P43121_1-69
auggggcuucccaggcuggucugcgccuucuugcucgccgccugcugcugcuguccucgcgucgcgggu

SEQ ID NO: 291 - RNA, 69 nt, Artificial Sequence
  O00206_1-69
augaugucugccucgcgccuggcugggacucugaucccagccauggccuuccucuccugcgugagacca

SEQ ID NO: 292 - RNA, 69 nt, Artificial Sequence
  P42701_1-69
auggagccgcuggugaccuggguggucccccuccucuuccucuuccugcuguccaggcagggcgcugcc

SEQ ID NO: 293 - RNA, 72 nt, Artificial Sequence
  P06729_1-69
augagcuuuccauguaaauuuguagccagcuuccuucugauuuucaauguuucuuccaaaggugcagucucc

SEQ ID NO: 294 - RNA, 72 nt, Artificial Sequence
  P15328_1-69
auggcucagcggaugacaacacagcugcugcuccuucuaguguggguggcuguaguaggggaggcucagaca

SEQ ID NO: 295 - RNA, 72 nt, Artificial Sequence
  P05112_1-69
augggucucaccucccaacugcuucccccucuguucuuccugcuagcaugugccggcaacuuuguccacgga

SEQ ID NO: 296 - RNA, 72 nt, Artificial Sequence
  P06127_1-69
augcccauggggucucugcaaccgcuggccaccuuguaccugcuggggaugcuggucgcuuccugccucgga

SEQ ID NO: 297 - RNA, 72 nt, Artificial Sequence
  P32248_1-69
auggaccuggggaaaccaaugaaaagcgugcuggugguggcucuccuugucauuuuccagguaugccugugu

SEQ ID NO: 298 - RNA, 72 nt, Artificial Sequence
  Q7Z7D3_1-69
auguucagaggccggacagcaguguuugcugaucaagugauaguuggcaaugccucuuugcggcugaaaaac

SEQ ID NO: 299 - RNA, 72 nt, Artificial Sequence
  P54756_1-69
augcggggcucggggccccggggugcgggacgccggcggcccccaagcggcggcggcgacacccccaucacc

SEQ ID NO: 300 - RNA, 72 nt, Artificial Sequence
  Q92823_1-69
augcagcuuaaaauaaugccgaaaaagaagcgcuuaucugcgggcagagugccccugauucucuuccugugc

SEQ ID NO: 301 - RNA, 72 nt, Artificial Sequence
  P19320_1-69
augccugggaagauggucgugauccuuggagccucaaauauacuuuggauaauguuugcagcuucucaagcu

SEQ ID NO: 302 - RNA, 72 nt, Artificial Sequence
  Q86UN2_1-69
augcuucgcaaagggugcuguguggaguugcugcugcuguugguagcugcggagcugccccugggugguggc

SEQ ID NO: 303 - RNA, 75 nt, Artificial Sequence
  P33151_1-75
augcagaggcucaugaugcuccucgccacaucgggcgccugccugggccugcuggcaguggcagcaguggcagca

SEQ ID NO: 304 - RNA, 75 nt, Artificial Sequence
  P17813_1-75
auggaccgcggcacgcucccucuggcuguugcccugcugcuggccagcugcagccucagccccacaagucuugca

SEQ ID NO: 305 - RNA, 75 nt, Artificial Sequence
  P25445_1-75
augcugggcaucuggacccuccuaccucugguucuuacgucuguugcuagauuaucguccaaaaguguuaaugcc

SEQ ID NO: 306 - RNA, 75 nt, Artificial Sequence
  P01730_1-75
augaaccggggagucccuuuuaggcacuugcuucuggugcugcaacuggcgcuccucccagcagccacucaggga

SEQ ID NO: 307 - RNA, 75 nt, Artificial Sequence
  Q685J3_1-75
augccaaggccagggaccauggcgcugugucugcugaccuugguccucucgcucuugcccccacaagcugcugca

SEQ ID NO: 308 - RNA, 75 nt, Artificial Sequence
  P17787_1-75
auggcccggcgcugcggccccguggcgcugcuccuuggcuucggccuccuccggcugugcucagggguguggggu

SEQ ID NO: 309 - RNA, 75 nt, Artificial Sequence
  Q6UQ28_1-75
auggcagucuuccaugacaugcugcugcagccacuggggauguuucugugccucagucugcagcuuucuucugcc

SEQ ID NO: 310 - RNA, 75 nt, Artificial Sequence
  P13987_1-75
augggaauccaaggagggucuguccuguucgggcugcugcucguccuggcugucuucugccauucaggucauagc

SEQ ID NO: 311 - RNA, 75 nt, Artificial Sequence
  P10721_1-75
augagaggcgcucgcggcgccugggauuuucucugcguucugcuccuacugcuucgcguccagacaggcucuucu

SEQ ID NO: 312 - RNA, 75 nt, Artificial Sequence
  P12319_1-75
auggcuccugccauggaauccccuacucuacuguguguagccuuacuguucuucgcuccagauggcguguuagca

SEQ ID NO: 313 - RNA, 78 nt, Artificial Sequence
  Q9BZR6_1-78
augaagagggcguccgcuggagggagccggcugcuggcaugggugcuguggcugcaggccuggcagguggcagcccca

SEQ ID NO: 314 - RNA, 78 nt, Artificial Sequence
  P25063_1-78
augggcagagcaaugguggccaggcucgggcuggggcugcugcugcuggcacugcuccuacccacgcagauuuauucc

SEQ ID NO: 315 - RNA, 78 nt, Artificial Sequence
  Q9NR97_1-78
augaaggagucaucuuugcaaaauagcuccugcagccugggaaaggagacuaaaaaggaaaacauguuccuucagucg

SEQ ID NO: 316 - RNA, 78 nt, Artificial Sequence
  Q8N131_1-78
augggacucggcgcgcgaggugcuugggccgcgcugcuccuggggacgcugcaggugcuagcgcugcugggggccgcc

SEQ ID NO: 317 - RNA, 78 nt, Artificial Sequence
  P49771_1-78
augacagugcuggcgccagccuggagcccaacaaccuaucuccuccugcugcugcugcugagcucgggacucaguggg

SEQ ID NO: 318 - RNA, 78 nt, Artificial Sequence
  P02679_1-78
augaguugguccuugcacccccggaauuuaauucucuacuucuaugcucuuuuauuucucucuucaacauguguagca

SEQ ID NO: 319 - RNA, 78 nt, Artificial Sequence
  P14784_1-78
auggcggccccugcucuguccuggcgucugccccuccucauccuccuccugccccuggcuaccucuugggcaucugca

SEQ ID NO: 320 - RNA, 81 nt, Artificial Sequence
  P05362_1-81
auggcucccagcagcccccggcccgcgcugcccgcacuccugguccugcucggggcucuguucccaggaccuggcaaugcc

SEQ ID NO: 321 - RNA, 81 nt, Artificial Sequence
  Q13740_1-81
auggaauccaagggggccaguuccugccgucugcucuucugccucuugaucuccgccaccgucuucaggccaggccuugga

SEQ ID NO: 322 - RNA, 84 nt, Artificial Sequence
  Q13443_1-84
auggggucuggcgcgcgcuuucccucggggacccuucguguccggugguugcuguugcuuggccuggugggcccaguccucggu

SEQ ID NO: 323 - RNA, 84 nt, Artificial Sequence
  P14151_1-84
augggcugcagaagaacuagagaaggaccaagcaaagccaugauauuuccauggaaaugucagagcacccagagggacuuaugg

SEQ ID NO: 324 - RNA, 84 nt, Artificial Sequence
  P56199_1-84
auggccccucggccccgcgcccgcccaggggucgcugucgccugcugcuggcuccucacuguuguucuacgcugcugcguauca

SEQ ID NO: 325 - RNA, 84 nt, Artificial Sequence
  P11279_1-84
auggcggcccccggcagcgcccggcgaccccugcugcugcuacugcuguugcugcugcucggccucaugcauugugcgucagca

SEQ ID NO: 326 - RNA, 84 nt, Artificial Sequence
  P40259_1-84
auggccaggcuggcguugucuccugugcccagccacuggaugguggcguugcugcugcugcucucagcagcugagccaguacca

SEQ ID NO: 327 - RNA, 84 nt, Artificial Sequence
  P43681_1-84
auggagcuagggggccccggagcgccgcggcugcugccgccgcugcugcugcuucuggggaccggccuccugcgcgccagcagc

SEQ ID NO: 328 - RNA, 84 nt, Artificial Sequence
  P18627_1-84
augugggaggcucaguuccugggcuugcuguuucugcagccgcuuuggguggcuccagugaagccucuccagccaggggcugag

SEQ ID NO: 329 - RNA, 84 nt, Artificial Sequence
  Q5ZPR3_1-84
augcugcgucggcggggcagcccuggcaugggugugcaugugggugcagcccugggagcacugugguucugccucacaggagcc

SEQ ID NO: 330 - RNA, 84 nt, Artificial Sequence
  P23415_1-84
auguacagcuucaauacucuucgacucuaccuuugggagaccauuguauucuucagccuugcugcuucuaaggaggcugaagcu

SEQ ID NO: 331 - RNA, 84 nt, Artificial Sequence
  Q8TD46_1-84
augcucugcccuuggagaacugcuaaccuagggcuacuguugauuuugacuaucuucuuaguggccgaagcggagggugcugcu

SEQ ID NO: 332 - RNA, 87 nt, Artificial Sequence
  P17301_1-87
auggggccagaacggacaggggccgcgccgcugccgcugcugcugguguuagcgcucagucaaggcauuuuaaauuguuguuuggcc

SEQ ID NO: 333 - RNA, 87 nt, Artificial Sequence
  P12821_1-87
augggccaggguugggcuacugcaggacuucccagccuccucuuccugcugcucugcuacgggcacccucugcugguccccagccag

SEQ ID NO: 334 - RNA, 87 nt, Artificial Sequence
  Q14118_1-87
augaggaugucugugggccucucgcugcugcugccccucucggggaggaccuuucuccuccugcucucugugguuauggcucagucc

SEQ ID NO: 335 - RNA, 87 nt, Artificial Sequence
  P05231_1-87
augaacuccuucuccacaagcgccuucgguccaguugccuucucccuggggcugcuccugguguugccugcugccuucccugcccca

SEQ ID NO: 336 - RNA, 87 nt, Artificial Sequence
  O00602_1-87
auggagcugaguggagccaccauggcccgggggcucgcuguccugcuagucuuguuccugcauaucaagaaccugccugcccaggcu

SEQ ID NO: 337 - RNA, 87 nt, Artificial Sequence
  Q9Y6Q6_1-87
auggccccgcgcgcccggcggcgccgcccgcuguucgcgcugcugcugcucugcgcgcugcucgcccggcugcagguggcuuugcag

SEQ ID NO: 338 - RNA, 87 nt, Artificial Sequence
  Q9ULI3_1-87
auggccucgccgcgcgccucgcgguggccgccgccgcuccugcugcuguugcugccgcugcugcugcugccgccggcggcccccggg

SEQ ID NO: 339 - RNA, 90 nt, Artificial Sequence
  Q8NBP7_1-90
augggcaccgucagcuccaggcgguccugguggccgcugccacugcugcugcugcugcugcugcuccugggucccgcgggcgcccgugcg

SEQ ID NO: 340 - RNA, 90 nt, Artificial Sequence
  P02675_1-90
augaaaaggaugguuucuuggagcuuccacaaacuuaaaaccaugaaacaucuauuauugcuacuauuguguguuuuucuaguuaagucc

SEQ ID NO: 341 - RNA, 90 nt, Artificial Sequence
  P06756_1-90
auggcuuuuccgccgcggcgacggcugcgccucgguccccgcggccucccgcuucuucucucgggacuccugcuaccucugugccgcgcc

SEQ ID NO: 342 - RNA, 93 nt, Artificial Sequence
  O60609_1-93
auggugcgcccccugaacccgcgaccgcugccgcccguaguccugauguugcugcugcugcugccgccgucgccgcugccucucgcagccgga

SEQ ID NO: 343 - RNA, 93 nt, Artificial Sequence
  P50895_1-93
auggagcccccggacgcaccggcccaggcgcgcggggccccgcggcugcuguugcucgcaguccugcuggcggcgcacccagaugcccaggcg

SEQ ID NO: 344 - RNA, 93 nt, Artificial Sequence
  P28906_1-93
augcugguccgcaggggcgcgcgcgcagggcccaggaugccgcggggcuggaccgcgcuuugcuugcugaguuugcugccuucuggguucaug

SEQ ID NO: 345 - RNA, 93 nt, Artificial Sequence
  P08514_1-93
auggccagagcuuuguguccacugcaagcccucuggcuucuggagugggugcugcugcucuugggaccuugugcugccccuccagccugggcc

SEQ ID NO: 346 - RNA, 93 nt, Artificial Sequence
  P00742_1-93
auggggcgcccacugcaccucguccugcucagugccucccuggcuggccuccugcugcucggggaaagucuguucauccgcagggagcaggcc

SEQ ID NO: 347 - RNA, 96 nt, Artificial Sequence
  P26006_1-96
augggccccggccccagccgcgcgccccgcgccccacgccugaugcucugugcgcucgccuugaugguggcggccggcggcugcgucgucuccgcc

SEQ ID NO: 348 - RNA, 96 nt, Artificial Sequence
  P13726_1-96
auggagaccccugccuggccccgggucccgcgccccgagaccgccgucgcucggacgcuccugcucggcugggucuucgcccagguggccggcgcu

SEQ ID NO: 349 - RNA, 96 nt, Artificial Sequence
  P11912_1-96
augccuggggguccaggaguccuccaagcucugccugccaccaucuuccuccucuuccugcugucugcugucuaccugggcccugggugccaggcc

SEQ ID NO: 350 - RNA, 96 nt, Artificial Sequence
  Q9H6X2_1-96
auggccacggcggagcggagagcccucggcaucggcuuccaguggcucucuuuggccacucuggugcucaucugcgccgggcaagggggacgcagg

SEQ ID NO: 351 - RNA, 99 nt, Artificial Sequence
  Q8IWK6_1-99
auggagccacccggacgccggcggggccgcgcgcagccgccgcuguugcugccgcucucgcuguuagcgcugcucgcgcugcugggaggcggcggcggc

SEQ ID NO: 352 - RNA, 99 nt, Artificial Sequence
  P58335_1-99
augguggcggagcgguccccggcccgcagccccgggagcuggcuguuccccgggcuguggcuguuggugcucagcggucccggggggcugcugcgcgcc

SEQ ID NO: 353 - RNA, 102 nt, Artificial Sequence
  P06731_1-102
auggagucucccucggccccuccccacagauggugcauccccuggcagaggcuccugcucacagccucacuucuaaccuucuggaacccgcccaccacugcc

SEQ ID NO: 354 - RNA, 102 nt, Artificial Sequence
  P33681_1-102
augggccacacacggaggcagggaacaucaccauccaaguguccauaccucaauuucuuucagcucuuggugcuggcuggucuuucucacuucuguucaggu

SEQ ID NO: 355 - RNA, 105 nt, Artificial Sequence
  P38567_1-105
augggagugcuaaaauucaagcacaucuuuuucagaagcuuuguuaaaucaaguggaguaucccagauaguuuucaccuuccuucugauuccauguugcuugacu

SEQ ID NO: 356 - RNA, 105 nt, Artificial Sequence
  P16410_1-105
auggcuugccuuggauuucagcggcacaaggcucagcugaaccuggcuaccaggaccuggcccugcacucuccuguuuuuucuucucuucaucccugucuucugc

SEQ ID NO: 357 - RNA, 111 nt, Artificial Sequence
  P15814_1-111
augaggccagggacaggccaggggggccuugaggccccuggugagccaggccccaaccucaggcagcgcuggccccugcugcugcugggucuggccgugguaacccauggc

SEQ ID NO: 358 - RNA, 114 nt, Artificial Sequence
  Q92956_1-114
auggagccuccuggagacugggggccuccucccuggagauccacccccaaaaccgacgucuugaggcuggugcuguaucucaccuuccugggagcccccugcuacgccccagcu

SEQ ID NO: 359 - RNA, 123 nt, Artificial Sequence
  Q86VB7_1-123
augagcaaacucagaauggugcuacuugaagacucuggaucugcugacuucagaagacauuuugucaacuugagucccuucaccauuacuguggucuuacuucucagugccuguuuugucacc

SEQ ID NO: 360 - RNA, 123 nt, Artificial Sequence
  P08648_1-123
auggggagccggacgccagaguccccucuccacgccgugcagcugcgcuggggcccccggcgccgacccccgcugcugccgcugcuguugcugcugcugccgccgccacccagggucgggggc

SEQ ID NO: 361 - RNA, 123 nt, Artificial Sequence
  P16109_1-123
auggccaacugccaaauagccaucuuguaccagagauuccagagaguggucuuuggaauuucccaacuccuuugcuucagugcccugaucucugaacuaacaaaccagaaagaaguggcagca

SEQ ID NO: 362 - RNA, 132 nt, Artificial Sequence
  O75326_1-132
augacgccuccuccgcccggacgugccgcccccagcgcaccgcgcgcccgcgucccuggcccgccggcucgguuggggcuuccgcugcggcugcggcugcugcugcugcucugggcggccgccgccuccgcc

SEQ ID NO: 363 - RNA, 135 nt, Artificial Sequence
  Q8N2Q7_1-135
auggcacugcccagaugcacguggccaaauuauguuuggagagcagugauggcaugcuugguacaccggggauugggugccccauugacucucuguauguugggauguuugcuucaggcuggccaugugcuauca

SEQ ID NO: 364 - RNA, 138 nt, Artificial Sequence
  Q86UN3_1-138
augcugcccgggcucaggcgccugcugcaagcucccgccucggccugccuccugcugaugcuccuggcccugccccuggcggcccccagcugccccaugcucugcaccugcuacucauccccgcccaccgugagcugc

SEQ ID NO: 365 - RNA, 540 nt, Artificial Sequence
  A0A5B9
auggaccugaaaaacguguucccacccgaggucgcuguguuugagccaucagaagcagagaucucccacacccaaaaggccacacuggugugccuggccacaggcuucuaccccgaccacguggagcugagcuggugggugaaugggaaggaggugcacaguggggucagcacagacccgcagccccucaaggagcagcccgcccucaaugacuccagauacugccugagcagccgccugagggucucggccaccuucuggcagaacccccgcaaccacuuccgcugucaaguccaguucuacgggcucucggagaaugacgaguggacccaggauagggccaaaccugucacccagaucgucagcgccgaggccugggguagagcagacuguggcuucaccuccgagucuuaccagcaagggguccugucugccaccauccucuaugagaucuugcuagggaaggccaccuuguaugccgugcuggucagugcccucgugcugauggccauggucaagagaaaggauuccagaggcuag

SEQ ID NO: 366 - RNA, 465 nt, Artificial Sequence
  B7Z8K6
augagucagccucauaccaaaccauccguuuuugucaugaaaaauggaacaaaugucgcuugucuggugaaggaauucuaccccaaggauauaagaauaaaucucgugucauccaagaagauaacagaguuugauccugcuauugucaucucucccagcgggaaguacaaugcugucaagcuugguaaauaugaagauucaaauucagugacauguucaguucaacacgacaauaaaacugugcacuccacugacuuugaagugaagacagauucuacagaucacguaaaaccaaaggaaacugaaaacacaaagcaaccuucaaagagcugccauaaacccaaagccauaguucauaccgagaaggugaacaugaugucccucacagugcuugggcuacgaaugcuguuugcaaagacuguugccgucaauuuucucuugacugccaaguuauuuuucuuguaa

SEQ ID NO: 367 - RNA, 645 nt, Artificial Sequence
  B9A064
augagacccaagacaggccaaguggguugugagaccccugaggagcugggcccuggucccaggcagcgcuggccccugcugcugcugggucuggccauggucgcccauggccugcugcgcccaaugguugcaccgcaaagcggggacccagacccuggagccucaguuggaagcagccgauccagccugcggagccuguggggcaggcuccugcuccagcccagcccccagagagcagaccccaggugcuggccccggggguuuuggucugagccucagucacuguguuaugucuucggaacugggaccaaggucaccguccuaggucagcccaaggccaaccccacugucacucuguucccgcccuccucugaggagcuccaagccaacaaggccacacuagugugucugaucagugacuucuacccgggagcugugacaguggccuggaaggcagauggcagccccgucaaggcgggaguggagaccaccaaacccuccaaacagagcaacaacaaguacgcggccagcagcuaccugagccugacgcccgagcaguggaagucccacagaagcuacagcugccaggucacgcaugaagggagcaccguggagaagacaguggccccuacagaauguucauag

SEQ ID NO: 368 - RNA, 2520 nt, Artificial Sequence
  O00206
augaugucugccucgcgccuggcugggacucugaucccagccauggccuuccucuccugcgugagaccagaaagcugggagcccugcguggaggugguuccuaauauuacuuaucaaugcauggagcugaauuucuacaaaauccccgacaaccuccccuucucaaccaagaaccuggaccugagcuuuaauccccugaggcauuuaggcagcuauagcuucuucaguuucccagaacugcaggugcuggauuuauccaggugugaaauccagacaauugaagauggggcauaucagagccuaagccaccucucuaccuuaauauugacaggaaaccccauccagaguuuagcccugggagccuuuucuggacuaucaaguuuacagaagcugguggcuguggagacaaaucuagcaucucuagagaacuuccccauuggacaucucaaaacuuugaaagaacuuaauguggcucacaaucuuauccaaucuuucaaauuaccugaguauuuuucuaaucugaccaaucuagagcacuuggaccuuuccagcaacaagauucaaaguauuuauugcacagacuugcggguucuacaucaaaugccccuacucaaucucucuuuagaccugucccugaacccuaugaacuuuauccaaccaggugcauuuaaagaaauuaggcuucauaagcugacuuuaagaaauaauuuugauaguuuaaauguaaugaaaacuuguauucaaggucuggcugguuuagaaguccaucguuugguucugggagaauuuagaaaugaaggaaacuuggaaaaguuugacaaaucugcucuagagggccugugcaauuugaccauugaagaauuccgauuagcauacuuagacuacuaccucgaugauauuauugacuuauuuaauuguuugacaaauguuucuucauuuucccuggugagugugacuauugaaaggguaaaagacuuuucuuauaauuucggauggcaacauuuagaauuaguuaacuguaaauuuggacaguuucccacauugaaacucaaaucucucaaaaggcuuacuuucacuuccaacaaaggugggaaugcuuuuucagaaguugaucuaccaagccuugaguuucuagaucucaguagaaauggcuugaguuucaaagguugcuguucucaaagugauuuugggacaaccagccuaaaguauuuagaucugagcuucaaugguguuauuaccaugaguucaaacuucuugggcuuagaacaacuagaacaucuggauuuccagcauuccaauuugaaacaaaugagugaguuuucaguauuccuaucacucagaaaccucauuuaccuugacauuucucauacucacaccagaguugcuuucaauggcaucuucaauggcuuguccagucucgaagucuugaaaauggcuggcaauucuuuccaggaaaacuuccuuccagauaucuucacagagcugagaaacuugaccuuccuggaccucucucagugucaacuggagcaguugucuccaacagcauuuaacucacucuccagucuucagguacuaaauaugagccacaacaacuucuuuucauuggauacguuuccuuauaagugucugaacucccuccagguucuugauuacagucucaaucacauaaugacuuccaaaaaacaggaacuacagcauuuuccaaguagucuagcuuucuuaaaucuuacucagaaugacuuugcuuguacuugugaacaccagaguuuccugcaauggaucaaggaccagaggcagcucuugguggaaguugaacgaauggaaugugcaacaccuucagauaagcagggcaugccugugcugaguuugaauaucaccugucagaugaauaagaccaucauuggugugucgguccucagugugcuuguaguaucuguuguagcaguucuggucuauaaguucuauuuucaccugaugcuucuugcuggcugcauaaaguaugguagaggugaaaacaucuaugaugccuuuguuaucuacucaagccaggaugaggacuggguaaggaaugagcuaguaaagaauuuagaagaaggggugccuccauuucagcucugccuucacuacagagacuuuauucccgguguggccauugcugccaacaucauccaugaagguuuccauaaaagccgaaaggugauuguuguggugucccagcacuucauccagagccgcugguguaucuuugaauaugagauugcucagaccuggcaguuucugagcagucgugcugguaucaucuucauuguccugcagaagguggagaagacccugcucaggcagcagguggagcuguaccgccuucucagcaggaacacuuaccuggagugggaggacaguguccuggggcggcacaucuucuggagacgacucagaaaagcccugcuggaugguaaaucauggaauccagaaggaacaguggguacaggaugcaauuggcaggaagcaacaucuaucuga

SEQ ID NO: 369 - RNA, 1377 nt, Artificial Sequence
  P01730
augaaccggggagucccuuuuaggcacuugcuucuggugcugcaacuggcgcuccucccagcagccacucagggaaagaaaguggugcugggcaaaaaaggggauacaguggaacugaccuguacagcuucccagaagaagagcauacaauuccacuggaaaaacuccaaccagauaaagauucugggaaaucagggcuccuucuuaacuaaagguccauccaagcugaaugaucgcgcugacucaagaagaagccuuugggaccaaggaaacuuuccccugaucaucaagaaucuuaagauagaagacucagauacuuacaucugugaaguggaggaccagaaggaggaggugcaauugcuaguguucggauugacugccaacucugacacccaccugcuucaggggcagagccugacccugaccuuggagagccccccugguaguagccccucagugcaauguaggaguccaagggguaaaaacauacagggggggaagacccucuccgugucucagcuggagcuccaggauaguggcaccuggacaugcacugucuugcagaaccagaagaagguggaguucaaaauagacaucguggugcuagcuuuccagaaggccuccagcauagucuauaagaaagagggggaacagguggaguucuccuucccacucgccuuuacaguugaaaagcugacgggcaguggcgagcugugguggcaggcggagagggcuuccuccuccaagucuuggaucaccuuugaccugaagaacaaggaagugucuguaaaacggguuacccaggacccuaagcuccagaugggcaagaagcucccgcuccaccucacccugccccaggccuugccucaguaugcuggcucuggaaaccucacccuggcccuugaagcgaaaacaggaaaguugcaucaggaagugaaccugguggugaugagagccacucagcuccagaaaaauuugaccugugagguguggggacccaccuccccuaagcugaugcugaguuugaaacuggagaacaaggaggcaaaggucucgaagcgggagaaggcggugugggugcugaacccugaggcggggauguggcagugucugcugagugacucgggacagguccugcuggaauccaacaucaagguucugcccacaugguccaccccggugcagccaauggcccugauugugcuggggggcgucgccggccuccugcuuuucauugggcuaggcaucuucuucugugucaggugccggcaccgaaggcgccaagcagagcggaugucucagaucaagagacuccucagugagaagaagaccugccaguguccucaccgguuucagaagacauguagccccauuuga

SEQ ID NO: 370 - RNA, 537 nt, Artificial Sequence
  P01850
auggaggaccugaacaagguguucccacccgaggucgcuguguuugagccaucagaagcagagaucucccacacccaaaaggccacacuggugugccuggccacaggcuucuucccugaccacguggagcugagcuggugggugaaugggaaggaggugcacaguggggucagcacggacccgcagccccucaaggagcagcccgcccucaaugacuccagauacugccugagcagccgccugagggucucggccaccuucuggcagaacccccgcaaccacuuccgcugucaaguccaguucuacgggcucucggagaaugacgaguggacccaggauagggccaaacccgucacccagaucgucagcgccgaggccugggguagagcagacuguggcuuuaccucgguguccuaccagcaagggguccugucugccaccauccucuaugagauccugcuagggaaggccacccuguaugcugugcuggucagcgcccuuguguugauggccauggucaagagaaaggauuucuga

SEQ ID NO: 371 - RNA, 624 nt, Artificial Sequence
  P07766
augcagucgggcacucacuggagaguucugggccucugccucuuaucaguuggcguuugggggcaagaugguaaugaagaaaugggugguauuacacagacaccauauaaagucuccaucucuggaaccacaguaauauugacaugcccucaguauccuggaucugaaauacuauggcaacacaaugauaaaaacauaggcggugaugaggaugauaaaaacauaggcagugaugaggaucaccugucacugaaggaauuuucagaauuggagcaaagugguuauuaugucugcuaccccagaggaagcaaaccagaagaugcgaacuuuuaucucuaccugagggcaagagugugugagaacugcauggagauggaugugaugucgguggccacaauugucauaguggacaucugcaucacugggggcuugcugcugcugguuuacuacuggagcaagaauagaaaggccaaggccaagccugugacacgaggagcgggugcuggcggcaggcaaaggggacaaaacaaggagaggccaccaccuguucccaacccagacuaugagcccauccggaaaggccagcgggaccuguauucuggccugaaucagagacgcaucuga

SEQ ID NO: 372 - RNA, 3915 nt, Artificial Sequence
  P08575
auguauuuguggcuuaaacucuuggcauuuggcuuugccuuucuggacacagaaguauuugugacagggcaaagcccaacaccuucccccacuggauugacuacagcaaagaugcccaguguuccacuuucaagugaccccuuaccuacucacaccacugcauucucacccgcaagcaccuuugaaagagaaaaugacuucucagagaccacaacuucucuuaguccagacaauacuuccacccaaguauccccggacucuuuggauaaugcuagugcuuuuaauaccacagguguuucaucaguacagacgccucaccuucccacgcacgcagacucgcagacgcccucugcuggaacugacacgcagacauucagcggcuccgccgccaaugcaaaacucaacccuaccccaggcagcaaugcuaucucagaugucccaggagagaggaguacagccagcaccuuuccuacagacccaguuuccccauugacaaccacccucagccuugcacaccacagcucugcugccuuaccugcacgcaccuccaacaccaccaucacagcgaacaccucagaugccuaccuuaaugccucugaaacaaccacucugagcccuucuggaagcgcugucauuucaaccacaacaauagcuacuacuccaucuaagccaacaugugaugaaaaauaugcaaacaucacuguggauuacuuauauaacaaggaaacuaaauuauuuacagcaaagcuaaauguuaaugagaauguggaauguggaaacaauacuugcacaaacaaugaggugcauaaccuuacagaauguaaaaaugcgucuguuuccauaucucauaauucauguacugcuccugauaagacauuaauauuagaugugccaccagggguugaaaaguuucaguuacaugauuguacacaaguugaaaaagcagauacuacuauuuguuuaaaauggaaaaauauugaaaccuuuacuugugauacacagaauauuaccuacagauuucagugugguaauaugauauuugauaauaaagaaauuaaauuagaaaaccuugaacccgaacaugaguauaagugugacucagaaauacucuauaauaaccacaaguuuacuaacgcaaguaaaauuauuaaaacagauuuugggaguccaggagagccucagauuauuuuuuguagaagugaagcugcacaucaaggaguaauuaccuggaaucccccucaaagaucauuucauaauuuuacccucuguuauauaaaagagacagaaaaagauugccucaaucuggauaaaaaccugaucaaauaugauuugcaaaauuuaaaaccuuauacgaaauauguuuuaucauuacaugccuacaucauugcaaaagugcaacguaauggaagugcugcaaugugucauuucacaacuaaaagugcuccuccaagccaggucuggaacaugacugucuccaugacaucagauaauaguaugcaugucaaguguaggccucccagggaccguaauggcccccaugaacguuaccauuuggaaguugaagcuggaaauacucugguuagaaaugagucgcauaagaauugcgauuuccguguaaaagaucuucaauauucaacagacuacacuuuuaaggccuauuuucacaauggagacuauccuggagaacccuuuauuuuacaucauucaacaucuuauaauucuaaggcacugauagcauuucuggcauuucugauuauugugacaucaauagcccugcuuguuguucucuacaaaaucuaugaucuacauaagaaaagauccugcaauuuagaugaacagcaggagcuuguugaaagggaugaugaaaaacaacugaugaauguggagccaauccaugcagauauuuuguuggaaacuuauaagaggaagauugcugaugaaggaagacuuuuucuggcugaauuucagagcaucccgcggguguucagcaaguuuccuauaaaggaagcucgaaagcccuuuaaccagaauaaaaaccguuauguugacauucuuccuuaugauuauaaccguguugaacucucugagauaaacggagaugcagggucaaacuacauaaaugccagcuauauugaugguuucaaagaacccaggaaauacauugcugcacaaggucccagggaugaaacuguugaugauuucuggaggaugauuugggaacagaaagccacaguuauugucauggucacucgaugugaagaaggaaacaggaacaagugugcagaauacuggccgucaauggaagagggcacucgggcuuuuggagauguuguuguaaagaucaaccagcacaaaagauguccagauuacaucauucagaaauugaacauuguaaauaaaaaagaaaaagcaacuggaagagaggugacucacauucaguucaccagcuggccagaccacggggugccugaggauccucacuugcuccucaaacugagaaggagagugaaugccuucagcaauuucuucaguggucccauuguggugcacugcagugcugguguugggcgcacaggaaccuauaucggaauugaugccaugcuagaaggccuggaagccgagaacaaaguggauguuuaugguuauguugucaagcuaaggcgacagagaugccugaugguucaaguagaggcccaguacaucuugauccaucaggcuuugguggaauacaaucaguuuggagaaacagaagugaauuugucugaauuacauccauaucuacauaacaugaagaaaagggauccacccagugagccgucuccacuagaggcugaauuccagagacuuccuucauauaggagcuggaggacacagcacauuggaaaucaagaagaaaauaaaaguaaaaacaggaauucuaaugucaucccauaugacuauaacagagugccacuuaaacaugagcuggaaaugaguaaagagagugagcaugauucagaugaauccucugaugaugacagugauucagaggaaccaagcaaauacaucaaugcaucuuuuauaaugagcuacuggaaaccugaagugaugauugcugcucagggaccacugaaggagaccauuggugacuuuuggcagaugaucuuccaaagaaaagucaaaguuauuguuaugcugacagaacugaaacauggagaccaggaaaucugugcucaguacuggggagaaggaaagcaaacauauggagauauugaaguugaccugaaagacacagacaaaucuucaacuuauacccuucgugucuuugaacugagacauuccaagaggaaagacucucgaacuguguaccaguaccaauauacaaacuggaguguggagcagcuuccugcagaacccaaggaauuaaucucuaugauucaggucgucaaacaaaaacuuccccagaagaauuccucugaagggaacaagcaucacaagaguacaccucuacucauucacugcagggauggaucucagcaaacgggaauauuuugugcuuuguuaaaucucuuagaaagugcggaaacagaagagguaguggauauuuuucaagugguaaaagcucuacgcaaagcuaggccaggcaugguuuccacauucgagcaauaucaauuccuauaugacgucauugccagcaccuacccugcucagaauggacaaguaaagaaaaacaaccaucaagaagauaaaauugaauuugauaaugaaguggacaaaguaaagcaggaugcuaauuguguuaauccacuuggugccccagaaaagcucccugaagcaaaggaacaggcugaagguucugaacccacgaguggcacugaggggccagaacauucugucaaugguccugcaaguccagcuuuaaaucaagguucauag

SEQ ID NO: 373 - RNA, 765 nt, Artificial Sequence
  P08637
auguggcagcugcuccucccaacugcucugcuacuucuaguuucagcuggcaugcggacugaagaucucccaaaggcugugguguuccuggagccucaaugguacagggugcucgagaaggacagugugacucugaagugccagggagccuacuccccugaggacaauuccacacagugguuucacaaugagagccucaucucaagccaggccucgagcuacuucauugacgcugccacagucgacgacaguggagaguacaggugccagacaaaccucuccacccucagugacccggugcagcuagaaguccauaucggcuggcuguugcuccaggccccucgguggguguucaaggaggaagacccuauucaccugaggugucacagcuggaagaacacugcucugcauaaggucacauauuuacagaauggcaaaggcaggaaguauuuucaucauaauucugacuucuacauuccaaaagccacacucaaagacagcggcuccuacuucugcagggggcuuuuugggaguaaaaaugugucuucagagacugugaacaucaccaucacucaagguuuggcagugucaaccaucucaucauucuuuccaccuggguaccaagucucuuucugcuuggugaugguacuccuuuuugcaguggacacaggacuauauuucucugugaagacaaacauucgaagcucaacaagagacuggaaggaccauaaauuuaaauggagaaaggacccucaagacaaauga

SEQ ID NO: 374 - RNA, 663 nt, Artificial Sequence
  P10747
augcucaggcugcucuuggcucucaacuuauucccuucaauucaaguaacaggaaacaagauuuuggugaagcagucgcccaugcuuguagcguacgacaaugcggucaaccuuagcugcaaguauuccuacaaucucuucucaagggaguuccgggcaucccuucacaaaggacuggauagugcuguggaagucuguguuguauaugggaauuacucccagcagcuucagguuuacucaaaaacgggguucaacugugaugggaaauugggcaaugaaucagugacauucuaccuccagaauuuguauguuaaccaaacagauauuuacuucugcaaaauugaaguuauguauccuccuccuuaccuagacaaugagaagagcaauggaaccauuauccaugugaaagggaaacaccuuuguccaaguccccuauuucccggaccuucuaagcccuuuugggugcugguggugguugguggaguccuggcuugcuauagcuugcuaguaacaguggccuuuauuauuuucugggugaggaguaagaggagcaggcuccugcacagugacuacaugaacaugacuccccgccgccccgggcccacccgcaagcauuaccagcccuaugccccaccacgcgacuucgcagccuaucgcuccuga

SEQ ID NO: 375 - RNA, 681 nt, Artificial Sequence
  P11912
augccuggggguccaggaguccuccaagcucugccugccaccaucuuccuccucuuccugcugucugcugucuaccugggcccugggugccaggcccuguggaugcacaaggucccagcaucauugauggugagccugggggaagacgcccacuuccaaugcccgcacaauagcagcaacaacgccaacgucaccugguggcgcguccuccauggcaacuacacguggcccccugaguucuugggcccgggcgaggaccccaaugguacgcugaucauccagaaugugaacaagagccaugggggcauauacgugugccggguccaggagggcaacgagucauaccagcaguccugcggcaccuaccuccgcgugcgccagccgccccccaggcccuuccuggacaugggggagggcaccaagaaccgaaucaucacagccgaggggaucauccuccuguucugcgcgguggugccugggacgcugcugcuguucaggaaacgauggcagaacgagaagcucggguuggaugccggggaugaauaugaagaugaaaaccuuuaugaaggccugaaccuggacgacugcuccauguaugaggacaucucccggggccuccagggcaccuaccaggaugugggcagccucaacauaggagauguccagcuggagaagccguga

SEQ ID NO: 376 - RNA, 1671 nt, Artificial Sequence
  P15391
augccaccuccucgccuccucuucuuccuccucuuccucacccccauggaagucaggcccgaggaaccucuaguggugaagguggaagagggagauaacgcugugcugcagugccucaaggggaccucagauggccccacucagcagcugaccuggucucgggaguccccgcuuaaacccuucuuaaaacucagccuggggcugccaggccugggaauccacaugaggccccuggccaucuggcuuuucaucuucaacgucucucaacagauggggggcuucuaccugugccagccggggccccccucugagaaggccuggcagccuggcuggacagucaauguggagggcagcggggagcuguuccgguggaauguuucggaccuagguggccugggcuguggccugaagaacagguccucagagggccccagcuccccuuccgggaagcucaugagccccaagcuguaugugugggccaaagaccgcccugagaucugggagggagagccuccgugucucccaccgagggacagccugaaccagagccucagccaggaccucaccauggccccuggcuccacacucuggcuguccugugggguacccccugacucuguguccaggggcccccucuccuggacccaugugcaccccaaggggccuaagucauugcugagccuagagcugaaggacgaucgcccggccagagauauguggguaauggagacgggucuguuguugccccgggccacagcucaagacgcuggaaaguauuauugucaccguggcaaccugaccaugucauuccaccuggagaucacugcucggccaguacuauggcacuggcugcugaggacugguggcuggaaggucucagcugugacuuuggcuuaucugaucuucugccuguguucccuugugggcauucuucaucuucaaagagcccugguccugaggaggaaaagaaagcgaaugacugaccccaccaggagauucuucaaagugacgccucccccaggaagcgggccccagaaccaguacgggaacgugcugucucuccccacacccaccucaggccucggacgcgcccagcguugggccgcaggccuggggggcacugccccgucuuauggaaacccgagcagcgacguccaggcggauggagccuuggggucccggagcccgccgggagugggcccagaagaagaggaaggggagggcuaugaggaaccugacagugaggaggacuccgaguucuaugagaacgacuccaaccuugggcaggaccagcucucccaggauggcagcggcuacgagaacccugaggaugagccccuggguccugaggaugaagacuccuucuccaacgcugagucuuaugagaacgaggaugaagagcugacccagccggucgccaggacaauggacuuccugagcccucaugggucagccugggaccccagccgggaagcaaccucccuggggucccaguccuaugaggauaugagaggaauccuguaugcagccccccagcuccgcuccauucggggccagccuggacccaaucaugaggaagaugcagacucuuaugagaacauggauaaucccgaugggccagacccagccuggggaggagggggccgcaugggcaccuggagcaccagguga

SEQ ID NO: 377 - RNA, 672 nt, Artificial Sequence
  P16410
auggcuugccuuggauuucagcggcacaaggcucagcugaaccuggcuaccaggaccuggcccugcacucuccuguuuuuucuucucuucaucccugucuucugcaaagcaaugcacguggcccagccugcugugguacuggccagcagccgaggcaucgccagcuuugugugugaguaugcaucuccaggcaaagccacugagguccgggugacagugcuucggcaggcugacagccaggugacugaagucugugcggcaaccuacaugauggggaaugaguugaccuuccuagaugauuccaucugcacgggcaccuccaguggaaaucaagugaaccucacuauccaaggacugagggccauggacacgggacucuacaucugcaagguggagcucauguacccaccgccauacuaccugggcauaggcaacggaacccagauuuauguaauugauccagaaccgugcccagauucugacuuccuccucuggauccuugcagcaguuaguucgggguuguuuuuuuauagcuuucuccucacagcuguuucuuugagcaaaaugcuaaagaaaagaagcccucuuacaacaggggucuaugugaaaaugcccccaacagagccagaaugugaaaagcaauuucagccuuauuuuauucccaucaauuga

SEQ ID NO: 378 - RNA, 1419 nt, Artificial Sequence
  P16671
augggcugugaccggaacugugggcucaucgcuggggcugucauuggugcuguccuggcuguguuuggagguauucuaaugccaguuggagaccugcuuauccagaagacaauuaaaaagcaaguuguccucgaagaagguacaauugcuuuuaaaaauuggguuaaaacaggcacagaaguuuacagacaguuuuggaucuuugaugugcaaaauccacaggaagugaugaugaacagcagcaacauucaaguuaagcaaagagguccuuauacguacagaguucguuuucuagccaaggaaaauguaacccaggacgcugaggacaacacagucucuuuccugcagcccaauggugccaucuucgaaccuucacuaucaguuggaacagaggcugacaacuucacaguucucaaucuggcuguggcagcugcaucccauaucuaucaaaaucaauuuguucaaaugauccucaauucacuuauuaacaagucaaaaucuucuauguuccaagucagaacuuugagagaacuguuauggggcuauagggauccauuuuugaguuugguuccguacccuguuacuaccacaguuggucuguuuuauccuuacaacaauacugcagauggaguuuauaaaguuuucaauggaaaagauaacauaaguaaaguugccauaaucgacacauauaaagguaaaaggaaucuguccuauugggaaagucacugcgacaugauuaaugguacagaugcagccucauuuccaccuuuuguugagaaaagccagguauugcaguucuuuucuucugauauuugcaggucaaucuaugcuguauuugaauccgacguuaaucugaaaggaaucccuguguauagauuuguucuuccauccaaggccuuugccucuccaguugaaaacccagacaacuauuguuucugcacagaaaaaauuaucucaaaaaauuguacaucauauggugugcuagacaucagcaaaugcaaagaagggagaccuguguacauuucacuuccucauuuucuguaugcaaguccugauguuucagaaccuauugauggauuaaacccaaaugaagaagaacauaggacauacuuggauauugaaccuauaacuggauucacuuuacaauuugcaaaacggcugcaggucaaccuauuggucaagccaucagaaaaaauucaaguauuaaagaaucugaagaggaacuauauugugccuauucuuuggcuuaaugagacugggaccauuggugaugagaaggcaaacauguucagaagucaaguaacuggaaaaauaaaccuccuuggccugauagaaaugaucuuacucaguguugguguggugauguuuguugcuuuuaugauuucauauugugcaugcagaucgaaaacaauaaaauaa

SEQ ID NO: 379 - RNA, 651 nt, Artificial Sequence
  P26718
augggguggauucguggucggaggucucgacacagcugggagaugagugaauuucauaauuauaacuuggaucugaagaagagugauuuuucaacacgauggcaaaagcaaagauguccaguagucaaaagcaaauguagagaaaaugcaucuccauuuuuuuucugcugcuucaucgcuguagccaugggaauccguuucauuauuaugguagcaauauggagugcuguauuccuaaacucauuauucaaccaagaaguucaaauucccuugaccgaaaguuacuguggcccauguccuaaaaacuggauauguuacaaaaauaacugcuaccaauuuuuugaugagaguaaaaacugguaugagagccaggcuucuuguaugucucaaaaugccagccuucugaaaguauacagcaaagaggaccaggauuuacuuaaacuggugaagucauaucauuggaugggacuaguacacauuccaacaaauggaucuuggcagugggaagauggcuccauucucucacccaaccuacuaacaauaauugaaaugcagaagggagacugugcacucuaugccucgagcuuuaaaggcuauauagaaaacuguucaacuccaaauacguacaucugcaugcaaaggacuguguaa

SEQ ID NO: 380 - RNA, 261 nt, Artificial Sequence
  P30273
augauuccagcaguggucuugcucuuacuccuuuugguugaacaagcagcggcccugggagagccucagcucugcuauauccuggaugccauccuguuucuguauggaauuguccucacccuccucuacugucgacugaagauccaagugcgaaaggcagcuauaaccagcuaugagaaaucagaugguguuuacacgggccugagcaccaggaaccaggagacuuacgagacucugaagcaugagaaaccaccacaguag

SEQ ID NO: 381 - RNA, 1137 nt, Artificial Sequence
  P32248
auggaccuggggaaaccaaugaaaagcgugcuggugguggcucuccuugucauuuuccagguaugccugugucaagaugaggucacggacgauuacaucggagacaacaccacaguggacuacacuuuguucgagucuuugugcuccaagaaggacgugcggaacuuuaaagccugguuccucccuaucauguacuccaucauuuguuucgugggccuacugggcaaugggcuggucguguugaccuauaucuauuucaagaggcucaagaccaugaccgauaccuaccugcucaaccuggcgguggcagacauccucuuccuccugacccuucccuucugggccuacagcgcggccaaguccugggucuucgguguccacuuuugcaagcucaucuuugccaucuacaagaugagcuucuucaguggcaugcuccuacuucuuugcaucagcauugaccgcuacguggccaucguccaggcugucucagcucaccgccaccgugcccgcguccuucucaucagcaagcuguccugugugggcaucuggauacuagccacagugcucuccaucccagagcuccuguacagugaccuccagaggagcagcagugagcaagcgaugcgaugcucucucaucacagagcauguggaggccuuuaucaccauccagguggcccagauggugaucggcuuucuggucccccugcuggccaugagcuucuguuaccuugucaucauccgcacccugcuccaggcacgcaacuuugagcgcaacaaggccaucaaggugaucaucgcuguggucguggucuucauagucuuccagcugcccuacaauggggugguccuggcccagacgguggccaacuucaacaucaccaguagcaccugugagcucaguaagcaacucaacaucgccuacgacgucaccuacagccuggccugcguccgcugcugcgucaacccuuucuuguacgccuucaucggcgucaaguuccgcaacgaucucuucaagcucuucaaggaccugggcugccucagccaggagcagcuccggcaguggucuuccugucggcacauccggcgcuccuccaugaguguggaggccgagaccaccaccaccuucuccccauag

SEQ ID NO: 382 - RNA, 690 nt, Artificial Sequence
  P40259
auggccaggcuggcguugucuccugugcccagccacuggaugguggcguugcugcugcugcucucagcagagccaguaccagcagccagaucggaggaccgguaccggaaucccaaagguagugcuuguucgcggaucuggcagagcccacguuucauagccaggaaacggggcuucacggugaaaaugcacugcuacaugaacagcgccuccggcaaugugagcuggcucuggaagcaggagauggacgagaauccccagcagcugaagcuggaaaagggccgcauggaagagucccagaacgaaucucucgccacccucaccauccaaggcauccgguuugaggacaauggcaucuacuucugucagcagaagugcaacaacaccucggaggucuaccagggcugcggcacagagcugcgagucaugggauucagcaccuuggcacagcugaagcagaggaacacgcugaaggaugguaucaucaugauccagacgcugcugaucauccucuucaucaucgugccuaucuuccugcugcuggacaaggaugacagcaaggcuggcauggaggaagaucacaccuacgagggccuggacauugaccagacagccaccuaugaggacauagugacgcugcggacaggggaagugaaguggucuguaggugagcacccaggccaggaguga

SEQ ID NO: 383 - RNA, 990 nt, Artificial Sequence
  P42081
auggauccccagugcacuaugggacugaguaacauucucuuugugauggccuuccugcucucuggugcugcuccucugaagauucaagcuuauuucaaugagacugcagaccugccaugccaauuugcaaacucucaaaaccaaagccugagugagcuaguaguauuuuggcaggaccaggaaaacuugguucugaaugagguauacuuaggcaaagagaaauuugacaguguucauuccaaguauaugggccgcacaaguuuugauucggacaguuggacccugagacuucacaaucuucagaucaaggacaagggcuuguaucaauguaucauccaucacaaaaagcccacaggaaugauucgcauccaccagaugaauucugaacugucagugcuugcuaacuucagucaaccugaaauaguaccaauuucuaauauaacagaaaauguguacauaaauuugaccugcucaucuauacacgguuacccagaaccuaagaagaugaguguuuugcuaagaaccaagaauucaacuaucgaguaugaugguguuaugcagaaaucucaagauaaugucacagaacuguacgacguuuccaucagcuugucuguuucauucccugauguuacgagcaauaugaccaucuucuguauucuggaaacugacaagacgcggcuuuuaucuucaccuuucucuauagagcuugaggacccucagccucccccagaccacauuccuuggauuacagcuguacuuccaacaguuauuauaugugugaugguuuucugucuaauucuauggaaauggaagaagaagaagcggccucgcaacucuuauaaauguggaaccaacacaauggagagggaagagagugaacagaccaagaaaagagaaaaaauccauauaccugaaagaucugaugaagcccagcguguuuuuaaaaguucgaagacaucuucaugcgacaaaagugauacauguuuuuaa

SEQ ID NO: 384 - RNA, 1011 nt, Artificial Sequence
  Q15762
auggauuauccuacuuuacuuuuggcucuucuucauguauacagagcucuaugugaagaggugcuuuggcauacaucaguucccuuugccgagaacaugucucuagaauguguguauccaucaaugggcaucuuaacacagguggagugguucaagaucgggacccagcaggauuccauagccauuuucagcccuacucauggcauggucauaaggaagcccuaugcugagaggguuuacuuuuugaauucaacgauggcuuccaauaacaugacucuuuucuuucggaaugccucugaagaugauguuggcuacuauuccugcucucuuuacacuuacccacagggaacuuggcagaaggugauacaggugguucagucagauaguuuugaggcagcugugccaucaaauagccacauuguuucggaaccuggaaagaaugucacacucacuugucagccucagaugacguggccugugcaggcagugaggugggaaaagauccagccccgucagaucgaccucuuaacuuacugcaacuugguccauggcagaaauuucaccuccaaguucccaagacaaauagugagcaacugcagccacggaagguggagcgucaucgucauccccgaugucacagucucagacucggggcuuuaccgcugcuacuugcaggccagcgcaggagaaaacgaaaccuucgugaugagauugacuguagccgaggguaaaaccgauaaccaauauacccucuuuguggcuggagggacaguuuuauuguuguuguuuguuaucucaauuaccaccaucauugucauuuuccuuaacagaaggagaaggagagagagaagagaucuauuuacagaguccugggauacacagaaggcacccaauaacuauagaagucccaucucuaccagucaaccuaccaaucaauccauggaugauacaagagaggauauuuaugucaacuauccaaccuucucucgcagaccaaagacuagaguuuaa

SEQ ID NO: 385 - RNA, 13482 nt, Artificial Sequence
  Q685J3
augccaaggccagggaccauggcgcugugucugcugaccuugguccucucgcucuugcccccacaagcugcugcagaacaggaccucagugugaacagggcugugugggauggaggagggugcaucucccaaggggacgucuugaaccgucagugccagcagcugucucagcacguuaggacagguucugcggcaaacaccgccacagguacaacaucuacaaaugucguggagccaagaauguauuugaguugcagcaccaacccugagaugaccucgauugaguccagugugacuucagacacuccuggugucuccaguaccaggaugacaccaacagaauccagaacaacuucagaaucuaccagugacagcaccacacuuuuccccaguucuacugaagacacuucaucuccuacaacuccugaaggcaccgacgugcccaugucaacaccaagugaagaaagcauuucaucaacaauggcuuuugucagcacugcaccucuucccaguuuugaggccuacacaucuuuaacauauaagguugauaugagcacaccucugaccacuucuacucaggcaaguucaucuccuacuacuccugaaagcaccaccauacccaaaucaacuaacagugaaggaagcacuccauuaacaaguaugccugccagcaccaugaagguggccaguucagaggcuaucacccuuuugacaacuccuguugaaaucagcacaccugugaccauuucugcucaagccaguucaucuccuacaacugcugaaggucccagccugucaaacucagcuccuaguggaggaagcacuccauuaacaagaaugccucucagcgugaugcugguggucaguucugaggcuagcacccuuucaacaacuccugcugccaccaacauuccugugaucacuucuacugaagccaguucaucuccuacaacggcugaaggcaccagcauaccaaccucaacuuauacugaaggaagcacuccauuaacaaguacgccugccagcaccaugccgguugccacuucugaaaugagcacacuuucaauaacuccuguugacaccagcacacuugugaccacuucuacugaacccaguucacuuccuacaacugcugaagcuaccagcaugcuaaccucaacucuuagugaaggaagcacuccauuaacaaauaugccugucagcaccauauugguggccaguucugaggcuagcaccacuucaacaauuccuguugacuccaaaacuuuugugaccacugcuagugaagccagcucaucucccacaacugcugaagauaccagcauugcaaccucaacuccuagugaaggaagcacuccauuaacaaguaugccugucagcaccacuccaguggccaguucugaggcuagcaaccuuucaacaacuccuguugacuccaaaacucaggugaccacuucuacugaagccaguucaucuccuccaacugcugaaguuaacagcaugccaaccucaacuccuagugaaggaagcacuccauuaacaaguaugucugucagcaccaugccgguggccaguucugaggcuagcacccuuucaacaacuccuguugacaccagcacaccugugaccacuucuagugaagccaguucaucuucuacaacuccugaagguaccagcauaccaaccucaacuccuagugaaggaagcacuccauuaacaaacaugccugucagcaccaggcugguggucaguucugaggcuagcaccacuucaacaacuccugcugacuccaacacuuuugugaccacuucuagugaagcuaguucaucuucuacaacugcugaagguaccagcaugccaaccucaacuuacagugaaagaggcacuacaauaacaaguaugucugucagcaccacacugguggccaguucugaggcuagcacccuuucaacaacuccuguugacuccaacacuccugugaccacuucaacugaagccacuucaucuucuacaacugcggaagguaccagcaugccaaccucaacuuauacugaaggaagcacuccauuaacaaguaugccugucaacaccacacugguggccaguucugaggcuagcacccuuucaacaacuccuguugacaccagcacaccugugaccacuucaacugaagccaguuccucuccuacaacugcugauggugccaguaugccaaccucaacuccuagugaaggaagcacuccauuaacaaguaugccugucagcaaaacgcuguugaccaguucugaggcuagcacccuuucaacaacuccucuugacacaagcacacauaucaccacuucuacugaagccaguugcucuccuacaaccacugaagguaccagcaugccaaucucaacuccuagugaaggaaguccuuuauuaacaaguauaccugucagcaucacaccggugaccaguccugaggcuagcacccuuucaacaacuccuguugacuccaacaguccugugaccacuucuacugaagucaguucaucuccuacaccugcugaagguaccagcaugccaaccucaacuuauagugaaggaagaacuccuuuaacaaguaugccugucagcaccacacugguggccacuucugcaaucagcacccuuucaacaacuccuguugacaccagcacaccugugaccaauucuacugaagcccguucgucuccuacaacuucugaagguaccagcaugccaaccucaacuccuggggaaggaagcacuccauuaacaaguaugccugacagcaccacgccgguagucaguucugaggcuagaacacuuucagcaacuccuguugacaccagcacaccugugaccacuucuacugaagccacuucaucuccuacaacugcugaagguaccagcauaccaaccucgacuccuagugaaggaacgacuccauuaacaagcacaccugucagccacacgcugguggccaauucugaggcuagcacccuuucaacaacuccuguugacuccaacacuccuuugaccacuucuacugaagccaguucaccuccucccacugcugaagguaccagcaugccaaccucaacuccuagugaaggaagcacuccauuaacacguaugccugucagcaccacaaugguggccaguucugaaacgagcacacuuucaacaacuccugcugacaccagcacaccugugaccacuuauucucaagccaguucaucuucuacaacugcugacgguaccagcaugccaaccucaacuuauagugaaggaagcacuccacuaacaagugugccugucagcaccaggcugguggucaguucugaggcuagcacccuuuccacaacuccugucgacaccagcauaccugucaccacuucuacugaagccaguucaucuccuacaacugcugaagguaccagcauaccaaccucaccucccagugaaggaaccacuccguuagcaaguaugccugucagcaccacgcugguggucaguucugaggcuaacacccuuucaacaacuccuguggacuccaaaacucagguggccacuucuacugaagccaguucaccuccuccaacugcugaaguuaccagcaugccaaccucaacuccuggagaaagaagcacuccauuaacaaguaugccugucagacacacgccaguggccaguucugaggcuagcacccuuucaacaucucccguugacaccagcacaccugugaccacuucugcugaaaccaguuccucuccuacaaccgcugaagguaccagcuugccaaccucaacuacuagugaaggaaguacucuauuaacaaguauaccugucagcaccacgcuggugaccaguccugaggcuagcacccuuuuaacaacuccuguugacacuaaagguccuguggucacuucuaaugaagucaguucaucuccuacaccugcugaagguaccagcaugccaaccucaacuuauagugaaggaagaacuccuuuaacaaguauaccugucaacaccacacugguggccaguucugcaaucagcauccuuucaacaacuccuguugacaacagcacaccugugaccacuucuacugaagccuguucaucuccuacaacuucugaagguaccagcaugccaaacucaaauccuagugaaggaaccacuccguuaacaaguauaccugucagcaccacgccgguagucaguucugaggcuagcacccuuucagcaacuccuguugacaccagcaccccugggaccacuucugcugaagccacuucaucuccuacaacugcugaagguaucagcauaccaaccucaacuccuagugaaggaaagacuccauuaaaaaguauaccugucagcaacacgccgguggccaauucugaggcuagcacccuuucaacaacuccuguugacucuaacaguccuguggucacuucuacagcagucaguucaucuccuacaccugcugaagguaccagcauagcaaucucaacgccuagugaaggaagcacugcauuaacaaguauaccugucagcaccacaacaguggccaguucugaaaucaacagccuuucaacaacuccugcugucaccagcacaccugugaccacuuauucucaagccaguucaucuccuacaacugcugacgguaccagcaugcaaaccucaacuuauagugaaggaagcacuccacuaacaaguuugccugucagcaccaugcugguggucaguucugaggcuaacacccuuucaacaaccccuauugacuccaaaacucaggugaccgcuucuacugaagccaguucaucuacaaccgcugaagguagcagcaugacaaucucaacuccuagugaaggaaguccucuauuaacaaguauaccugucagcaccacgccgguggccaguccugaggcuagcacccuuucaacaacuccuguugacuccaacaguccugugaucacuucuacugaagucaguucaucuccuacaccugcugaagguaccagcaugccaaccucaacuuauacugaaggaagaacuccuuuaacaaguauaacugucagaacaacaccgguggccagcucugcaaucagcacccuuucaacaacucccguugacaacagcacaccugugaccacuucuacugaagcccguucaucuccuacaacuucugaagguaccagcaugccaaacucaacuccuagugaaggaaccacuccauuaacaaguauaccugucagcaccacgccgguacucaguucugaggcuagcacccuuucagcaacuccuauugacaccagcaccccugugaccacuucuacugaagccacuucgucuccuacaacugcugaagguaccagcauaccaaccucgacucuuagugaaggaaugacuccauuaacaagcacaccugucagccacacgcugguggccaauucugaggcuagcacccuuucaacaacuccuguugacucuaacaguccuguggucacuucuacagcagucaguucaucuccuacaccugcugaagguaccagcauagcaaccucaacgccuagugaaggaagcacugcauuaacaaguauaccugucagcaccacaacaguggccaguucugaaaccaacacccuuucaacaacucccgcugucaccagcacaccugugaccacuuaugcucaagucaguucaucuccuacaacugcugacgguagcagcaugccaaccucaacuccuagggaaggaaggccuccauuaacaaguauaccugucagcaccacaacaguggccaguucugaaaucaacacccuuucaacaacucuugcugacaccaggacaccugugaccacuuauucucaagccaguucaucuccuacaacugcugaugguaccagcaugccaaccccagcuuauagugaaggaagcacuccacuaacaaguaugccucucagcaccacgcugguggucaguucugaggcuagcacucuuuccacaacuccuguugacaccagcacuccugccaccacuucuacugaaggcaguucaucuccuacaacugcaggagguaccagcauacaaaccucaacuccuagugaacggaccacuccauuagcagguaugccugucagcacuacgcuuguggucaguucugaggguaacacccuuucaacaacuccuguugacuccaaaacucaggugaccaauucuacugaagccaguucaucugcaaccgcugaagguagcagcaugacaaucucagcuccuagugaaggaaguccucuacuaacaaguauaccucucagcaccacgccgguggccaguccugaggcuagcacccuuucaacaacuccuguugacuccaacaguccugugaucacuucuacugaagucaguucaucuccuauaccuacugaagguaccagcaugcaaaccucaacuuauagugacagaagaacuccuuuaacaaguaugccugucagcaccacagugguggccaguucugcaaucagcacccuuucaacaacuccuguugacaccagcacaccugugaccaauucuacugaagcccguucaucuccuacaacuucugaagguaccagcaugccaaccucaacuccuagugaaggaagcacuccauucacaaguaugccugucagcaccaugccgguaguuacuucugaggcuagcacccuuucagcaacuccuguugacaccagcacaccugugaccacuucuacugaagccacuucaucuccuacaacugcugaagguaccagcauaccaacuucaacucuuagugaaggaacgacuccauuaacaaguauaccugucagccacacgcugguggccaauucugagguuagcacccuuucaacaacuccuguugacuccaacacuccuuucacuacuucuacugaagccaguucaccuccucccacugcugaagguaccagcaugccaaccucaacuucuagugaaggaaacacuccauuaacacguaugccugucagcaccacaaugguggccaguuuugaaacaagcacacuuucuacaacuccugcugacaccagcacaccugugacuacuuauucucaagccgguucaucuccuacaacugcugacgauacuagcaugccaaccucaacuuauagugaaggaagcacuccacuaacaagugugccugucagcaccaugccgguggucaguucugaggcuagcacccauuccacaacuccuguugacaccagcacaccugucaccacuucuacugaagccaguucaucuccuacaacugcugaagguaccagcauaccaaccucaccuccuagugaaggaaccacuccguuagcaaguaugccugucagcaccacgccgguggucaguucugaggcuggcacccuuuccacaacuccuguugacaccagcacaccuaugaccacuucuacugaagccaguucaucuccuacaacugcugaagauaucgucgugccaaucucaacugcuagugaaggaaguacucuauuaacaaguauaccugucagcaccacgccaguggccaguccugaggcuagcacccuuucaacaacuccuguugacuccaacaguccuguggucacuucuacugaaaucaguucaucugcuacauccgcugaagguaccagcaugccuaccucaacuuauagugaaggaagcacuccauuaagaaguaugccugucagcaccaagccguuggccaguucugaggcuagcacucuuucaacaacuccuguugacaccagcauaccugucaccacuucuacugaaaccaguucaucuccuacaacugcaaaagauaccagcaugccaaucucaacuccuagugaaguaaguacuucauuaacaaguauacuugucagcaccaugccaguggccaguucugaggcuagcacccuuucaacaacuccuguugacaccaggacacuugugaccacuuccacuggaaccaguucaucuccuacaacugcugaagguagcagcaugccaaccucaacuccuggugaaagaagcacuccauuaacaaauauacuugucagcaccacgcuguuggccaauucugaggcuagcacccuuucaacaacuccuguugacaccagcacaccugucaccacuucugcugaagccaguucuucuccuacaacugcugaagguaccagcaugcgaaucucaacuccuagugauggaaguacuccauuaacaaguauacuugucagcacccugccaguggccaguucugaggcuagcaccguuucaacaacugcuguugacaccagcauaccugucaccacuucuacugaagccaguuccucuccuacaacugcugaaguuaccagcaugccaaccucaacuccuagugaaacaaguacuccauuaacuaguaugccugucaaccacacgccaguggccaguucugaggcuggcacccuuucaacaacuccuguugacaccagcacaccugugaccacuucuacuaaagccaguucaucuccuacaacugcugaagguaucgucgugccaaucucaacugcuagugaaggaaguacucuauuaacaaguauaccugucagcaccacgccgguggccaguucugaggcuagcacccuuucaacaacuccuguugauaccagcauaccugucaccacuucuacugaaggcaguucuucuccuacaacugcugaagguaccagcaugccaaucucaacuccuagugaaguaaguacuccauuaacaaguauacuugucagcaccgugccaguggccgguucugaggcuagcacccuuucaacaacuccuguugacaccaggacaccugucaccacuucugcugaagcuaguucuucuccuacaacugcugaagguaccagcaugccaaucucaacuccuggcgaaagaagaacuccauuaacaaguaugucugucagcaccaugccgguggccaguucugaggcuagcacccuuucaagaacuccugcugacaccagcacaccugugaccacuucuacugaagccaguuccucuccuacaacugcugaagguaccggcauaccaaucucaacuccuagugaaggaaguacuccauuaacaaguauaccugucagcaccacgccaguggccauuccugaggcuagcacccuuucaacaacuccuguugacuccaacaguccuguggucacuucuacugaagucaguucaucuccuacaccugcugaagguaccagcaugccaaucucaacuuauagugaaggaagcacuccauuaacaggugugccugucagcaccacaccggugaccaguucugcaaucagcacccuuucaacaacuccuguugacaccagcacaccugugaccacuucuacugaagcccauucaucuccuacaacuucugaagguaccagcaugccaaccucaacuccuagugaaggaaguacuccauuaacauauaugccugucagcaccaugcugguagucaguucugaggauagcacccuuucagcaacuccuguugacaccagcacaccugugaccacuucuacugaagccacuucaucuacaacugcugaagguaccagcauuccaaccucaacuccuagugaaggaaugacuccauuaacuaguguaccugucagcaacacgccgguggccaguucugaggcuagcauccuuucaacaacuccuguugacuccaacacuccuuugaccacuucuacugaagccaguucaucuccucccacugcugaagguaccagcaugccaaccucaacuccuagugaaggaagcacuccauuaacaaguaugccugucagcaccacaacgguggccaguucugaaacgagcacccuuucaacaacuccugcugacaccagcacaccugugaccacuuauucucaagccaguucaucuccuccaauugcugacgguacuagcaugccaaccucaacuuauagugaaggaagcacuccacuaacaaauaugucuuucagcaccacgccaguggucaguucugaggcuagcacccuuuccacaacuccuguugacaccagcacaccugucaccacuucuacugaagccaguuuaucuccuacaacugcugaagguaccagcauaccaaccucaaguccuagugaaggaaccacuccauuagcaaguaugccugucagcaccacgccgguggucaguucugagguuaacacccuuucaacaacuccuguggacuccaacacucuggugaccacuucuacugaagccaguucaucuccuacaaucgcugaagguaccagcuugccaaccucaacuacuagugaaggaagcacuccauuaucaauuaugccucucaguaccacgccgguggccaguucugaggcuagcacccuuucaacaacuccuguugacaccagcacaccugugaccacuucuucuccaaccaauucaucuccuacaacugcugaaguuaccagcaugccaacaucaacugcuggugaaggaagcacuccauuaacaaauaugccugucagcaccacaccgguggccaguucugaggcuagcacccuuucaacaacuccuguugacuccaacacuuuuguuaccaguucuagucaagccaguucaucuccagcaacucuucaggucaccacuaugcguaugucuacuccaagugaaggaagcucuucauuaacaacuaugcuccucagcagcacauaugugaccaguucugaggcuagcacaccuuccacuccuucuguugacagaagcacaccugugaccacuucuacucagagcaauucuacuccuacaccuccugaaguuaucacccugccaaugucaacuccuagugaaguaagcacuccauuaaccauuaugccugucagcaccacaucggugaccauuucugaggcuggcacagcuucaacacuuccuguugacaccagcacaccugugaucacuucuacccaagucaguucaucuccugugacuccugaagguaccaccaugccaaucuggacgccuagugaaggaagcacuccauuaacaacuaugccugucagcaccacacgugugaccagcucugaggguagcacccuuucaacaccuucuguugucaccagcacaccugugaccacuucuacugaagccauuucaucuucugcaacucuugacagcaccaccaugucugugucaaugcccauggaaauaagcacccuugggaccacuauucuugucaguaccacaccuguuacgagguuuccugagaguagcaccccuuccauaccaucuguuuacaccagcaugucuaugaccacugccucugaaggcaguucaucuccuacaacucuugaaggcaccaccaccaugccuaugucaacuacgagugaaagaagcacuuuauugacaacuguccucaucagcccuauaucugugaugaguccuucugaggccagcacacuuucaacaccuccuggugauaccagcacaccuuugcucaccucuaccaaagccgguucauucuccauaccugcugaagucacuaccauacguauuucaauuaccagugaaagaagcacuccauuaacaacucuccuugucagcaccacacuuccaacuagcuuuccuggggccagcauagcuucgacaccuccucuugacacaagcacaacuuuuaccccuucuacugacacugccucaacucccacaauuccuguagccaccaccauaucuguaucagugaucacagaaggaagcacaccugggacaaccauuuuuauucccagcacuccugucaccaguucuacugcugaugucuuuccugcaacaacuggugcuguaucuaccccugugauaacuuccacugaacuaaacacaccaucaaccuccaguaguaguaccaccacaucuuuuucaacuacuaaggaauuuacaacacccgcaaugacuacugcagcuccccucacauaugugaccaugucuacugcccccagcacacccagaacaaccagcagaggcugcacuacuucugcaucaacgcuuucugcaaccaguacaccucacaccucuacuucugucaccacccguccugugaccccuucaucagaauccagcaggccgucaacaauuacuucucacaccaucccaccuacauuuccuccugcucacuccaguacaccuccaacaaccucugccuccuccacgacugugaacccugaggcugucaccaccaugaccaccaggacaaaacccagcacacggaccacuuccuuccccacggugaccaccaccgcuguccccacgaauacuacaauuaagagcaaccccaccucaacuccuacugugccaagaaccacaacaugcuuuggagaugggugccagaauacggccucucgcugcaagaauggaggcaccugggaugggcucaagugccagugucccaaccucuauuauggggaguugugugaggagguggucagcagcauugacauagggccaccggagacuaucucugcccaaauggaacugacugugacagugaccagugugaaguucaccgaagagcuaaaaaaccacucuucccaggaauuccaggaguucaaacagacauucacggaacagaugaauauuguguauuccgggaucccugaguaugucggggugaacaucacaaagcuacgucuuggcaguguggugguggagcaugacguccuccuaagaaccaaguacacaccagaauacaagacaguauuggacaaugccaccgaaguagugaaagagaaaaucacaaaagugaccacacagcaaauaaugauuaaugauauuugcucagacaugauguguuucaacaccacuggcacccaagugcaaaacauuacggugacccaguacgacccugaagaggacugccggaagauggccaaggaauauggagacuacuucguaguggaguaccgggaccagaagccauacugcaucagccccugugagccuggcuucagugucuccaagaacuguaaccucggcaagugccagaugucucuaaguggaccucagugccucugcgugaccacggaaacucacugguacaguggggagaccuguaaccagggcacccagaagagucugguguacggccucgugggggcaggggucgugcugaugcugaucauccugguagcucuccugaugcucguuuuccgcuccaagagagaggugaaacggcaaaaguacagauugucucaguuauacaaguggcaagaagaggacaguggaccagcuccugggaccuuccaaaacauuggcuuugacaucugccaagaugaugauuccauccaccuggaguccaucuauaguaauuuccagcccuccuugagacacauagacccugaaacaaagauccgaauucagaggccucagguaaugacgacaucauuuuaa

SEQ ID NO: 386 - RNA, 1215 nt, Artificial Sequence
  Q9NNX6
augagugacuccaaggaaccaagacugcagcagcugggccuccuggaggaggaacagcugagaggccuuggauuccgacagacucgaggauacaagagcuuagcagggugucuuggccaugguccccuggugcugcaacuccucuccuucacgcucuuggcugggcuccuuguccaaguguccaagguccccagcuccauaagucaggaacaauccaggcaagacgcgaucuaccagaaccugacccagcuuaaagcugcagugggugagcucucagagaaauccaagcugcaggagaucuaccaggagcugacccagcugaaggcugcagugggugagcuuccagagaaaucuaagcugcaggagaucuaccaggagcugacccggcugaaggcugcagugggugagcuuccagagaaaucuaagcugcaggagaucuaccaggagcugaccuggcugaaggcugcagugggugagcuuccagagaaaucuaagaugcaggagaucuaccaggagcugacucggcugaaggcugcagugggugagcuuccagagaaaucuaagcagcaggagaucuaccaggagcugacccggcugaaggcugcagugggugagcuuccagagaaaucuaagcagcaggagaucuaccaggagcugacccggcugaaggcugcagugggugagcuuccagagaaaucuaagcagcaggagaucuaccaggagcugacccagcugaaggcugcaguggaacgccugugccaccccugucccugggaauggacauucuuccaaggaaacuguuacuucaugucuaacucccagcggaacuggcacgacuccaucaccgccugcaaagaagugggggcccagcucgucguaaucaaaagugcugaggagcagaacuuccuacagcugcagucuuccagaaguaaccgcuucaccuggaugggacuuucagaucuaaaucaggaaggcacguggcaauggguggacggcucaccucuguugcccagcuucaagcaguauuggaacagaggagagcccaacaacguuggggaggaagacugcgcggaauuuaguggcaauggcuggaacgacgacaaauguaaucuugccaaauucuggaucugcaaaaaguccgcagccuccugcuccagggaugaagaacaguuucuuucuccagccccugccaccccaaaccccccuccugcguag

SEQ ID NO: 387 - RNA, 3126 nt, Artificial Sequence
  Q9NR97
auggaaaacauguuccuucagucgucaaugcugaccugcauuuuccugcuaauaucugguuccugugaguuaugcgccgaagaaaauuuuucuagaagcuauccuugugaugagaaaaagcaaaaugacucaguuauugcagagugcagcaaucgucgacuacaggaaguuccccaaacggugggcaaauaugugacagaacuagaccugucugauaauuucaucacacacauaacgaaugaaucauuucaagggcugcaaaaucucacuaaaauaaaucuaaaccacaaccccaauguacagcaccagaacggaaaucccgguauacaaucaaauggcuugaauaucacagacggggcauuccucaaccuaaaaaaccuaagggaguuacugcuugaagacaaccaguuaccccaaauacccucugguuugccagagucuuugacagaacuuagucuaauucaaaacaauauauacaacauaacuaaagagggcauuucaagacuuauaaacuugaaaaaucucuauuuggccuggaacugcuauuuuaacaaaguuugcgagaaaacuaacauagaagauggaguauuugaaacgcugacaaauuuggaguugcuaucacuaucuuucaauucucuuucacacgugccacccaaacugccaagcucccuacgcaaacuuuuucugagcaacacccagaucaaauacauuagugaagaagauuucaagggauugauaaauuuaacauuacuagauuuaagcgggaacuguccgaggugcuucaaugccccauuuccaugcgugccuugugaugguggugcuucaauuaauauagaucguuuugcuuuucaaaacuugacccaacuucgauaccuaaaccucucuagcacuucccucaggaagauuaaugcugccugguuuaaaaauaugccucaucugaaggugcuggaucuugaauucaacuauuuagugggagaaauagccucuggggcauuuuuaacgaugcugccccgcuuagaaauacuugacuugucuuuuaacuauauaaaggggaguuauccacagcauauuaauauuuccagaaacuucucuaaacuuuugucucuacgggcauugcauuuaagagguuauguguuccaggaacucagagaagaugauuuccagccccugaugcagcuuccaaacuuaucgacuaucaacuuggguauuaauuuuauuaagcaaaucgauuucaaacuuuuccaaaauuucuccaaucuggaaauuauuuacuugucagaaaacagaauaucaccguugguaaaagauacccggcagaguuaugcaaauaguuccucuuuucaacgucauauccggaaacgacgcucaacagauuuugaguuugacccacauucgaacuuuuaucauuucacccguccuuuaauaaagccacaaugugcugcuuauggaaaagccuuagauuuaagccucaacaguauuuucuucauugggccaaaccaauuugaaaaucuuccugacauugccuguuuaaaucugucugcaaauagcaaugcucaaguguuaaguggaacugaauuuucagccauuccucaugucaaauauuuggauuugacaaacaauagacuagacuuugauaaugcuagugcucuuacugaauuguccgacuuggaaguucuagaucucagcuauaauucacacuauuucagaauagcaggcguaacacaucaucuagaauuuauucaaaauuucacaaaucuaaaaguuuuaaacuugagccacaacaacauuuauacuuuaacagauaaguauaaccuggaaagcaagucccugguagaauuaguuuucaguggcaaucgccuugacauuuuguggaaugaugaugacaacagguauaucuccauuuucaaaggucucaagaaucugacacgucuggauuuaucccuuaauaggcugaagcacaucccaaaugaagcauuccuuaauuugccagcgagucucacugaacuacauauaaaugauaauauguuaaaguuuuuuaacuggacauuacuccagcaguuuccucgucucgaguugcuugacuuacguggaaacaaacuacucuuuuuaacugauagccuaucugacuuuacaucuucccuucggacacugcugcugagucauaacaggauuucccaccuacccucuggcuuucuuucugaagucaguagucugaagcaccucgauuuaaguuccaaucugcuaaaaacaaucaacaaauccgcacuugaaacuaagaccaccaccaaauuaucuauguuggaacuacacggaaaccccuuugaaugcaccugugacauuggagauuuccgaagauggauggaugaacaucugaaugucaaaauucccagacugguagaugucauuugugccaguccuggggaucaaagagggaagaguauugugagucuggagcuaacaacuuguguuucagaugucacugcagugauauuauuuuucuucacguucuuuaucaccaccaugguuauguuggcugcccuggcucaccauuuguuuuacugggauguuugguuuauauauaauguguguuuagcuaagguaaaaggcuacaggucucuuuccacaucccaaacuuucuaugaugcuuacauuucuuaugacaccaaagaugccucuguuacugacugggugauaaaugagcugcgcuaccaccuugaagagagccgagacaaaaacguucuccuuugucuagaggagagggauugggacccgggauuggccaucaucgacaaccucaugcagagcaucaaccaaagcaagaaaacaguauuuguuuuaaccaaaaaauaugcaaaaagcuggaacuuuaaaacagcuuuuuacuuggcuuugcagaggcuaauggaugagaacauggaugugauuauauuuauccugcuggagccaguguuacagcauucucaguauuugaggcuacggcagcggaucuguaagagcuccauccuccaguggccugacaacccgaaggcagaaggcuuguuuuggcaaacucugagaaauguggucuugacugaaaaugauucacgguauaacaauauguaugucgauuccauuaagcaauacuaa

SEQ ID NO: 388 - RNA, 66 nt, Artificial Sequence
  P16671_1_22-87
gggcucaucgcuggggcugucauuggugcuguccuggcuguguuuggagguauucuaaugccaguu

SEQ ID NO: 389 - RNA, 81 nt, Artificial Sequence
  P32248_1_178-258
uuccucccuaucauguacuccaucauuuguuucgugggccuacugggcaaugggcuggucguguugaccuauaucuauuuc

SEQ ID NO: 390 - RNA, 66 nt, Artificial Sequence
  P16671_2_1318-1383
cuccuuggccugauagaaaugaucuuacucaguguugguguggugauguuuguugcuuuuaugauu

SEQ ID NO: 391 - RNA, 63 nt, Artificial Sequence
  P32248_2_286-348
uaccugcucaaccuggcgguggcagacauccucuuccuccugacccuucccuucugggccuac

SEQ ID NO: 392 - RNA, 66 nt, Artificial Sequence
  P32248_3_391-456
cucaucuuugccaucuacaagaugagcuucuucaguggcaugcuccuacuucuuugcaucagcauu

SEQ ID NO: 393 - RNA, 63 nt, Artificial Sequence
  P32248_4_511-573
guccuucucaucagcaagcuguccugugugggcaucuggauacuagccacagugcucuccauc

SEQ ID NO: 394 - RNA, 84 nt, Artificial Sequence
  P32248_5_658-741
uuuaucaccauccagguggcccagauggugaucggcuuucuggucccccugcuggccaugagcuucuguuaccuugucaucauc

SEQ ID NO: 395 - RNA, 78 nt, Artificial Sequence
  P32248_6_790-867
gugaucaucgcuguggucguggucuucauagucuuccagcugcccuacaauggggugguccuggcccagacgguggcc

SEQ ID NO: 396 - RNA, 54 nt, Artificial Sequence
  P32248_7_940-993
cuggccugcguccgcugcugcgucaacccuuucuuguacgccuucaucggcguc

SEQ ID NO: 397 - RNA, 69 nt, Artificial Sequence
  A0A5B9_433-501
accauccucuaugagaucuugcuagggaaggccaccuuguaugccgugcuggucagugcccucgugcug

SEQ ID NO: 398 - RNA, 69 nt, Artificial Sequence
  B7Z8K6_388-456
cuugggcuacgaaugcuguuugcaaagacuguugccgucaauuuucucuugacugccaaguuauuuuuc

SEQ ID NO: 399 - RNA, 63 nt, Artificial Sequence
  O00206_1894-1956
accaucauuggugugucgguccucagugugcuuguaguaucuguuguagcaguucuggucuau

SEQ ID NO: 400 - RNA, 66 nt, Artificial Sequence
  P01730_1189-1254
auggcccugauugugcuggggggcgucgccggccuccugcuuuucauugggcuaggcaucuucuuc

SEQ ID NO: 401 - RNA, 63 nt, Artificial Sequence
  P01850_453-513
auccugcuagggaaggccacccuguaugcugugcuggucagcgcccuuguguugauggccaug

SEQ ID NO: 402 - RNA, 78 nt, Artificial Sequence
  P07766_379-456
gugaugucgguggccacaauugucauaguggacaucugcaucacugggggcuugcugcugcugguuuacuacuggagc

SEQ ID NO: 403 - RNA, 66 nt, Artificial Sequence
  P08575_1726-1791
gcacugauagcauuucuggcauuucugauuauugugacaucaauagcccugcuuguuguucucuac

SEQ ID NO: 404 - RNA, 63 nt, Artificial Sequence
  P08637_625-687
agggggcuuuuugggaguaaaaaugugucuucagagacugugaacaucaccaucacucaaggu

SEQ ID NO: 405 - RNA, 81 nt, Artificial Sequence
  P10747_457-537
uuuugggugcugguggugguugguggaguccuggcuugcuauagcuugcuaguaacaguggccuuuauuauuuucugggug

SEQ ID NO: 406 - RNA, 66 nt, Artificial Sequence
  P11912_432-495
aucaucacagccgaggggaucauccuccuguucugcgcgguggugccugggacgcugcugcuguuc

SEQ ID NO: 407 - RNA, 66 nt, Artificial Sequence
  P15391_874-939
gucucagcugugacuuuggcuuaucugaucuucugccuguguucccuugugggcauucuucaucuu

SEQ ID NO: 408 - RNA, 63 nt, Artificial Sequence
  P16410_484-546
uuccuccucuggauccuugcagcaguuaguucgggguuguuuuuuuauagcuuucuccucaca

SEQ ID NO: 409 - RNA, 63 nt, Artificial Sequence
  P26718_154-216
ccauuuuuuuucugcugcuucaucgcuguagccaugggaauccguuucauuauuaugguagca

SEQ ID NO: 410 - RNA, 63 nt, Artificial Sequence
  P30273_70-132
cucugcuauauccuggaugccauccuguuucuguauggaauuguccucacccuccucuacugu

SEQ ID NO: 411 - RNA, 63 nt, Artificial Sequence
  P40259_478-540
gaugguaucaucaugauccagacgcugcugaucauccucuucaucaucgugccuaucuuccug

SEQ ID NO: 412 - RNA, 63 nt, Artificial Sequence
  P42081_742-804
uggauuacagcuguacuuccaacaguuauuauaugugugaugguuuucugucuaauucuaugg

SEQ ID NO: 413 - RNA, 63 nt, Artificial Sequence
  Q15762_763-825
ggagggacaguuuuauuguuguuguuuguuaucucaauuaccaccaucauugucauuuuccuu

SEQ ID NO: 414 - RNA, 63 nt, Artificial Sequence
  Q685J3_13180-13242
cucgugggggcaggggucgugcugaugcugaucauccugguagcucuccugaugcucguuuuc

SEQ ID NO: 415 - RNA, 63 nt, Artificial Sequence
  Q9NNX6_112-174
cuuggccaugguccccuggugcugcaacuccucuccuucacgcucuuggcugggcuccuuguc

SEQ ID NO: 416 - RNA, 63 nt, Artificial Sequence
  Q9NR97_2482-2544
gcagugauauuauuuuucuucacguucuuuaucaccaccaugguuauguuggcugcccuggcu

SEQ ID NO: 417 - RNA, 48 nt, Artificial Sequence
  P14207_1-16
augguguggaaguggaugccccugcuccugcugcucgucugcguggcc

SEQ ID NO: 418 - RNA, 48 nt, Artificial Sequence
  O75787_1-16
auggccguguucgucgugcugcucgcccugguggcgggcguccugggg

SEQ ID NO: 419 - RNA, 48 nt, Artificial Sequence
  P07359_1-16
augccccugcuccugcugcuccugcugcucccgagcccccugcacccc

SEQ ID NO: 420 - RNA, 48 nt, Artificial Sequence
  P08637_1-16
auguggcagcugcuccugcccaccgcccugcuccugcuggugagcgcc

SEQ ID NO: 421 - RNA, 51 nt, Artificial Sequence
  P07237_1-17
augcugcgccgggcccuccugugccuggccguggcggcccucguccgcgcc

SEQ ID NO: 422 - RNA, 51 nt, Artificial Sequence
  O60911_1-17
augaaccugagccucgugcuggccgccuucugccugggcaucgcguccgcc

SEQ ID NO: 423 - RNA, 51 nt, Artificial Sequence
  P20138_1-17
augccccugcuccugcugcucccgcugcugugggccggcgcccucgcgaug

SEQ ID NO: 424 - RNA, 51 nt, Artificial Sequence
  P27797_1-17
augcugcucagcgugccccugcugcucggccugcuggggcucgccgucgcc

SEQ ID NO: 425 - RNA, 54 nt, Artificial Sequence
  P10747_1-18
augcugcgccuccugcuggcccucaaccuguuccccagcauccaggugaccggc

SEQ ID NO: 426 - RNA, 54 nt, Artificial Sequence
  O75487_1-18
auggcccgcuucggccugcccgcccuccugugcacccuggcggugcucagcgcc

SEQ ID NO: 427 - RNA, 54 nt, Artificial Sequence
  P07996_1-18
augggccuggccugggggcucggcgugcuguuccugaugcacgucugcgggacc

SEQ ID NO: 428 - RNA, 54 nt, Artificial Sequence
  P22748_1-18
augcgcaugcugcucgcccugcuggcccucagcgcggcccggcccuccgccagc

SEQ ID NO: 429 - RNA, 54 nt, Artificial Sequence
  Q15762_1-18
auggacuaccccacccugcuccuggcccugcuccacguguaccgcgcccugugc

SEQ ID NO: 430 - RNA, 54 nt, Artificial Sequence
  P30273_1-18
augauccccgccgugguccugcuccugcugcuccugguggagcaggccgcggcc

SEQ ID NO: 431 - RNA, 54 nt, Artificial Sequence
  P38570_1-18
auguggcuguuccacacccuccugugcaucgccagccuggcccuccuggcggcc

SEQ ID NO: 432 - RNA, 54 nt, Artificial Sequence
  Q01638_1-18
augggcuucuggauccuggccauccucaccauccugauguacagcaccgccgcg

SEQ ID NO: 433 - RNA, 54 nt, Artificial Sequence
  Q9NZQ7_1-18
augcgcaucuucgccguguucaucuucaugaccuacuggcaccuccugaacgcc

SEQ ID NO: 434 - RNA, 57 nt, Artificial Sequence
  P13591_1-19
augcugcagaccaaggaccucaucuggacccuguucuuccugggcacggccgugagc

SEQ ID NO: 435 - RNA, 57 nt, Artificial Sequence
  P26842_1-19
auggcccgcccccacccgugguggcugugcgugcucggcacccuggucgggcugagc

SEQ ID NO: 436 - RNA, 57 nt, Artificial Sequence
  P15391_1-19
augcccccgccccgccuccuguucuuccugcuguuccucacccccauggaggugcgg

SEQ ID NO: 437 - RNA, 57 nt, Artificial Sequence
  Q8NI17_1-19
augauguggaccugggcccuguggaugcuccccagccugugcaaguucucccuggcc

SEQ ID NO: 438 - RNA, 57 nt, Artificial Sequence
  P08571_1-19
auggagcgcgccagcugccugcuccugcugcuccugccccuggugcacgucuccgcc

SEQ ID NO: 439 - RNA, 57 nt, Artificial Sequence
  P05154_1-19
augcagcuguuccuccugcugugccucgugcugcugagcccccagggcgccucccuc

SEQ ID NO: 440 - RNA, 57 nt, Artificial Sequence
  P02787_1-19
augcgccuggccgugggcgcccuccuggucugcgcggugcuggggcucugccuggcc

SEQ ID NO: 441 - RNA, 57 nt, Artificial Sequence
  P02671_1-19
auguucagcaugcgcaucgugugccugguccucuccguggugggcaccgccuggacc

SEQ ID NO: 442 - RNA, 57 nt, Artificial Sequence
  P04216_1-19
augaaccuggccaucagcaucgcccuccugcugaccgugcuccaggucucccgcggc

SEQ ID NO: 443 - RNA, 57 nt, Artificial Sequence
  P00747_1-19
auggagcacaaggaggugguccugcuccugcugcuguuccucaagagcggccagggg

SEQ ID NO: 444 - RNA, 57 nt, Artificial Sequence
  P01764_1-19
auggaguucggccugagcuggcuguuccucguggccauccugaaggggguccagugc

SEQ ID NO: 445 - RNA, 57 nt, Artificial Sequence
  P16150_1-19
auggccacccugcuccugcugcucggcgugcuggucgugagccccgacgcccugggg

SEQ ID NO: 446 - RNA, 57 nt, Artificial Sequence
  Q6DN72_1-19
augcugcucuggaccgccgugcugcuguucguccccugcgugggcaagaccgugugg

SEQ ID NO: 447 - RNA, 57 nt, Artificial Sequence
  Q01151_1-19
augagccgcggccugcagcuccugcugcucuccugcgccuacagccuggcccccgcg

SEQ ID NO: 448 - RNA, 57 nt, Artificial Sequence
  P07093_1-19
augaacuggcaccucccccuguuccugcuggccagcgugacccucccguccaucugc

SEQ ID NO: 449 - RNA, 57 nt, Artificial Sequence
  Q8WWQ8_1-19
augaugcugcagcaccucgugaucuucugccugggccuggucgugcagaacuucugc

SEQ ID NO: 450 - RNA, 60 nt, Artificial Sequence
  Q13291_1-20
auggaccccaagggccugcucagccugaccuucgugcuguuccucucccuggccuucggg

SEQ ID NO: 451 - RNA, 60 nt, Artificial Sequence
  P35225_1-20
auggcccugcuccugaccaccgugaucgcccugacgugccucggcggguucgcgagcccc

SEQ ID NO: 452 - RNA, 60 nt, Artificial Sequence
  P25942_1-20
auggugcgccugccccuccagugcguccuguggggcugccugcucaccgccgugcacccg

SEQ ID NO: 453 - RNA, 60 nt, Artificial Sequence
  P52803_1-20
augcugcacguggagaugcucacccuggucuuccuggugcucuggaugugcguguucagc

SEQ ID NO: 454 - RNA, 60 nt, Artificial Sequence
  Q15116_1-20
augcagaucccccaggccccguggcccguggucugggccgugcugcagcucggcuggcgc

SEQ ID NO: 455 - RNA, 60 nt, Artificial Sequence
  P05556_1-20
augaaccugcagcccaucuucuggaucggccucaucagcuccgugugcugcgucuucgcc

SEQ ID NO: 456 - RNA, 60 nt, Artificial Sequence
  Q12891_1-20
augcgcgccggccccgggccgaccgugacccuggcccucguccuggcgguggccugggcc

SEQ ID NO: 457 - RNA, 60 nt, Artificial Sequence
  Q8IV16_1-20
augaaggcccugggcgccgugcuccuggcgcugcuccugugcgggcgccccggccggggg

SEQ ID NO: 458 - RNA, 60 nt, Artificial Sequence
  Q03167_1-20
augaccagccacuacgugaucgccaucuucgcccugauguccagcugccucgcgaccgcc

SEQ ID NO: 459 - RNA, 60 nt, Artificial Sequence
  Q14246_1-20
augcgcggcuucaaccugcuccuguucugggggugcugcgugaugcacagcugggagggc

SEQ ID NO: 460 - RNA, 60 nt, Artificial Sequence
  P16871_1-20
augaccauccugggcaccacguucgggaugguguucagccuccugcaggucguguccggc

SEQ ID NO: 461 - RNA, 60 nt, Artificial Sequence
  P61769_1-20
augagccgcuccguggcccuggccguccucgcgcugcugagccucuccggccuggaggcc

SEQ ID NO: 462 - RNA, 60 nt, Artificial Sequence
  Q9Y6W8_1-20
augaagagcggccugugguacuucuuccucuucugccugcgcaucaaggugcugaccggg

SEQ ID NO: 463 - RNA, 63 nt, Artificial Sequence
  P10966_1-21
augcgcccccggcuguggcuccugcuggccgcccagcucaccgugcugcacggcaacagcguc

SEQ ID NO: 464 - RNA, 63 nt, Artificial Sequence
  Q9BZW8_1-21
augcugggccagguggucacccucauccugcugcuccugcugaagguguaccaggggaagggc

SEQ ID NO: 465 - RNA, 63 nt, Artificial Sequence
  P02778_1-21
augaaccagaccgccauccugaucugcugccucaucuuccugacccugagcggcauccagggg

SEQ ID NO: 466 - RNA, 63 nt, Artificial Sequence
  P18564_1-21
augggcaucgagcugcucugccuguucuuccuguuccucgggcgcaacgaccacgugcagggc

SEQ ID NO: 467 - RNA, 63 nt, Artificial Sequence
  O14525_1-21
auggcccuggccggccucugcgcgcugcuggccugcugcugggggcccgccgccgugcucgcc

SEQ ID NO: 468 - RNA, 63 nt, Artificial Sequence
  P01130_1-21
augggccccuggggguggaagcugcgcuggaccguggcccuccugcuggccgcggccggcacc

SEQ ID NO: 469 - RNA, 63 nt, Artificial Sequence
  P01732_1-21
auggcccugcccgugaccgcccuccugcugccgcucgcgcugcugcuccacgccgcccgcccc

SEQ ID NO: 470 - RNA, 63 nt, Artificial Sequence
  P48061_1-21
augaacgccaagguggucguggugcugguccucgugcugaccgcccugugccucagcgacggc

SEQ ID NO: 471 - RNA, 63 nt, Artificial Sequence
  P01589_1-21
auggacagcuaccugcucauguggggccugcugaccuucaucauggugcccgggugccaggcc

SEQ ID NO: 472 - RNA, 63 nt, Artificial Sequence
  Q86T13_1-21
augcgccccgccuucgcccugugccuccuguggcaggcgcuguggccgggccccgggggcggg

SEQ ID NO: 473 - RNA, 63 nt, Artificial Sequence
  Q5DID0_1-21
augcugcgcaccagcggccucgcccugcuggcccucguguccgcggucgggcccagccaggcc

SEQ ID NO: 474 - RNA, 66 nt, Artificial Sequence
  P40189_1-22
augcugacccuccagaccuggcuggugcaggcccuguucaucuuccucacgaccgagagcaccggc

SEQ ID NO: 475 - RNA, 66 nt, Artificial Sequence
  Q86YL7_1-22
auguggaaggugagcgcccuccuguucguccugggcuccgccagccugugggugcucgcggagggg

SEQ ID NO: 476 - RNA, 66 nt, Artificial Sequence
  P55075_1-22
augggcagcccccgcuccgcccugagcugccuccugcugcaccuccuggugcugugccuccaggcc

SEQ ID NO: 477 - RNA, 66 nt, Artificial Sequence
  Q30201_1-22
augggcccccgcgcccggccggcccugcuccugcugaugcuccugcagaccgcggugcugcagggg

SEQ ID NO: 478 - RNA, 66 nt, Artificial Sequence
  P07766_1-22
augcagagcggcacccacuggcgcgugcuggggcucugccugcuguccgucggcgugugggggcag

SEQ ID NO: 479 - RNA, 66 nt, Artificial Sequence
  P18827_1-22
augcgccgggccgcccuguggcucuggcugugcgcgcuggcccucagccugcagcccgcccugccg

SEQ ID NO: 480 - RNA, 66 nt, Artificial Sequence
  P55290_1-22
augcagccccgcaccccgcuggugcucugcguccugcugagccaggugcuccugcugaccuccgcc

SEQ ID NO: 481 - RNA, 66 nt, Artificial Sequence
  P37173_1-22
augggccgcgggcugcuccggggccuguggccccugcacaucgugcucuggacccgcaucgccagc

SEQ ID NO: 482 - RNA, 66 nt, Artificial Sequence
  Q07325_1-22
augaagaagagcggcgugcuguuccuccuggggaucauccugcucguccugaucggcgugcagggg

SEQ ID NO: 483 - RNA, 66 nt, Artificial Sequence
  P04156_1-22
auggccaaccugggcugcuggaugcucgugcuguucgucgccaccuggagcgaccuggggcucugc

SEQ ID NO: 484 - RNA, 66 nt, Artificial Sequence
  P31785_1-22
augcugaagcccagccucccguucaccucccugcuguuccuccagcugccccugcucggcgugggg

SEQ ID NO: 485 - RNA, 69 nt, Artificial Sequence
  P01579_1-23
augaaguacaccagcuacauccuggccuuccagcucugcaucgugcugggcucccuggggugcuacugc

SEQ ID NO: 486 - RNA, 69 nt, Artificial Sequence
  P23229_1-23
auggccgccgcgggccagcugugccuccuguaccugagcgccgggcuccugucccgccugggcgccgcc

SEQ ID NO: 487 - RNA, 69 nt, Artificial Sequence
  O60494_1-23
augaugaacaugagccugcccuuccucuggucccugcugacccuccugaucuucgccgaggugaacggc

SEQ ID NO: 488 - RNA, 69 nt, Artificial Sequence
  P08575_1-23
auguaccuguggcucaagcugcuggccuucggcuucgccuuccucgacaccgagguguucgucaccggg

SEQ ID NO: 489 - RNA, 69 nt, Artificial Sequence
  Q8IWY4_1-23
augggcgccgccgcggugcgcuggcaccugugcguccuccuggcccuggggacccggggccgccucgcc

SEQ ID NO: 490 - RNA, 69 nt, Artificial Sequence
  Q08431_1-23
augccccgcccgcggcugcucgccgcccugugcggcgcgcugcucugcgcccccagccugcugguggcc

SEQ ID NO: 491 - RNA, 69 nt, Artificial Sequence
  Q99665_1-23
auggcccacaccuuccgcggcugcagccuggccuucauguucaucaucaccuggcuccugaucaaggcg

SEQ ID NO: 492 - RNA, 69 nt, Artificial Sequence
  Q6Q8B3_1-23
augagcgccccccgccugcucaucuccaucaucaucauggugagcgccuccagcuccagcugcaugggc

SEQ ID NO: 493 - RNA, 69 nt, Artificial Sequence
  Q07011_1-23
augggcaacagcugcuacaacaucguggccacccugcuccugguccugaacuucgagcgcacccggucc

SEQ ID NO: 494 - RNA, 69 nt, Artificial Sequence
  Q8NHL6_1-23
augacccccauccugaccgugcucaucugccugggccugagccucgggccgcgcacgcacguccaggcc

SEQ ID NO: 495 - RNA, 69 nt, Artificial Sequence
  P36894_1-23
augccccagcuguacaucuacauccgccuccugggcgccuaccuguucaucaucagccgggugcagggg

SEQ ID NO: 496 - RNA, 69 nt, Artificial Sequence
  Q16552_1-23
augacccccggcaagaccagccuggugucccuccugcugcuccugagccuggaggccaucgucaaggcc

SEQ ID NO: 497 - RNA, 69 nt, Artificial Sequence
  P42081_1-23
auggacccccagugcaccaugggccugagcaacauccucuucgugauggccuuccugcuguccggggcc

SEQ ID NO: 498 - RNA, 69 nt, Artificial Sequence
  P43121_1-23
augggccugccccgccucgugugcgccuuccugcuggccgcgugcugcugcugcccgcgggucgccggg

SEQ ID NO: 499 - RNA, 69 nt, Artificial Sequence
  O00206_1-23
augaugagcgccucccgccuggccggcacccucauccccgcgauggccuuccugagcugcgugcggccg

SEQ ID NO: 500 - RNA, 69 nt, Artificial Sequence
  P42701_1-23
auggagccccuggugaccugggucgugccgcuccuguuccuguuccuccugagccgccagggcgccgcc

SEQ ID NO: 501 - RNA, 72 nt, Artificial Sequence
  P06729_1-24
augagcuuccccugcaaguucguggccuccuuccugcucaucuucaacgucagcuccaagggcgccgugagc

SEQ ID NO: 502 - RNA, 72 nt, Artificial Sequence
  P15328_1-24
auggcccagcgcaugaccacccagcugcuccugcugcucgugugggucgccguggugggcgaggcgcagacg

SEQ ID NO: 503 - RNA, 72 nt, Artificial Sequence
  P05112_1-24
augggccugaccagccagcuccugcccccgcuguucuuccuccuggccugcgccgggaacuucgugcacggc

SEQ ID NO: 504 - RNA, 72 nt, Artificial Sequence
  P06127_1-24
augcccaugggcagccugcagccgcucgccacccuguaccugcucgggaugcugguggccuccugccugggc

SEQ ID NO: 505 - RNA, 72 nt, Artificial Sequence
  P32248_1-24
auggaccugggcaagcccaugaagagcgugcucgucguggcccugcuggugaucuuccaggucugccucugc

SEQ ID NO: 506 - RNA, 72 nt, Artificial Sequence
  Q7Z7D3_1-24
auggccagccugggccagauccucuucugguccaucaucagcaucaucaucauccuggccggggcgaucgcc

SEQ ID NO: 507 - RNA, 72 nt, Artificial Sequence
  P54756_1-24
augcgcggcagcgggccccggggcgccgggcgccggcgcccgcccuccggcgggggcgacacccccaucacc

SEQ ID NO: 508 - RNA, 72 nt, Artificial Sequence
  Q92823_1-24
augcagcugaagaucaugcccaagaagaagcgccucagcgccggccgggugccgcugauccuguuccucugc

SEQ ID NO: 509 - RNA, 72 nt, Artificial Sequence
  P19320_1-24
augcccggcaagaugguggucauccugggggccagcaacauccucuggaucauguucgccgcgucccaggcc

SEQ ID NO: 510 - RNA, 72 nt, Artificial Sequence
  Q86UN2_1-24
augcugcgcaagggcugcugcguggagcuccugcugcuccuggucgccgccgagcugccccucgggggcggg

SEQ ID NO: 511 - RNA, 75 nt, Artificial Sequence
  P33151_1-25
augcagcgccugaugaugcuccuggccaccagcggcgccugccuggggcuccuggcgguggccgccgucgccgcc

SEQ ID NO: 512 - RNA, 75 nt, Artificial Sequence
  P17813_1-25
auggaccgcggcacccugccccucgccguggcccugcugcucgcgagcugcucccugagcccgaccucccuggcc

SEQ ID NO: 513 - RNA, 75 nt, Artificial Sequence
  P25445_1-25
augcugggcaucuggacccuccugccccuggugcucaccagcgucgcccgccuguccagcaaguccgugaacgcc

SEQ ID NO: 514 - RNA, 75 nt, Artificial Sequence
  P01730_1-25
augaaccgcggcgugcccuuccggcaccuccugcugguccugcagcucgcccugcugccggccgcgacccagggg

SEQ ID NO: 515 - RNA, 75 nt, Artificial Sequence
  Q685J3_1-25
augccccgccccggcaccauggcccugugccuccugacccuggugcucagccugcugccgccccaggccgcggcc

SEQ ID NO: 516 - RNA, 75 nt, Artificial Sequence
  P17787_1-25
auggcccgccggugcggccccguggcccugcuccugggguucggccugcuccgccugugcagcggggucuggggc

SEQ ID NO: 517 - RNA, 75 nt, Artificial Sequence
  Q6UQ28_1-25
auggccguguuccacgacaugcugcuccagccccugggcauguuccugugccucagccugcagcuguccagcgcc

SEQ ID NO: 518 - RNA, 75 nt, Artificial Sequence
  P13987_1-25
augggcauccagggcgggagcgugcuguucgggcuccugcugguccucgccguguucugccacuccggccacagc

SEQ ID NO: 519 - RNA, 75 nt, Artificial Sequence
  P10721_1-25
augcgcggcgcccgcggggccugggacuuccugugcgugcuccugcugcuccugcggguccagaccggcagcucc

SEQ ID NO: 520 - RNA, 75 nt, Artificial Sequence
  P12319_1-25
auggcccccgccauggagagcccgacccugcucugcguggcgcugcuguucuucgcccccgacggcguccucgcc

SEQ ID NO: 521 - RNA, 78 nt, Artificial Sequence
  Q9BZR6_1-26
augaagcgcgccagcgccggcgggucccggcugcucgcgugggugcuguggcugcaggccuggcaggucgccgccccc

SEQ ID NO: 522 - RNA, 78 nt, Artificial Sequence
  P25063_1-26
augggccgcgccaugguggcccggcuggggcucggccugcugcuccuggcgcugcuccugcccacccagaucuacagc

SEQ ID NO: 523 - RNA, 78 nt, Artificial Sequence
  Q9NR97_1-26
auggagaacauguuccugcagagcuccaugcugaccugcaucuuccuccugaucagcggcuccugcgagcucugcgcc

SEQ ID NO: 524 - RNA, 78 nt, Artificial Sequence
  Q8N131_1-26
augggccugggggcccgcggcgccugggcggcccuccugcuggggacccuccaggugcuggcccugcucggcgccgcc

SEQ ID NO: 525 - RNA, 78 nt, Artificial Sequence
  P49771_1-26
augaccgugcuggcccccgccuggagcccgaccacguaccuccugcugcuccugcugcucuccagcggccuguccggg

SEQ ID NO: 526 - RNA, 78 nt, Artificial Sequence
  P02679_1-26
augagcuggucccugcacccccgcaaccucauccuguacuucuacgcccugcucuuccugagcuccaccugcguggcc

SEQ ID NO: 527 - RNA, 78 nt, Artificial Sequence
  P14784_1-26
auggccgcccccgcgcugagcuggcgccucccgcugcugauccuccugcugccccucgccaccuccugggccagcgcc

SEQ ID NO: 528 - RNA, 81 nt, Artificial Sequence
  P05362_1-27
auggcccccagcuccccgcgccccgcccugcccgcgcuccuggugcugcucggcgcccuguuccccgggccgggcaacgcc

SEQ ID NO: 529 - RNA, 81 nt, Artificial Sequence
  Q13740_1-27
auggagagcaagggcgccuccagcugccgccuccuguucugccugcugaucuccgccaccguguuccggcccgggcucggc

SEQ ID NO: 530 - RNA, 84 nt, Artificial Sequence
  Q13443_1-28
augggcagcggggcccgcuuccccuccggcacccugcgggugcgcuggcuccugcugcucgggcuggucggcccggugcugggg

SEQ ID NO: 531 - RNA, 84 nt, Artificial Sequence
  P14151_1-28
augaucuuccccuggaagugccagagcacccagcgcgaccuguggaacaucuucaagcucuggggcuggaccaugcugugcugc

SEQ ID NO: 532 - RNA, 84 nt, Artificial Sequence
  P56199_1-28
auggcgccccgcccgcgggcccgccccggcguggccgucgccugcugcuggcugcucaccguggugcugcggugcugcgucagc

SEQ ID NO: 533 - RNA, 84 nt, Artificial Sequence
  P11279_1-28
auggccgcccccggcagcgcgcgccggccgcugcuccugcugcuccugcugcuccugcuggggcucaugcacugcgccuccgcc

SEQ ID NO: 534 - RNA, 84 nt, Artificial Sequence
  P40259_1-28
auggcccgccuggcccucagccccgugccgucccacuggauggucgcgcugcugcuccugcugagcgccgagcccgugcccgcc

SEQ ID NO: 535 - RNA, 84 nt, Artificial Sequence
  P43681_1-28
auggagcugggcgggcccggcgccccgcgccuccugcccccccugcuccugcugcucgggaccggccugcugcgggccagcucc

SEQ ID NO: 536 - RNA, 84 nt, Artificial Sequence
  P18627_1-28
augugggaggcccaguuccugggccuccuguuccugcagccccucuggguggccccggucaagccccugcagcccggggcggag

SEQ ID NO: 537 - RNA, 84 nt, Artificial Sequence
  Q5ZPR3_1-28
augcugcgccggcgcggcagccccgggaugggcgugcacgucggggccgcccucggcgcgcugugguucugccugaccggggcc

SEQ ID NO: 538 - RNA, 84 nt, Artificial Sequence
  P23415_1-28
auguacagcuucaacacccugcgccucuaccugugggagaccaucguguucuucucccuggccgccagcaaggaggcggaggcc

SEQ ID NO: 539 - RNA, 84 nt, Artificial Sequence
  Q8TD46_1-28
augcugugccccuggcgcaccgccaaccucggccugcugcucauccugaccaucuuccugguggccgcgagcuccagccucugc

SEQ ID NO: 540 - RNA, 87 nt, Artificial Sequence
  P17301_1-29
augggccccgagcgcaccggggccgccccgcugccccuccugcuggugcucgcgcugagccagggcauccugaacugcugccucgcc

SEQ ID NO: 541 - RNA, 87 nt, Artificial Sequence
  P12821_1-29
augggcgccgccagcgggcgccggggccccgggcugcuccugccgcugccccuccugcugcuccugccgccccagcccgcgcuggcc

SEQ ID NO: 542 - RNA, 87 nt, Artificial Sequence
  Q14118_1-29
augcgcaugagcgugggccugucccuccugcugccccucugggggcggaccuuccugcugcuccugagcgucgugauggcccagucc

SEQ ID NO: 543 - RNA, 87 nt, Artificial Sequence
  P05231_1-29
augaacagcuucuccaccagcgccuucggccccguggccuucucccuggggcuccugcugguccucccggcggccuuccccgccccc

SEQ ID NO: 544 - RNA, 87 nt, Artificial Sequence
  O00602_1-29
auggagcugagcggcgccaccauggcccgcgggcucgcggugcugcugguccucuuccugcacaucaagaaccugcccgcccaggcc

SEQ ID NO: 545 - RNA, 87 nt, Artificial Sequence
  Q9Y6Q6_1-29
auggcgccccgcgcccggcgccggcgcccgcuguucgcccuccugcugcucugcgcccugcuggcccggcuccagguggcccugcag

SEQ ID NO: 546 - RNA, 87 nt, Artificial Sequence
  Q9ULI3_1-29
auggccagcccccgcgccucccgguggcccccgccccugcuccugcugcuccugccccugcuccugcugccgcccgcggcccccggc

SEQ ID NO: 547 - RNA, 90 nt, Artificial Sequence
  Q8NBP7_1-30
augggcaccgugagcucccgccggagcugguggccccugccgcuccugcugcuccugcugcuccugcuggggcccgccggcgcccgcgcg

SEQ ID NO: 548 - RNA, 90 nt, Artificial Sequence
  P02675_1-30
augaagcgcauggugagcugguccuuccacaagcugaagaccaugaagcaccuccugcugcuccugcugugcguguuccucgucaagagc

SEQ ID NO: 549 - RNA, 90 nt, Artificial Sequence
  P06756_1-30
auggccuucccgccccgccggcgccugcggcucggcccccgcgggcugccccugcuccugagcggccugcuccugccccugugccgggcc

SEQ ID NO: 550 - RNA, 93 nt, Artificial Sequence
  O60609_1-31
auggugcgcccccugaacccccggccccucccgcccgucgugcugaugcugcuccugcugcucccgcccagcccccugccccuggccgccggc

SEQ ID NO: 551 - RNA, 93 nt, Artificial Sequence
  P50895_1-31
auggagcccccggacgcccccgcccaggcgcgcggcgcgccccggcugcuccugcuggccgugcuccuggccgcccaccccgacgcccaggcc

SEQ ID NO: 552 - RNA, 93 nt, Artificial Sequence
  P28906_1-31
augcuggugcgccggggcgcccgcgccgggccccggaugccgcgcggcuggaccgcgcucugccugcugagccuccugcccuccggguucaug

SEQ ID NO: 553 - RNA, 93 nt, Artificial Sequence
  P08514_1-31
auggcccgcgcccugugcccccuccaggcgcuguggcugcucgagugggugcugcugcuccugggccccugcgccgccccgcccgccugggcc

SEQ ID NO: 554 - RNA, 93 nt, Artificial Sequence
  P00742_1-31
augggccgcccccugcaccucgugcugcugagcgccucccucgccgggcugcugcuccugggcgagagccuguucauccggcgcgagcaggcg

SEQ ID NO: 555 - RNA, 96 nt, Artificial Sequence
  P26006_1-32
augggccccgggcccagccgcgccccgcgggcgccccgccugaugcucugcgcccuggcccugaugguggccgccggcgggugcgucguguccgcc

SEQ ID NO: 556 - RNA, 96 nt, Artificial Sequence
  P13726_1-32
auggagacccccgccuggccgcgcgugccccggcccgagaccgccgucgcgcgcacgcugcuccugggcuggguguucgcccagguggccggggcc

SEQ ID NO: 557 - RNA, 96 nt, Artificial Sequence
  P11912_1-32
augcccggcgggccgggcgugcugcaggcccuccccgccaccaucuuccugcuguuccuccugagcgcggucuaccuggggcccggcugccaggcc

SEQ ID NO: 558 - RNA, 96 nt, Artificial Sequence
  Q9H6X2_1-32
auggccaccgccgagcgccgggcgcugggcaucggguuccaguggcucagccuggccacccuggugcucaucugcgccggccagggcgggcgccgg

SEQ ID NO: 559 - RNA, 99 nt, Artificial Sequence
  Q8IWK6_1-33
auggagcccccgggccgccggcgcgggcgggcccagcccccccugcuccugccccugagccuccuggcccugcucgcgcugcugggcgggggcgggggc

SEQ ID NO: 560 - RNA, 99 nt, Artificial Sequence
  P58335_1-33
augguggccgagcgcagccccgcccgguccccgggcagcuggcuguuccccgggcucuggcugcugguccucuccggccccgggggccugcugcgcgcg

SEQ ID NO: 561 - RNA, 102 nt, Artificial Sequence
  P06731_1-34
auggagagccccuccgccccgccccaccgcuggugcauccccuggcagcggcugcuccugaccgccagccugcucaccuucuggaacccgcccacgaccgcg

SEQ ID NO: 562 - RNA, 102 nt, Artificial Sequence
  P33681_1-34
augggccacacccgccggcaggggaccagccccuccaagugcccguaccugaacuucuuccagcuccuggugcuggccggccucagccacuucugcuccggg

SEQ ID NO: 563 - RNA, 105 nt, Artificial Sequence
  P38567_1-35
augggcgugcugaaguucaagcacaucuucuuccgcagcuucgucaaguccagcggggugucccagaucguguucaccuuccuccugauccccugcugccugacc

SEQ ID NO: 564 - RNA, 105 nt, Artificial Sequence
  P16410_1-35
auggccugccugggcuuccagcgccacaaggcccagcucaaccuggcgacccggaccuggcccugcacgcuccuguucuuccugcuguucaucccgguguucugc

SEQ ID NO: 565 - RNA, 111 nt, Artificial Sequence
  P15814_1-37
augcgccccggcaccgggcagggcgggcuggaggccccgggcgagcccgggcccaaccuccggcagcgcuggccccugcugcuccugggccuggccguggucacccacggc

SEQ ID NO: 566 - RNA, 114 nt, Artificial Sequence
  Q92956_1-38
auggagcccccgggcgacugggggcccccgcccuggcgcagcacccccaagaccgacgugcugcggcucguccuguaccugacguuccucggcgcccccugcuacgcccccgcg

SEQ ID NO: 567 - RNA, 123 nt, Artificial Sequence
  Q86VB7_1-41
augagcaagcugcgcauggugcuccuggaggacuccggcagcgccgacuuccggcgccacuucgucaaccugucccccuucaccaucaccguggugcuccugcugagcgccugcuucgucacg

SEQ ID NO: 568 - RNA, 123 nt, Artificial Sequence
  P08648_1-41
augggcucccgcacccccgagagcccccugcacgccgugcagcuccggugggggccccgccggcgcccgccccugcugccccuccugcugcuccugcugcccccgccgccccgggucggcggg

SEQ ID NO: 569 - RNA, 123 nt, Artificial Sequence
  P16109_1-41
auggccaacugccagaucgccauccuguaccagcgcuuccagcggguggucuucggcaucagccagcuccugugcuucuccgcgcugaucagcgagcucaccaaccagaaggagguggccgcc

SEQ ID NO: 570 - RNA, 132 nt, Artificial Sequence
  O75326_1-44
augaccccgcccccgcccggccgcgccgcccccagcgcgccccgggcccgcgugcccgggccgcccgcccggcugggccucccccugcgccugcggcuccugcugcuccugugggccgccgcggccuccgcc

SEQ ID NO: 571 - RNA, 135 nt, Artificial Sequence
  Q8N2Q7_1-45
auggcccugccccgcugcaccuggccgaacuacguguggcgggccgucauggccugccucgugcaccgcggccugggggcgccccugacccucugcaugcugggcugccugcuccaggccgggcacgugcugagc

SEQ ID NO: 572 - RNA, 138 nt, Artificial Sequence
  Q86UN3_1-46
augcugcccggccuccgccggcugcugcaggccccggccagcgcgugccuccugcugaugcuccuggcccugccccucgccgcccccuccugccccaugcugugcaccugcuacagcuccccgcccaccgugagcugc

SEQ ID NO: 573 - RNA, 540 nt, Artificial Sequence
  A0A5B9
auggaccugaagaacguguucccgcccgaggucgccguguucgagcccagcgaggccgagaucucccacacccagaaggcgacccucgugugccuggccacgggcuucuaccccgaccacgucgagcugagcuggugggugaacgggaaggaggugcacuccggcgucagcaccgacccccagccgcucaaggagcagcccgcccugaacgacucccgcuacugccugagcucccggcuccgcgugagcgccaccuucuggcagaacccccggaaccacuuccgcugccaggugcaguucuacgggcuguccgagaacgacgaguggacccaggaccgggccaagcccgucacgcagaucgugagcgcggaggccuggggccgcgccgacugcggguucaccuccgagagcuaccagcagggcgugcuguccgccaccauccucuacgagauccugcugggcaaggcgacccucuacgccguccuggugagcgcccuggugcucauggccauggucaagcggaaggacucccgcggguga

SEQ ID NO: 574 - RNA, 465 nt, Artificial Sequence
  B7Z8K6
augagccagccccacaccaagccguccguguucgucaugaagaacggcaccaacguggccugccuggugaaggaguucuaccccaaggacauccgcaucaaccucgucagcuccaagaagaucacggaguucgaccccgccaucgugaucagccccuccgggaaguacaacgcggugaagcugggcaaguacgaggacagcaacuccgugaccugcagcguccagcacgacaacaagaccgugcacuccaccgacuucgaggucaagacggacagcaccgaccacgugaagccgaaggagaccgagaacaccaagcagcccuccaagagcugccacaagcccaaggccaucgugcacacggagaaggucaacaugaugucccugaccgugcucgggcugcggaugcuguucgccaagaccguggccgucaacuuccuccugaccgccaagcuguucuuccucuga

SEQ ID NO: 575 - RNA, 645 nt, Artificial Sequence
  B9A064
augcgccccaagaccggccagguggggugcgagaccccggaggagcugggccccgggccccggcagcgcuggccccuccugcugcucggccuggccauggucgcccacgggcugcuccggccgaugguggcgccccagagcggcgaccccgaccccggcgccuccguggggagcucccgcagcucccugcggagccuguggggccgccuccugcugcagccgagcccccagcgggccgacccccgcugcuggccccggggguucugguccgagccgcagucccucugcuacgucuucggcacggggaccaaggugaccgugcugggccagcccaaggccaaccccaccgucacgcuguucccgcccagcuccgaggagcuccaggccaacaaggcgacccuggugugccugaucagcgacuucuaccccggcgccgugaccgucgccuggaaggccgacgggucccccgugaaggcgggcguggagaccacgaagcccagcaagcaguccaacaacaaguacgccgccagcuccuaccucagccugaccccggagcaguggaagucccaccgcagcuacagcugccaggucacccacgagggguccaccguggagaagacgguggcccccaccgagugcagcuga

SEQ ID NO: 576 - RNA, 2520 nt, Artificial Sequence
  O00206
augaugagcgccucccgccuggccggcacccucauccccgcgauggccuuccugagcugcgugcggccggaguccugggagcccugcgucgagguggugcccaacaucaccuaccagugcauggagcugaacuucuacaagauccccgacaaccucccguucagcacgaagaaccuggaccuguccuucaacccccuccgccaccuggggagcuacuccuucuucagcuuccccgagcugcagguccucgaccugucccggugcgagauccagaccaucgaggacggcgccuaccagagccugucccaccucagcacccugauccugaccgggaaccccauccagucccucgcccugggcgccuucagcgggcuguccagccuccagaagcugguggcgguggagacgaaccuggccucccucgagaacuucccgaucggccaccugaagacccugaaggagcucaacgucgcccacaaccugauccagagcuucaagcugcccgaguacuucuccaaccucaccaaccuggagcaccuggaccucagcagcaacaagauccaguccaucuacugcaccgaccugcgcgugcugcaccagaugccccuccugaaccugagccucgaccugucccugaaccccaugaacuucauccagccgggcgccuucaaggagauccggcuccacaagcugacgcugcgcaacaacuucgacagccucaacgugaugaagaccugcauccaggggcuggcgggccuggagguccaccggcucgugcugggggaguuccgcaacgagggcaaccuggagaaguucgacaaguccgcccucgaggggcugugcaaccugaccaucgaggaguuccggcuggccuaccucgacuacuaccuggacgacaucaucgaccuguucaacugccucaccaacgugagcuccuucagccuggucuccgugacgaucgagcgcgugaaggacuucagcuacaacuucggcuggcagcaccuggagcucgucaacugcaaguucggccaguuccccacccugaagcugaagucccucaagcggcugaccuucaccagcaacaagggcgggaacgccuucuccgagguggaccugcccagccucgaguuccuggaccugucccgcaacgggcucagcuucaagggcugcugcucccagagcgacuucggcacgaccucccugaaguaccuggaccucagcuucaacggggugaucaccaugagcuccaacuuccugggccuggagcagcucgagcaccuggacuuccagcacagcaaccugaagcagauguccgaguucagcgucuuccucucccugcggaaccugaucuaccucgacaucagccacacccacacgcgcguggccuucaacgggaucuucaacggccuguccagccuggaggugcucaagauggcggggaacuccuuccaggagaacuuccugcccgacaucuucaccgagcugcggaaccucaccuuccuggaccugagccagugccagcucgagcagcuguccccgaccgccuucaacagccuguccagccuccagguccugaacaugucccacaacaacuucuucagccuggacacguuccccuacaagugccucaacucccuccaggugcuggacuacagccugaaccacaucaugaccagcaagaagcaggagcugcagcacuuccccuccagccuggccuuccucaaccugacccagaacgacuucgccugcacgugcgagcaccaguccuuccugcaguggaucaaggaccagcgccagcuccugguggaggucgagcggauggagugcgccacccccagcgacaagcagggcaugccggugcugucccucaacaucacgugccagaugaacaagaccaucaucggcgucagcgugcuguccgugcuggucgugagcguggucgcggugcucguguacaaguucuacuuccaccugaugcugcucgccgggugcaucaaguacggccgcggggagaacaucuacgacgccuucgucaucuacuccagccaggacgaggacugggugcggaacgagcuggugaagaaccuggaggagggcgucccgcccuuccagcucugccugcacuaccgcgacuucauccccgggguggccaucgccgcgaacaucauccacgagggcuuccacaagucccggaaggugaucgucguggugagccagcacuucauccagucccgcuggugcaucuucgaguacgagaucgcccagaccuggcaguuccugagcucccgcgccggcaucaucuucaucguccuccagaagguggagaagacccugcugcggcagcaggucgagcucuaccgccugcugagccggaacaccuaccucgagugggaggacuccgugcuggggcgccacaucuucuggcggcgccugcggaaggcccuccuggacggcaagagcuggaaccccgaggggaccgugggcaccgggugcaacuggcaggaggccacguccaucuga

SEQ ID NO: 577 - RNA, 1377 nt, Artificial Sequence
  P01730
augaaccgcggcgugcccuuccggcaccuccuccugguccugcagcucgcccugcugccggccgcgacccaggggaagaagguggugcucggcaagaagggggacaccgucgagcugacgugcaccgccagccagaagaaguccauccaguuccacuggaagaacagcaaccagaucaagauccugggcaaccagggguccuuccucaccaagggccccagcaagcugaacgaccgcgccgacucccggcgcagccugugggaccagggcaacuucccccucaucaucaagaaccugaagaucgaggacuccgacaccuacaucugcgagguggaggaccagaaggaggaggugcagcugcucgucuucgggcugacggccaacagcgacacccaccuccugcagggccagucccugacccugacccucgagagcccgcccggguccagccccuccgugcagugccggagcccccgcggcaagaacauccagggcgggaagacgcuguccgugagccagcuggagcuccaggacuccggcaccuggaccugcaccguccugcagaaccagaagaagguggaguucaagaucgacaucgugguccuggccuuccagaaggcgagcuccaucguguacaagaaggagggggagcaggucgaguucagcuucccccucgccuucacgguggagaagcugaccggcagcggggagcugugguggcaggccgagcgggccuccagcuccaagagcuggaucaccuucgaccucaagaacaaggagguguccgugaagcgcgucacccaggacccgaagcugcagaugggcaagaagcugccccuccaccugacgcugccccaggcgcucccccaguacgccggcagcgggaaccugacccuggcccucgaggccaagaccggcaagcugcaccaggaggugaaccugguggucaugcgggccacccagcuccagaagaaccugacgugcgaggugugggggccgaccucccccaagcugaugcucagccugaagcuggagaacaaggaggcgaagguguccaagcgcgagaaggccgucugggugcucaaccccgaggccggcauguggcagugccugcugagcgacuccgggcagguccugcucgagagcaacaucaaggugcugcccaccugguccaccccggugcagcccauggcccugaucguccucggcggcguggccgggcugcugcuguucaucggccuggggaucuucuucugcgugcggugccgccaccggcgccggcaggcggagcgcaugagccagaucaagcggcugcucuccgagaagaagacgugccagugcccccaccgcuuccagaagaccugcagccccaucuga

SEQ ID NO: 578 - RNA, 537 nt, Artificial Sequence
  P01850
auggaggaccugaacaagguguucccgcccgaggucgccguguucgagcccagcgaggccgagaucucccacacccagaaggcgacccucgugugccuggccacgggcuucuuccccgaccacgucgagcugagcuggugggugaacgggaaggaggugcacuccggcgucagcaccgacccccagccgcucaaggagcagcccgcccugaacgacucccgcuacugccugagcucccggcuccgcgugagcgccaccuucuggcagaacccccggaaccacuuccgcugccaggugcaguucuacgggcuguccgagaacgacgaguggacccaggaccgggccaagcccgucacgcagaucgugagcgcggaggccuggggccgcgccgacugcggguucaccuccgugagcuaccagcagggcguccuguccgccaccauccucuacgagauccugcugggcaaggcgacccucuacgccgugcuggugagcgcccugguccucauggccauggugaagcggaaggacuucuga

SEQ ID NO: 579 - RNA, 624 nt, Artificial Sequence
  P07766
augcagagcggcacccacuggcgcgugcuggggcucugccugcuguccgucggcgugugggggcaggacggcaacgaggagaugggcgggaucacccagacgcccuacaaggugagcaucuccggcaccaccgucauccugaccugcccccaguaccccgggagcgagauccucuggcagcacaacgacaagaacaucggcggggacgaggacgacaagaacaucggcuccgacgaggaccaccugagccucaaggaguucuccgagcuggagcagagcggguacuacgugugcuacccccggggcuccaagcccgaggacgccaacuucuaccuguaccuccgcgcccgggugugcgagaacugcauggagauggacgucaugagcguggcgacgaucgugaucgucgacaucugcaucaccggcgggcugcugcuccugguguacuacugguccaagaaccgcaaggccaaggccaagccggugacccggggcgccggggccggcggccgccagcgggggcagaacaaggagcgcccgccgcccguccccaaccccgacuacgagcccauccggaagggccagcgcgaccuguacagcgggcucaaccagcggcgcaucuga

SEQ ID NO: 580 - RNA, 3915 nt, Artificial Sequence
  P08575
auguaccuguggcucaagcugcuggccuucggcuucgccuuccucgacaccgagguguucgucaccgggcagagccccacgccgucccccaccggccugaccaccgcgaagaugcccagcgugccccuguccagcgacccgcuccccacgcacaccaccgccuucucccccgccagcaccuucgagcgcgagaacgacuucuccgagacgaccaccagccugucccccgacaacaccagcacccagguguccccggacagccuggacaacgccuccgccuucaacaccaccggggucagcuccgugcagacgccccaccuccccacgcacgcggacagccagacccccuccgccggcaccgacacccagacguucagcggguccgccgccaacgcgaagcugaacccgacccccggcagcaacgccaucagcgacgugcccggcgagcgguccaccgccagcaccuuccccacggacccggucagcccccugaccaccacccucucccuggcccaccacuccagcgccgcgcugcccgcccgcacguccaacaccaccaucaccgccaacacgagcgacgccuaccucaacgccuccgagaccaccacccugagccccuccgggagcgcggugaucuccacgaccaccaucgccaccaccccgagcaagcccacgugcgacgagaaguacgccaacaucaccguggacuaccuguacaacaaggagaccaagcuguucaccgccaagcugaacgucaacgagaacguggagugcggcaacaacacgugcaccaacaacgaggugcacaaccugaccgagugcaagaacgccuccgucagcaucucccacaacagcugcaccgcgcccgacaagacgcucauccuggacgugcccccggggguggagaaguuccagcugcacgacugcacccaggucgagaaggccgacaccaccaucugccucaaguggaagaacaucgagacguucacgugcgacacccagaacaucaccuaccgguuccagugcggcaacaugaucuucgacaacaaggagaucaagcuggagaaccuggagcccgagcacgaguacaagugcgacuccgagauccucuacaacaaccacaaguucaccaacgccagcaagaucaucaagaccgacuucgggagccccggcgagccccagaucaucuucugccgcuccgaggccgcccaccagggcgugaucaccuggaacccgccccagcggagcuuccacaacuucacccugugcuacaucaaggagacggagaaggacugccugaaccucgacaagaaccugaucaaguacgaccugcagaaccucaagcccuacaccaaguacgugcugucccugcacgcguacaucaucgccaagguccagcgcaacgggagcgccgccaugugccacuucaccaccaaguccgcgccgcccagccagguguggaacaugacgguguccaugaccagcgacaacuccaugcacgucaagugccggccgccccgcgaccggaacggcccccacgagcgcuaccaccucgagguggaggccgggaacacccuggugcggaacgagagccacaagaacugcgacuuccgcgucaaggaccugcaguacuccaccgacuacacguucaaggccuacuuccacaacggcgacuaccccggcgagcccuucauccuccaccacagcaccuccuacaacagcaaggcccugaucgccuuccuggcguuccucaucaucgugaccuccaucgcccugcuggucgugcucuacaagaucuacgaccugcacaagaagcggagcugcaaccuggacgagcagcaggagcucguggagcgcgacgacgagaagcagcugaugaacgucgagcccauccacgccgacauccugcuggagaccuacaagcggaagaucgccgacgaggggcgccucuuccuggccgaguuccaguccaucccgcggguguucagcaaguuccccaucaaggaggcgcgcaagcccuucaaccagaacaagaaccgguacguggacauccugcccuacgacuacaaccgcgucgagcucagcgagaucaacggcgacgccggguccaacuacaucaacgccagcuacaucgacggcuucaaggagccgcggaaguacaucgccgcccaggggccccgcgacgagacgguggacgacuucuggcgcaugaucugggagcagaaggcgaccgugaucgucauggugacccggugcgaggagggcaaccgcaacaagugcgccgaguacuggcccuccauggaggagggcacccgggccuucggggacguggucgugaagaucaaccagcacaagcgcugccccgacuacaucauccagaagcugaacaucgugaacaagaaggagaaggccacgggccgggaggucacccacauccaguucaccagcuggccggaccacggggugcccgaggacccccaccuccuccugaagcugcgccggcgcgugaacgcguucuccaacuucuucagcggccccaucgucgugcacugcuccgccggggugggccggaccggcaccuacaucgggaucgacgccaugcucgagggccuggaggccgagaacaaggucgacguguacggguacguggucaagcugcgccggcagcgcugccucaugguccagguggaggcccaguacauccugauccaccaggcgcugguggaguacaaccaguucggcgagacggaggugaaccucagcgagcugcacccguaccugcacaacaugaagaagcgggacccgcccuccgagcccagcccccucgaggccgaguuccagcgccugcccuccuaccggagcuggcgcacccagcacaucgggaaccaggaggagaacaaguccaagaaccggaacagcaacgugauccccuacgacuacaaccgcgucccgcugaagcacgagcucgagauguccaaggagagcgagcacgacuccgacgagagcuccgacgacgacagcgacagcgaggagcccuccaaguacaucaacgccagcuucaucauguccuacuggaagcccgaggugaugaucgccgcccagggcccccugaaggagaccaucggcgacuucuggcagaugaucuuccagcggaaggugaaggucaucgugaugcugaccgagcucaagcacggggaccaggagaucugcgcgcaguacuggggcgaggggaagcagacguacggcgacaucgagguggaccugaaggacaccgacaagagcuccaccuacacccugcgcgucuucgagcuccgccacagcaagcggaaggacucccgcacgguguaccaguaccaguacaccaacuggagcguggagcagcugccggccgagcccaaggagcugaucuccaugauccaggucgugaagcagaagcucccccagaagaacagcuccgagggcaacaagcaccacaagagcacgccccugcugauccacugccgggacgggucccagcagaccggcaucuucugcgcccuccugaaccugcucgagagcgccgagaccgaggagguggucgacaucuuccagguggugaaggcccugcgcaaggcgcggccggggauggucuccaccuucgagcaguaccaguuccuguacgacgugaucgccagcaccuaccccgcccagaacggccaggugaagaagaacaaccaccaggaggacaagaucgaguucgacaacgaggucgacaaggugaagcaggacgccaacugcgugaacccccucggggcgcccgagaagcugccggaggccaaggagcaggccgagggcuccgagcccaccagcggcacggaggggcccgagcacuccgucaacggccccgccagcccggcccugaaccaggggagcuga

SEQ ID NO: 581 - RNA, 765 nt, Artificial Sequence
  P08637
auguggcagcugcuccugcccaccgcccugcuccugcuggugagcgccggcaugcgcaccgaggaccucccgaaggcggucguguuccuggagccccagugguaccgggugcuggagaaggacuccgucacgcucaagugccagggggccuacagccccgaggacaacuccacccagugguuccacaacgagagccugaucuccagccaggccuccagcuacuucaucgacgccgccaccguggacgacuccggcgaguaccgcugccagaccaaccugagcacgcucuccgaccccgugcagcuggagguccacaucggguggcugcuccugcaggcgccgcgguggguguucaaggaggaggaccccauccaccuccgcugccacagcuggaagaacaccgcccugcacaaggugaccuaccugcagaacggcaaggggcggaaguacuuccaccacaacuccgacuucuacauccccaaggccacccugaaggacagcggcuccuacuucugccgcggccucuucgggagcaagaacgucuccagcgagacggugaacaucaccaucacccagggccuggccguguccaccaucagcagcuucuucccgcccggguaccaggucuccuucugccuggugauggugcuccuguucgcggucgacacgggccuguacuucagcgugaagaccaacauccgguccagcacccgcgacuggaaggaccacaaguucaaguggcggaaggacccccaggacaaguga

SEQ ID NO: 582 - RNA, 663 nt, Artificial Sequence
  P10747
augcugcgccuccugcuggcccucaaccuguuccccagcauccaggugaccggcaacaagauccuggucaagcagucccccaugcucguggccuacgacaacgcggugaaccugagcugcaaguacuccuacaaccuguucagccgggaguuccgcgccucccuccacaaggggcuggacagcgccgucgaggugugcguggucuacggcaacuacucccagcagcuccagguguacagcaagaccggguucaacugcgacggcaagcuggggaacgaguccgugacguucuaccugcagaaccuguacgucaaccagaccgacaucuacuucugcaagaucgaggugauguacccgccgcccuaccucgacaacgagaaguccaacggcaccaucauccacgugaagggcaagcaccugugccccagcccccuguuccccgggcccagcaagcccuucuggguccucgugguggucggcggggugcuggccugcuacucccugcucgugaccgucgccuucaucaucuucugggugcggagcaagcgcucccggcugcugcacagcgacuacaugaacaugacgccccgccggcccggccccacccgcaagcacuaccagccguacgcgccgccccgggacuucgccgccuaccgcuccuga

SEQ ID NO: 583 - RNA, 681 nt, Artificial Sequence
  P11912
augcccggcgggccgggcgugcugcaggcccuccccgccaccaucuuccugcuguuccuccugagcgcggucuaccuggggcccggcugccaggcccucuggaugcacaaggugcccgccucccugauggugagccugggggaggacgcccacuuccagugcccgcacaacuccagcaacaacgccaacgucaccugguggcgcgugcuccacggcaacuacacguggccgcccgaguuccugggccccggggaggaccccaacggcacccugaucauccagaacgugaacaagucccacgggggcaucuacgucugccgggugcaggaggggaacgagagcuaccagcaguccugcggcaccuaccuccgcgugcggcagcccccgccccgccccuuccuggacaugggcgaggggaccaagaaccggaucaucacggcggagggcaucauccugcuguucugcgccgucgugcccgggacccugcuccucuuccgcaagcgguggcagaacgagaagcugggccuggacgccggcgacgaguacgaggacgagaaccucuacgaggggcugaaccuggacgacugcagcauguacgaggacaucucccgcggccuccaggggaccuaccaggacgugggcagccugaacaucggggacguccagcuggagaagcccuga

SEQ ID NO: 584 - RNA, 1671 nt, Artificial Sequence
  P15391
augcccccgccccgccugcucuucuuccugcuguuccucacccccauggaggugcggcccgaggagccgcuggucgugaagguggaggagggcgacaacgccguccugcagugccucaaggggaccagcgacggccccacgcagcagcugaccuggucccgcgagagcccccugaagcccuuccucaagcugucccuggggcucccgggccuggggauccacaugcggccccuggccaucuggcucuucaucuucaacgugagccagcagaugggcggcuucuaccugugccagcccgggcccccguccgagaaggcguggcagcccggcuggaccgugaacgucgaggggagcggcgagcuguuccgcuggaacguguccgaccucgggggccugggcugcgggcugaagaaccggagcuccgagggccccagcucccccagcgggaagcucauguccccgaagcuguacgugugggccaaggaccgccccgagaucugggagggcgagccccccugccugccgccccgggacagccucaaccagucccugagccaggaccugaccauggcccccggcuccacgcucuggcugagcugcgggguccccccggacuccgugagccgcggcccccugagcuggacccacgugcaccccaaggggcccaagucccuccugagccuggagcucaaggacgaccggccggcccgcgacaugugggucauggagaccggccugcugcucccccgggccaccgcgcaggacgccgggaaguacuacugccaccgcggcaaccugacgauguccuuccaccuggagaucaccgcccggcccgugcucuggcacuggcugcugcgcaccggcggguggaaggugagcgccgucacccucgcguaccugaucuucugccugugcucccucgugggcauccugcaccugcagcgggcccucgugcugcgccggaagcgcaagcggaugacggacccgacccgccgguucuucaaggucacccccccccccgggagcggcccgcagaaccaguacgggaacgugcugucccugcccacccccacgagcggccucggccgcgcccagcgcugggccgccgggcugggcgggaccgcgcccuccuacggcaacccgagcuccgacgugcaggccgacggggcccugggcagccgguccccccccggcgucgggcccgaggaggaggagggcgagggguacgaggagccggacagcgaggaggacuccgaguucuacgagaacgacagcaaccucggccaggaccagcugucccaggacggcagcggguacgagaaccccgaggacgagccccugggccccgaggacgaggacuccuucagcaacgccgagagcuacgagaacgaggacgaggagcucacccagccgguggcccgcaccauggacuuccuguccccccacgggagcgcgugggaccccucccgggaggccacgagccugggcucccagagcuacgaggacaugcgcgggauccucuacgccgccccccagcugcgguccauccgcggccagccgggccccaaccacgaggaggacgccgacagcuacgagaacauggacaaccccgacgggcccgacccggcguggggcgggggcgggcggaugggcaccugguccacccgcuga

SEQ ID NO: 585 - RNA, 672 nt, Artificial Sequence
  P16410
auggccugccugggcuuccagcgccacaaggcccagcucaaccuggcgacccggaccuggcccugcacgcuccuguucuuccugcuguucaucccgguguucugcaaggccaugcacgucgcccagcccgccguggugcucgccagcucccgcgggaucgcgagcuucgucugcgaguacgccucccccggcaaggccaccgaggugcgggugaccguccugcgccaggccgacagccaggugaccgaggugugcgcggccacguacaugauggggaacgagcugaccuuccucgacgacuccaucugcaccggcaccagcuccgggaaccaggucaaccugacgauccagggccugcgggccauggacaccggccucuacaucugcaagguggagcugauguacccgccgcccuacuaccuggggaucggcaacgggacccagaucuacgugaucgaccccgagcccugccccgacagcgacuuccuccuguggauccuggccgccgucuccagcggccucuucuucuacuccuuccugcugaccgcggugagccucuccaagaugcugaagaagcgcagcccccugacgaccgggguguacgucaagaugccgcccaccgagcccgagugcgagaagcaguuccagcccuacuucauccccaucaacuga

SEQ ID NO: 586 - RNA, 1419 nt, Artificial Sequence
  P16671
augggcugcgaccgcaacugcgggcugaucgccggcgccgugaucggggcgguccucgccguguucggcgggauccugaugcccgugggcgaccugcucauccagaagaccaucaagaagcaggucgugcuggaggagggcaccaucgccuucaagaacugggugaagacggggaccgaggucuaccggcaguucuggaucuucgacgugcagaacccgcaggaggugaugaugaacagcuccaacauccaggucaagcagcgcggccccuacaccuaccgggugcgcuuccuggccaaggagaacgugacccaggacgccgaggacaacacggucagcuuccuccagcccaacggggcgaucuucgagcccucccugagcgugggcaccgaggccgacaacuucaccgugcugaaccucgccgucgccgcggccucccacaucuaccagaaccaguucgugcagaugauccugaacagccugaucaacaaguccaagagcuccauguuccaggugcggacccuccgcgagcugcuguggggguaccgggacccguuccucagccugguccccuaccccgugacgaccaccgugggccuguucuaccccuacaacaacaccgccgacggcgucuacaagguguucaacgggaaggacaacaucuccaagguggccaucaucgacacguacaagggcaagcgcaaccucagcuacugggagucccacugcgacaugaucaacgggaccgacgccgcgagcuucccgcccuucgucgagaagucccaggugcugcaguucuucagcuccgacaucugccggagcaucuacgccgucuucgaguccgacgugaaccugaagggcauccccguguaccgcuucguccuccccagcaaggccuucgccagcccgguggagaaccccgacaacuacugcuucugcaccgagaagaucaucuccaagaacugcaccagcuacggcgugcuggacaucuccaagugcaaggaggggcggcccgucuacaucagccugccccacuuccucuacgccuccccggacgugagcgagcccaucgacggccugaaccccaacgaggaggagcaccgcacguaccuggacaucgagcccaucaccggguucacccuccaguucgcgaagcggcuccaggugaaccugcuggucaagccguccgagaagauccaggugcugaagaaccugaagcgcaacuacaucgugcccauccucuggcugaacgagaccggcacgaucggggacgagaaggccaacauguuccggagccaggucaccggcaagaucaaccugcucggccugaucgagaugauccugcucuccguggggguggucauguucguggccuucaugaucagcuacugcgccugccgcuccaagaccaucaaguga

SEQ ID NO: 587 - RNA, 651 nt, Artificial Sequence
  P26718
augggcuggauccgcgggcggcgcagccggcacuccugggagaugagcgaguuccacaacuacaaccuggaccucaagaaguccgacuucagcacccgcuggcagaagcagcggugccccguggucaaguccaagugccgcgagaacgccagcccguucuucuucugcugcuucaucgccguggcgaugggcauccgguucaucaucaugguggccaucugguccgccgucuuccugaacagccuguucaaccaggaggugcagaucccccucaccgaguccuacugcgggcccugccccaagaacuggaucugcuacaagaacaacugcuaccaguucuucgacgagagcaagaacugguacgagucccaggccagcugcaugucccagaacgccagccugcugaagguguacuccaaggaggaccaggaccuccugaagcuggucaagagcuaccacuggaugggccucgugcacaucccgacgaacggguccuggcagugggaggacggcagcauccugucccccaaccugcucaccaucaucgagaugcagaagggcgacugcgcgcuguacgccagcagcuucaagggguacaucgagaacugcuccacccccaacaccuacaucugcaugcagcgcacgguguga

SEQ ID NO: 588 - RNA, 261 nt, Artificial Sequence
  P30273
augauccccgccgugguccugcuccugcugcuccugguggagcaggccgcggcccugggcgagccccagcucugcuacauccuggacgccauccuguuccucuacgggaucgugcugacccugcucuacugccgccugaagauccagguccggaaggccgccaucaccagcuacgagaaguccgacggcguguacacggggcugagcacccgcaaccaggagaccuacgagacccucaagcacgagaagccgccccaguag

SEQ ID NO: 589 - RNA, 1137 nt, Artificial Sequence
  P32248
auggaccugggcaagcccaugaaguccgugcucgucguggcccugcuggugaucuuccaggucugccucugccaggacgaggugaccgacgacuacaucggggacaacaccacgguggacuacacccuguucgagagccugugcagcaagaaggacguccgcaacuucaaggccugguuccucccgaucauguacuccaucaucugcuucgugggccugcuggggaacggccucgugguccugaccuacaucuacuucaagcggcugaagaccaugacggacaccuaccuccugaaccuggcgguggccgacauccucuuccugcugacccuccccuucugggccuacagcgccgccaaguccuggguguucgggguccacuucugcaagcugaucuucgcgaucuacaagaugagcuucuucuccggcaugcugcuccugcugugcaucagcaucgaccgcuacguggccaucgugcaggccgucuccgcccaccggcaccgcgcgcgggugcuccugaucagcaagcuguccugcgugggcaucuggauccucgccaccguccugagcauccccgagcugcucuacuccgaccugcagcgcagcuccagcgagcaggccaugcggugcucccugaucacggagcacguggaggccuucaucaccauccagguggcccagauggucaucggguuccucgugccccugcuggcgaugagcuucugcuaccucgugaucauccgcacccugcugcaggcccggaacuucgagcgcaacaaggccaucaaggucaucaucgccguggucgugguguucaucgucuuccagcucccguacaacggcguggugcuggcccagaccgucgcgaacuucaacaucacguccagcacgugcgagcugagcaagcagcucaacaucgccuacgacgugaccuacucccuggccugcgugcggugcugcgucaaccccuuccuguacgccuucaucggggugaaguuccgcaacgaccucuucaagcuguucaaggaccugggcugccucagccaggagcagcugcggcagugguccagcugccgccacauccggcgcuccagcauguccguggaggccgagaccaccaccaccuucagccccuga

SEQ ID NO: 590 - RNA, 690 nt, Artificial Sequence
  P40259
auggcccgccuggcccucagccccgugccgucccacuggauggucgcgcugcugcuccugcugagcgccgagcccgugcccgccgcccgguccgaggaccgcuaccggaaccccaagggcagcgccugcucccgcaucuggcagagcccgcgguucaucgcgcgcaagcggggguucaccgugaagaugcacugcuacaugaacuccgccagcggcaacgucuccuggcucuggaagcaggagauggacgagaacccccagcagcugaagcuggagaaggggcgcauggaggagagccagaacgagucccucgccacccugacgauccagggcauccgguucgaggacaacgggaucuacuucugccagcagaagugcaacaacaccagcgagguguaccagggcugcggcaccgagcugcgcgugaugggguucuccacccucgcccagcugaagcagcggaacacgcugaaggacggcaucaucaugauccagacccuccugaucauccuguucaucaucguccccaucuuccuccugcuggacaaggacgacagcaaggcggggauggaggaggaccacaccuacgagggccucgacaucgaccagaccgccacguacgaggacaucgugacccugcgcaccggggaggugaagugguccgucggcgagcaccccggccaggaguga

SEQ ID NO: 591 - RNA, 990 nt, Artificial Sequence
  P42081
auggacccccagugcaccaugggccugagcaacauccucuucgugauggccuuccugcuguccggggccgcgccgcucaagauccaggccuacuucaacgagaccgccgaccugcccugccaguucgccaacagccagaaccagucccugagcgagcucgucguguucuggcaggaccaggagaaccuggugcugaacgaggucuaccucggcaaggagaaguucgacuccgugcacagcaaguacauggggcgcaccuccuucgacagcgacuccuggacccugcggcugcacaaccuccagaucaaggacaagggccuguaccagugcaucauccaccacaagaagcccaccgggaugauccgcauccaccagaugaacagcgagcuguccgugcucgccaacuucagccagcccgagaucgucccgaucuccaacaucaccgagaacguguacaucaaccugacgugcagcuccauccacggcuaccccgagcccaagaagaugagcgugcugcuccggaccaagaacuccaccaucgaguacgacggcgucaugcagaagucccaggacaacgugaccgagcuguacgacgugagcaucagccugagcgucuccuuccccgacgugacgagcaacaugaccaucuucugcauccucgagaccgacaagacccgccugcuguccagcccguucuccaucgagcucgaggacccccagcccccgcccgaccacauccccuggaucacggcggugcugcccaccgucaucaucugcgugaugguguucugccugauccucuggaaguggaagaagaagaagcggccccgcaacagcuacaagugcgggaccaacaccauggagcgggaggaguccgagcagacgaagaagcgcgagaagauccacaucccggagcggagcgacgaggcccagcgcgucuucaaguccagcaagaccuccagcugcgacaaguccgacacgugcuucuga

SEQ ID NO: 592 - RNA, 1011 nt, Artificial Sequence
  Q15762
auggacuaccccacccugcuccuggcccugcuccacguguaccgcgcccugugcgaggagguccuguggcacaccagcgugccguucgcggagaacaugucccucgagugcguguaccccagcaugggcauccugacgcaggucgagugguucaagaucgggacccagcaggacuccaucgccaucuucagccccacccacggcauggugauccggaagcccuacgccgagcgcguguacuuccugaacuccaccauggccagcaacaacaugacccucuucuuccggaacgccuccgaggacgacgucggguacuacagcugcucccuguacacguacccgcagggcaccuggcagaaggugauccaggugguccagagcgacuccuucgaggcggccgugcccagcaacucccacaucgugagcgagcccgggaagaacgucacccugacgugccagccccagaugaccuggccggugcaggccgugcgcugggagaagauccagccccggcagaucgaccuccugaccuacugcaaccugguccacggccgcaacuucaccuccaaguucccccggcagaucgugagcaacugcucccacggccgcuggagcgugaucgucauccccgacgugacgguguccgacagcgggcucuaccggugcuaccugcaggccagcgcgggcgagaacgagaccuucgucaugcgccugaccguggccgaggggaagaccgacaaccaguacacccucuucguggccggcgggacgguccugcugcuccuguucgugaucuccaucaccaccaucaucgucaucuuccugaaccggcgccggcgccgggagcgccgggaccucuucacggagagcugggacacccagaaggccccgaacaacuaccgcucccccaucagcaccucccagcccaccaaccagagcauggacgacacgcgggaggacaucuacgugaacuaccccaccuucucccgccggccgaagacccgcguguga

SEQ ID NO: 593 - RNA, 13482 nt, Artificial Sequence
  Q685J3
augccccgcccgggcaccauggcccugugccuccugacccuggugcucagccugcugccgccccaggccgcggccgagcaggaccucagcgucaaccgggccgugugggacgggggcgggugcaucagccagggcgacgugcugaaccgccagugccagcagcugucccagcacguccggacggggagcgccgccaacaccgcgaccggcaccaccuccaccaacgugguggagccccgcauguaccucagcugcuccaccaacccggagaugaccagcaucgaguccagcgucaccuccgacacccccggcgugagcuccacccggaugacccccaccgagagccgcaccaccuccgagagcaccuccgacagcaccacccuguuccccuccagcaccgaggacaccagcuccccgaccacccccgaggggaccgacgugcccaugagcacccccuccgaggagagcaucuccagcaccauggccuucgucuccaccgccccgcugcccagcuucgaggccuacaccucccucaccuacaagguggacaugagcaccccgcugaccaccuccacccaggcgagcuccagccccaccacccccgaguccaccaccauccccaagagcaccaacuccgagggcagcacgccccugaccuccaugcccgccagcaccaugaagguggccagcuccgaggccaucacccuccugaccaccccggucgagaucagcacccccgugaccaucuccgcccaggcgagcuccagccccaccaccgccgaggggcccucccugagcaacuccgccccgagcggcggguccacgccccucacccggaugccccugagcgugaugcuggucguguccagcgaggccuccacccucagcaccacccccgccgcgaccaacaucccggugaucaccuccaccgaggccagcagcucccccaccaccgccgagggcaccagcauccccaccuccaccuacaccgagggcagcaccccgcugaccuccacccccgccagcaccaugcccgucgccaccuccgagaugagcacccuguccaucacccccguggacaccagcacccucgugaccaccuccaccgagccgagcucccugcccaccaccgcggaggccaccagcaugcugaccuccacccucagcgagggguccacgccccugaccaacaugcccgucagcaccauccugguggccuccagcgaggccagcaccaccuccaccaucccgguggacagcaagaccuucgucaccaccgccuccgaggcgagcuccagccccaccaccgccgaggacaccuccaucgccaccagcacccccuccgagggcagcacgccccucaccuccaugccggugagcaccacccccgucgccuccagcgaggcguccaaccugagcaccacccccguggacuccaagacccaggugaccaccagcaccgaggccuccagcuccccgcccaccgccgaggucaacuccaugcccaccagcacccccuccgaggggagcacgccccugaccuccaugagcguguccaccaugcccguggccagcuccgaggccagcacccucuccaccacccccgucgacaccagcacccccgugaccaccuccagcgaggcguccagcuccagcaccacccccgagggcaccuccaucccgaccagcacccccagcgagggcuccacgccccugaccaacaugccggugagcacccgccuggucguguccagcgaggccuccaccaccagcaccacccccgccgacuccaacaccuucgugaccaccagcuccgaggccagcuccagcuccaccaccgccgaggggaccagcaugcccaccuccaccuacagcgagcggggcaccaccaucaccuccaugagcgucuccaccacgcucguggcgagcagcgaggccuccacccugagcaccacccccguggacuccaacaccccggucaccaccagcaccgaggccaccuccagcuccaccaccgccgaggggaccagcaugcccaccuccaccuacaccgagggcagcacgccccugaccuccaugcccgugaacaccacccucguggccagcuccgaggcgagcacccuguccaccaccccggucgacaccagcacccccgugacgaccuccaccgaggccagcuccagccccaccaccgccgacggggccagcaugcccacguccaccccgagcgagggcuccacgccccugaccagcaugcccguguccaagacgcuccugaccagcuccgaggcgagcacccuguccaccacgccccucgacaccagcacccacaucaccacguccaccgaggccagcugcuccccgaccaccacggagggcaccagcaugcccaucuccacccccagcgaggggagcccccugcugaccagcaucccggucagcaucacgcccgugaccucccccgaggccagcacccucuccaccacgcccguggacagcaacuccccggucaccaccagcaccgagguguccagcucccccacgcccgccgagggcaccagcaugcccaccuccaccuacagcgaggggcgcacgccgcugaccuccaugcccgugagcaccacccuggucgccacguccgcgaucagcacccuguccaccacccccguggacaccagcacgccggugaccaacuccaccgaggcccggagcagccccaccacguccgagggcaccagcaugcccaccuccacccccggggagggcagcacgccgcucaccuccaugcccgacagcaccacccccgucguguccagcgaggcccgcacgcuguccgccacccccguggacaccagcaccccggucacgaccuccaccgaggccaccagcucccccacgaccgcggagggcaccagcauccccaccuccacgcccagcgaggggaccaccccgcugaccuccacgcccgugagccacacccucguggccaacuccgaggccagcacccugagcaccacgcccgucgacuccaacacgccccugaccaccagcacggaggccuccagcccgccgcccaccgccgagggcaccuccaugcccaccagcaccccguccgaggggagcacgccccucacccggaugcccguguccaccaccaugguggcgagcuccgagacgagcacccuguccaccacccccgccgacacgagcaccccggucaccaccuacucccaggccagcuccagcuccacgaccgccgacggcaccagcaugcccaccagcacguacuccgaggggagcacgccccugaccuccgugcccgugagcacccgccucgucguguccagcgaggcguccacgcugagcaccaccccgguggacaccuccauccccgucacgaccagcaccgaggccuccagcucccccaccacggccgagggcaccagcaucccgaccagcccgcccagcgagggcaccacgccccuggccuccaugccggugagcaccacccucguggucuccagcgaggccaacacccugagcacgacccccguggacuccaagacccagguggcgaccagcaccgaggccuccuccccgccgcccacggccgaggucaccuccaugcccaccagcacccccggggagcgguccacgccccugaccagcaugcccgugcgccacacccccgucgccuccagcgaggccuccacccucagcacgucccccguggacaccagcacccccgugaccacguccgcggagaccagcuccagcccgaccaccgccgagggcacgucccugcccaccagcaccaccagcgagggguccacgcugcucaccagcauccccgucuccaccacccuggugacgagccccgaggccuccacccugcucaccaccccgguggacacgaagggccccgucgugaccagcaacgagguguccagcucccccacccccgccgagggcaccagcaugccgacguccaccuacagcgaggggcggacgccccugaccuccauccccgucaacacgacccugguggccagcuccgcgaucagcauccucuccaccaccccgguggacaacagcacccccgucacgaccagcaccgaggccugcuccagccccaccacguccgagggcaccagcaugcccaacuccaacccgagcgaggggaccacgccccugacguccauccccgugagcaccacccccguggucuccagcgaggccuccacccugagcgccacgccgguggacaccuccacccccggcaccacgagcgccgaggcgaccuccagccccaccaccgccgaggggaucuccauccccacgagcaccccguccgagggcaagacgccccucaagagcauccccgugagcaacacccccgucgccaacuccgaggccagcacgcuguccaccaccccgguggacagcaacucccccguggucaccagcacggcgguguccagcucccccacccccgccgagggcaccagcaucgccaucuccaccccgagcgagggguccacggcccugaccagcauccccguguccaccaccacggucgccagcuccgagaucaacagccucuccaccacccccgcggugaccagcacgcccgugaccaccuacagccaggccuccagcuccccgaccaccgccgacggcacgagcaugcagaccuccaccuacagcgagggguccacgccccugacgagccugcccgucuccaccaugcucguggugagcuccgaggccaacacccugagcaccacgcccaucgacuccaagacccaggucaccgccagcaccgaggcguccagcuccacgaccgccgagggcagcuccaugaccaucagcaccccgagcgaggggagcccccugcucacgagcauccccguguccaccaccccgguggccagccccgaggccuccacccugagcacgacccccgucgacuccaacagccccgugaucaccuccaccgaggugagcuccagcccgacgcccgccgagggcaccuccaugcccaccagcaccuacacggagggccgcacgccccugaccuccaucaccguccggacgaccccgguggcgagcuccgccaucagcacccucuccaccacgcccguggacaacagcacccccgucaccaccagcaccgaggcccgcuccagccccacgaccuccgaggggaccagcaugccgaacuccacccccagcgagggcacgacgccccugaccuccauccccgugagcaccacgccggugcuguccagcgaggccuccacccucagcgcgacccccaucgacaccuccacgcccgucaccaccagcaccgaggccacguccagccccaccaccgccgaggggaccuccaucccgacgagcacccuguccgagggcaugacgccccugaccagcacgcccgugagccacacccucguggccaacuccgaggccagcacccuguccaccacgcccgucgacagcaacuccccgguggugaccagcaccgcggucuccagcucccccacccccgccgaggggacgagcaucgccaccuccacccccagcgagggcuccaccgcccugacgagcaucccgguguccaccaccaccguggccagcuccgagaccaacacgcucagcaccacccccgcggucaccagcacgcccgugaccaccuacgcccaggucuccagcuccccgaccacggccgacggcagcuccaugcccaccagcacgccccgggaggggcgcccgccccugaccuccauccccgugagcacgaccaccguggccuccagcgagaucaacacccuguccacgacccucgccgacacccgcacccccgucacgaccuacagccaggcguccagcucccccaccaccgccgacggcacgagcaugcccacccccgccuacuccgaggggagcacgccccugaccuccaugccccugagcacgacccucguggugagcuccgaggccagcacccuguccaccacgccggucgacaccagcacccccgcgaccacguccaccgagggcagcuccagccccaccaccgccgggggcaccuccauccagacgagcacccccuccgagcggaccaccccgcuggccggcaugcccgugagcacgacccucguggucuccagcgaggggaacacccuguccaccacgcccguggacagcaagacccaggugaccaacuccaccgaggccagcuccagcgccacggcggagggcagcuccaugaccaucagcgcccccuccgaggggagcccgcugcucaccuccaucccccugagcaccacgcccgucgccucccccgaggccagcacccuguccaccaccccgguggacagcaacucccccgugaucacgagcaccgaggucuccagcucccccauccccaccgagggcaccagcaugcagacguccaccuacagcgaccgccggaccccgcucaccuccaugcccgugagcacgaccguggucgccagcuccgcgaucagcacccuguccaccacgcccguggacaccagcaccccggugaccaacuccacggaggcccgcagcucccccaccaccagcgagggcaccuccaugcccaccagcacgcccuccgaggggagcaccccguucaccuccaugcccgucagcaccaugcccguggugacguccgaggccagcacccuguccgccacccccgucgacaccagcacgccggugaccaccuccaccgaggccacgagcagccccaccaccgcggagggcaccuccauccccacgagcacccucuccgaggggaccacgccccugacgagcaucccggugucccacacccuggucgccaacagcgagguguccacccucagcaccacgcccguggacuccaacacccccuucaccaccagcacggaggccuccuccccgccgcccaccgccgagggcaccuccaugcccaccagcacguccagcgaggggaacacgccccugacccggaugcccgucuccaccacgaugguggccagcuucgagaccuccacccugagcaccacccccgcggacacgagcacccccgugaccaccuacucccaggccggcagcucccccacgaccgccgacgacaccagcaugcccaccuccacguacagcgagggcuccacgccccucaccagcguccccguguccaccaugccgguggucagcuccgaggccagcacgcacuccaccacccccguggacaccagcacgcccgugaccaccuccaccgaggcgagcuccagccccacgaccgccgaggggaccagcaucccgaccagcccgcccagcgagggcacgacgccccuggccuccaugccggucagcaccacccccgugguguccagcgaggccgggacgcuguccaccacccccgucgacaccagcacgcccaugaccaccuccaccgaggccagcuccagcccgacgaccgcggaggacaucguggugcccaucuccaccgccagcgagggcuccacccuccugaccagcauccccgucuccacgacccccguggccagcccggaggccuccacccugagcaccacgcccguggacagcaacucccccgucgugaccagcaccgagaucuccagcuccgccaccagcgcggaggggacguccaugcccaccagcaccuacuccgagggcagcaccccgcuccgcuccaugcccgugagcacgaagccccuggccuccagcgaggccuccacccugagcaccacccccgucgacacguccaucccggugaccaccagcaccgagacguccagcagccccaccaccgccaaggacaccuccaugcccaucagcacgcccuccgaggucagcaccucccucaccagcauccugguguccaccaugccgguggccagcuccgaggcgagcacgcuguccaccacccccgucgacacccggacgcucgugaccaccagcaccggcacguccagcucccccaccaccgccgaggggagcuccaugccgaccagcacgcccggcgagcgcuccacgccccugaccaacauccuggugagcaccacccuccuggccaacagcgaggccuccacgcugagcaccacccccgucgacaccuccacgccggugaccaccagcgcggaggccuccagcucccccaccacggccgaggggaccagcaugcggaucuccacccccagcgacggcuccacgccccucacgagcauccugguguccacccugccggucgccagcuccgaggccagcaccguguccaccacggcgguggacaccagcauccccgucaccaccuccacggaggccagcagcucccccaccaccgccgaggugaccagcaugcccacguccaccccgagcgagaccuccacgccccucacgagcaugcccgugaaccacacccccgucgccuccagcgaggccgggacccuguccaccacgccgguggacaccagcacccccgugaccacguccaccaaggcgagcuccagccccaccaccgccgagggcaucgucgugcccaucuccaccgccagcgagggcuccacgcugcugaccagcaucccgguguccaccacccccgucgccagcagcgaggccuccacgcucagcaccacccccguggacaccuccauccccgugacgaccagcaccgagggguccagcuccccgaccacggcggagggcaccagcaugcccaucuccacccccagcgaggucuccacgccccugacgagcauccugguguccaccgugccggucgccgggagcgaggccuccacccucagcaccacgcccguggacacccgcacccccgugaccacguccgccgaggcgagcagcuccccgaccaccgccgagggcaccagcaugcccaucuccacgcccggcgagcggcgcacgccccugaccagcauguccgucagcaccaugccgguggccuccagcgaggccuccacgcugagccggacccccgccgacaccuccacccccgugacgaccagcaccgaggcguccagcucccccaccaccgccgaggggacgggcaucccgaucagcacccccuccgaggggagcacgccccucaccuccauccccgucagcacgaccccgguggccauccccgaggccagcacccuguccaccacgcccguggacagcaacucccccgucgugaccagcaccgagguguccagcuccccgacccccgccgagggcacgagcaugcccaucuccaccuacagcgagggguccacgccccugaccggcgucccggugagcacgacccccgugaccuccagcgcgaucuccacccucagcacgacccccgucgacaccuccacccccgugacgaccagcaccgaggcccacuccagcccgaccacgagcgagggcaccuccaugcccaccagcacccccuccgaggggagcacgccgcugaccuacaugcccguguccaccaugcuggucgugagcuccgaggacagcacccucuccgccacgcccguggacaccagcacccccgucaccaccuccacggaggccaccagcuccaccaccgccgagggcacgagcaucccgaccuccacccccagcgaggggaugacgccccugacguccgugcccgugagcaacaccccggucgcguccagcgaggccagcauccuguccaccacccccguggacagcaacacgccccucaccaccuccaccgaggccagcuccagcccgcccacggccgagggcaccuccaugcccaccagcacccccuccgaggggagcacgccccugaccuccaugcccgucagcaccaccacgguggccuccagcgagaccuccacccugagcaccacgcccgcggacaccuccacccccgugaccacguacagccaggccuccagcuccccgcccaucgccgacggcaccuccaugcccaccagcaccuacuccgagggcagcacgccccucaccaacauguccuucagcaccacccccgucguguccagcgaggccuccacccugagcacgacccccguggacaccuccacccccgucacgaccagcaccgaggcgucccugagccccaccacggccgaggggaccuccauccccaccagcuccccgagcgagggcaccacgccccucgccuccaugcccgugagcaccaccccgguggucagcuccgaggugaacacccugagcacgacccccguggacuccaacacccuggucaccacgagcaccgaggccuccagcucccccaccaucgccgaggggaccagccuccccacguccaccaccagcgagggcuccaccccgcugagcaucaugccccuguccacgacccccguggcgagcuccgaggccagcacccucuccaccacgcccguggacaccagcaccccggucaccacgagcucccccaccaacagcucccccaccaccgccgaggugaccagcaugcccacguccaccgccggggagggcagcaccccgcugaccaacaugcccguguccacgacccccgucgccagcuccgaggcgagcacccuguccaccacgcccguggacagcaacaccuucgugaccuccagcucccaggccagcuccagcccggccacccuccaggucacgaccaugcgcauguccacccccagcgagggcagcuccagccugaccacgaugcugcucuccagcaccuacgugaccuccagcgaggccuccacccccagcacgcccuccguggaccggagcaccccggucaccaccuccacgcagagcaacuccacccccacgccgcccgaggugaucacccugccgaugagcacgcccuccgaggugagcacgccccugaccaucaugcccgucuccaccacgagcgugaccaucuccgaggccgggaccgcgagcacccucccgguggacacgagcacccccgucaucaccuccacccaggugagcuccagccccgugacgccggagggcaccaccaugcccaucuggacccccuccgaggggagcacgccccugacgaccaugccggucuccaccacccgcgugacgagcuccgagggcagcacccuguccacccccagcguggucaccuccacgcccgugaccaccagcaccgaggccaucuccagcuccgccacgcucgacagcaccaccauguccgugagcaugcccauggagaucagcacccuggggacgaccauccuggucuccaccaccccggugacgcgguuccccgagagcuccacccccagcauccccuccguguacaccagcauguccaugaccacggccagcgagggcuccagcuccccgaccacccucgagggcaccacgaccaugcccaugagcaccaccuccgagcgcagcacgcugcugaccaccguccucaucucccccaucagcgugaugucccccagcgaggcguccacccugagcacgccgcccggggacaccagcacgccccugcucaccuccaccaaggccggcagcuucuccauccccgccgaggugacgaccauccggaucagcaucaccuccgagcgcagcaccccgcugacgacccugcucgucuccaccacccugcccacgagcuuccccggggccuccaucgccagcacgccgccccuggacaccuccaccacguucacccccagcaccgacaccgcguccacgcccaccauccccguggccaccaccaucagcguguccgucaucacggagggcagcacccccggcaccaccaucuucauccccuccacgcccgugaccagcuccaccgccgacguguucccggccaccacgggggccgucagcacccccgugaucaccagcaccgagcucaacacgcccuccaccagcuccagcuccaccaccacgagcuucuccaccaccaaggaguucaccacccccgcgaugacgaccgccgccccgcugaccuacgucaccaugagcacggcccccuccacgccccgcaccaccagccggggcugcaccaccuccgccagcacccuguccgcgaccagcacgccccacaccuccaccagcgugaccacgcgcccggugacccccuccagcgagagcucccggcccagcaccaucaccucccacacgaucccgccgaccuucccgcccgcccacagcuccacgccgcccaccacgagcgccuccagcaccaccgucaaccccgaggccgugaccacgaugaccacccgcaccaagcccuccacgcggaccaccagcuuccccaccgugacgaccaccgccguccccaccaacaccacgaucaaguccaaccccaccagcacccccaccgugccccgcacgacgaccugcuucggggacggcugccagaacaccgcgucccggugcaagaacgggggcacgugggacggccucaagugccagugcccgaaccuguacuacggggagcugugcgaggagguggucagcuccaucgacaucggcccgcccgagaccaucagcgcccagauggagcucaccgugaccgugacguccgucaaguucaccgaggagcugaagaaccacagcucccaggaguuccaggaguucaagcagaccuucaccgagcagaugaacaucguguacagcgggauccccgaguacgugggcgucaacaucacgaagcugcgccucgggagcgugguggucgagcacgacgugcugcugcggaccaaguacacccccgaguacaagaccgugcucgacaacgccacggaggucgugaaggagaagaucaccaaggugaccacccagcagaucaugaucaacgacaucugcuccgacaugaugugcuucaacacgaccggcacccagguccagaacaucaccgugacgcaguacgaccccgaggaggacugccgcaagauggccaaggaguacggcgacuacuucguggucgaguaccgggaccagaagcccuacugcaucagcccgugcgagcccggguucuccgugagcaagaacugcaaccugggcaagugccagaugucccugagcgggccccagugccucugcgugaccaccgagacccacugguacuccggcgagacgugcaaccaggggacccagaagucccuggucuacggccuggugggcgcgggggugguccucaugcugaucauccugguggcccuccugaugcugguguuccgcuccaagcgggaggucaagcgccagaaguaccggcucagccagcuguacaaguggcaggaggaggacuccggccccgccccggggaccuuccagaacaucggcuucgacaucugccaggacgacgacagcauccaccuggaguccaucuacagcaacuuccagcccucccuccgccacaucgaccccgagaccaagauccggauccagcgcccccaggugaugacgaccagcuucuga

SEQ ID NO: 594 - RNA, 1215 nt, Artificial Sequence
  Q9NNX6
augagcgacuccaaggagccccgccugcagcagcucggccugcuggaggaggagcagcuccgggggcugggcuuccgccagacccggggguacaagagccuggccggcugccucgggcacggcccccuggugcugcagcuccuguccuucacccugcucgccggccugcugguccaggugagcaaggugcccuccagcaucucccaggagcagagccgccaggacgcgaucuaccagaaccucacgcagcugaaggccgccgucggggagcuguccgagaaguccaagcuccaggagaucuaccaggagcugacccagcugaaggccgccgugggcgagcuccccgagaaguccaagcugcaggagaucuaccaggagcugacccggcucaaggcggccgugggggagcugcccgagaaguccaagcugcaggagaucuaccaggagcucaccuggcugaaggccgccgucggcgagcugccggagaaguccaagaugcaggagaucuaccaggagcucacgcgccugaaggcggccgugggggagcugcccgagaaguccaagcagcaggagaucuaccaggagcucacccggcugaaggccgccgugggcgagcugcccgagaaguccaagcagcaggagaucuaccaggagcucacccgccugaaggccgcggucggcgagcugcccgagaaguccaagcagcaggagaucuaccaggagcucacccagcugaaggccgccguggagcggcugugccacccgugccccugggaguggacguucuuccaggggaacugcuacuucaugagcaacagccagcgcaacuggcacgacagcaucaccgccugcaaggaggugggcgcccagcucgucgugaucaagagcgcggaggagcagaacuuccugcagcugcagagcagccggagcaaccgcuucaccuggauggggcucagcgaccugaaccaggagggcaccuggcaguggguggacggcagcccccugcuccccuccuucaagcaguacuggaaccgcggggagccgaacaacgucggcgaggaggacugcgccgaguucagcgggaacggcuggaacgacgacaagugcaaccuggccaaguucuggaucugcaagaaguccgccgccagcugcucccgggacgaggagcaguuccugagccccgcgcccgccacgcccaacccgccgcccgccuga

SEQ ID NO: 595 - RNA, 3126 nt, Artificial Sequence
  Q9NR97
auggagaacauguuccugcagagcuccaugcugaccugcaucuuccugcugaucagcggcuccugcgagcucugcgccgaggagaacuucagccgcuccuaccccugcgacgagaagaagcagaacgacagcgugaucgccgagugcuccaaccggcgccugcaggaggucccgcagaccguggggaaguacgugacggagcuggaccucagcgacaacuucaucacccacaucaccaacgaguccuuccagggccugcagaaccugaccaagaucaaccucaaccacaaccccaacguccagcaccagaacgggaaccccggcauccagagcaacgggcugaacaucacggacggcgcguuccugaaccucaagaaccugcgggagcugcuccuggaggacaaccagcugccccagaucccguccggccuccccgagagccugaccgagcugucccucauccagaacaacaucuacaacaucaccaaggaggggaucagccgccugaucaaccugaagaaccucuaccuggccuggaacugcuacuucaacaaggugugcgagaagaccaacaucgaggacggcguguucgagacgcugaccaaccucgagcugcugucccucagcuucaacucccugagccacgucccgcccaagcugcccuccagccuccggaagcuguuccugagcaacacccagaucaaguacaucuccgaggaggacuucaaggggcucaucaaccugacccugcucgaccugagcggcaacugcccccgcugcuucaacgcccccuuccccugcgugccgugcgacgggggcgccuccaucaacaucgaccgguucgccuuccagaaccugacgcagcuccgcuaccugaaccugagcuccaccagccuccggaagaucaacgcggccugguucaagaacaugccccaccugaaggugcuggaccucgaguucaacuaccuggucggcgagaucgccuccggggccuuccugaccaugcugccccgccucgagauccuggaccugagcuucaacuacaucaagggcuccuacccccagcacaucaacaucagccggaacuucuccaagcuccugagccugcgcgcgcuccaccuccggggguacguguuccaggagcugcgcgaggacgacuuccagccgcucaugcagcugcccaaccuguccaccaucaaccucggcaucaacuucaucaagcagaucgacuucaagcuguuccagaacuucagcaaccuggagaucaucuaccucuccgagaaccggaucagcccccuggugaaggacacgcgccaguccuacgccaacagcuccagcuuccagcggcacauccgcaagcggcgcagcaccgacuucgaguucgacccccacuccaacuucuaccacuucacccggccgcugaucaagccccagugcgccgccuacggcaaggcccucgaccugagccugaacuccaucuucuucaucgggcccaaccaguucgagaaccuccccgacaucgcgugccugaaccugagcgccaacuccaacgcccagguccucagcggcaccgaguucuccgccaucccgcacgugaaguaccuggaccugacgaacaaccgccucgacuucgacaacgccagcgcgcugaccgagcuguccgaccucgaggugcuggaccugagcuacaacucccacuacuuccgcaucgccggggucacccaccaccucgaguucauccagaacuucaccaaccugaaggugcugaaccucagccacaacaacaucuacacgcugaccgacaaguacaaccuggaguccaagagccucguggagcuggucuucuccggcaaccggcuggacauccucuggaacgacgacgacaaccgcuacaucagcaucuucaaggggcugaagaaccugacccggcucgaccugucccugaaccgccucaagcacauccccaacgaggccuuccugaaccugcccgccagccucaccgagcugcacaucaacgacaacaugcugaaguucuucaacuggacgcuccugcagcaguucccccggcuggagcuccuggaccugcgcggcaacaagcuccuguuccugaccgacagccucuccgacuucaccagcucccugcggacccugcuccugagccacaaccgcaucucccaccucccgagcggcuuccuguccgaggugagcucccugaagcaccuggaccucagcuccaaccugcugaagacgaucaacaagagcgcccucgagaccaagaccaccacgaagcuguccaugcuggagcuccacgggaaccccuucgagugcacgugcgacaucggcgacuuccggcgcuggauggacgagcaccugaacgugaagaucccccggcuggucgacgugaucugcgcgagcccgggggaccagcgcggcaaguccaucgugagccucgagcugacgaccugcgucuccgacgugaccgccgucauccuguucuucuucaccuucuucaucaccaccauggugaugcucgccgcccuggcccaccaccuguucuacugggacgugugguucaucuacaacgucugccucgcgaaggugaagggguaccggagccuguccaccagccagaccuucuacgacgccuacaucagcuacgacaccaaggacgccuccgugaccgacugggucaucaacgagcugcgcuaccaccucgaggagagccgggacaagaacgugcugcugugccucgaggagcgcgacugggaccccggccuggccaucaucgacaaccugaugcaguccaucaaccagagcaagaagaccguguucguccugacgaagaaguacgcgaaguccuggaacuucaagaccgccuucuaccucgcccugcagcggcugauggacgagaacauggacgugaucaucuucauccuccuggagcccgugcugcagcacagccaguaccuccgccugcggcagcgcaucugcaaguccagcauccugcaguggcccgacaacccgaaggccgagggccucuucuggcagacccugcgcaacgucgugcugaccgagaacgacucccgguacaacaacauguacguggacagcaucaagcaguacuga

SEQ ID NO: 596 - RNA, 66 nt, Artificial Sequence
  P16671_TM_1_8-29
ggccugaucgccggggccgugaucggcgcgguccucgccguguucgggggcauccugaugcccgug

SEQ ID NO: 597 - RNA, 81 nt, Artificial Sequence
  P32248_TM_1_60-86
uuccugcccaucauguacagcaucaucugcuucgugggccuccuggggaacggccuggucgugcucaccuacaucuacuuc

SEQ ID NO: 598 - RNA, 66 nt, Artificial Sequence
  P16671_TM_2_440-461
cugcucggccugaucgagaugauccugcucagcgugggggucgugauguucguggccuucaugauc

SEQ ID NO: 599 - RNA, 63 nt, Artificial Sequence
  P32248_TM_2_96-116
uaccugcucaaccuggccguggccgacauccuguuccuccugacccugcccuucugggcguac

SEQ ID NO: 600 - RNA, 66 nt, Artificial Sequence
  P32248_TM_3_131-152
cugaucuucgccaucuacaagaugagcuucuucuccggcaugcuccugcugcucugcaucagcauc

SEQ ID NO: 601 - RNA, 63 nt, Artificial Sequence
  P32248_TM_4_171-191
gugcugcucaucagcaagcuguccugcgucggcaucuggauccuggccaccgugcucagcauc

SEQ ID NO: 602 - RNA, 84 nt, Artificial Sequence
  P32248_TM_5_220-247
uucaucaccauccagguggcccagauggucaucggcuuccuggugccccuccuggccaugagcuucugcuaccuggugaucauc

SEQ ID NO: 603 - RNA, 78 nt, Artificial Sequence
  P32248_TM_6_264-289
gugaucaucgccgucgugguggucuucaucguguuccagcugcccuacaacggcgugguccucgcccagaccguggcg

SEQ ID NO: 604 - RNA, 54 nt, Artificial Sequence
  P32248_TM_7_314-331
cuggccugcgugcgcugcugcgucaaccccuuccucuacgccuucaucggcgug

SEQ ID NO: 605 - RNA, 69 nt, Artificial Sequence
  A0A5B9_TM_145-167
accauccuguacgagauccuccugggcaaggccacccuguacgccgugcucgucagcgcgcuggugcug

SEQ ID NO: 606 - RNA, 69 nt, Artificial Sequence
  B7Z8K6_TM_130-152
cugggccuccgcaugcuguucgccaagaccguggccgucaacuuccugcucaccgcgaagcuguucuuc

SEQ ID NO: 607 - RNA, 63 nt, Artificial Sequence
  O00206_TM_632-652
accaucaucggcgugagcguccuguccgugcucguggucagcgugguggccguccugguguac

SEQ ID NO: 608 - RNA, 66 nt, Artificial Sequence
  P01730_TM_397-418
auggcccugaucgugcucggcggggucgccggccugcuccuguucaucgggcugggcaucuucuuc

SEQ ID NO: 609 - RNA, 63 nt, Artificial Sequence
  P01850_TM_151-171
auccugcucggcaaggccacccuguacgccgugcuggucagcgcgcucgugcugauggccaug

SEQ ID NO: 610 - RNA, 78 nt, Artificial Sequence
  P07766_TM_127-152
gugaugagcgucgccaccaucgugaucguggacaucugcaucaccggcgggcugcuccugcuggucuacuacuggucc

SEQ ID NO: 611 - RNA, 66 nt, Artificial Sequence
  P08575_TM_576-597
gcccugaucgccuuccucgcguuccugaucaucgugaccagcaucgcccugcucgucgugcuguac

SEQ ID NO: 612 - RNA, 63 nt, Artificial Sequence
  P08637_TM_209-229
gugagcuucugccuggucauggugcuccuguucgccguggacaccggccuguacuucuccguc

SEQ ID NO: 613 - RNA, 81 nt, Artificial Sequence
  P10747_TM_153-179
uucugggugcuggucguggugggcgggguccucgccugcuacagccugcuggugaccguggccuucaucaucuucuggguc

SEQ ID NO: 614 - RNA, 66 nt, Artificial Sequence
  P11912_TM_144-165
aucaucaccgccgagggcaucauccugcuguucugcgccgugguccccgggacccugcuccucuuc

SEQ ID NO: 615 - RNA, 66 nt, Artificial Sequence
  P15391_TM_292-313
gugagcgccgucacccuggccuaccucaucuucugccugugcucccuggugggcauccuccaccug

SEQ ID NO: 616 - RNA, 63 nt, Artificial Sequence
  P16410_TM_162-182
uuccugcucuggauccuggccgccgugagcuccggccuguucuucuacagcuuccuccugacc

SEQ ID NO: 617 - RNA, 63 nt, Artificial Sequence
  P26718_TM_52-72
cccuucuucuucugcugcuucaucgccguggccaugggcauccgcuucaucaucauggucgcg

SEQ ID NO: 618 - RNA, 63 nt, Artificial Sequence
  P30273_TM_24-44
cugugcuacauccucgacgccauccuguuccuguacggcaucgugcucacccugcuguacugc

SEQ ID NO: 619 - RNA, 63 nt, Artificial Sequence
  P40259_TM_160-180
ggcaucaucaugauccagacccugcucaucauccuguucaucaucgugcccaucuuccugcuc

SEQ ID NO: 620 - RNA, 63 nt, Artificial Sequence
  P42081_TM_248-268
uggaucaccgccgugcugcccaccgucaucaucugcgugaugguguucugccucauccugugg

SEQ ID NO: 621 - RNA, 63 nt, Artificial Sequence
  Q15762_TM_255-275
ggcgggaccgugcugcuccugcuguucgucaucagcaucaccacgaucaucgugaucuuccuc

SEQ ID NO: 622 - RNA, 63 nt, Artificial Sequence
  Q685J3_TM_4394-4414
cuggugggcgccggggucgugcucaugcugaucauccugguggcccuccugaugcuggucuuc

SEQ ID NO: 623 - RNA, 63 nt, Artificial Sequence
  Q9NNX6_TM_38-58
cugggccacgggccccucgugcugcagcugcucagcuucacccugcuggccggccuccugguc

SEQ ID NO: 624 - RNA, 63 nt, Artificial Sequence
  Q9NR97_TM_828-848
gccgugauccuguucuucuucaccuucuucaucaccacgauggucaugcucgccgcgcuggcc

SEQ ID NO: 625 - RNA, 48 nt, Artificial Sequence
  P14207_1-16
auggucuggaaguggaugccccuccuccuccuccucgucugcgucgcc

SEQ ID NO: 626 - RNA, 48 nt, Artificial Sequence
  O75787_1-16
auggccgucuucgucguccuccucgcccucgucgccggcguccucggc

SEQ ID NO: 627 - RNA, 48 nt, Artificial Sequence
  P07359_1-16
augccccuccuccuccuccuccuccuccuccccuccccccuccacccc

SEQ ID NO: 628 - RNA, 48 nt, Artificial Sequence
  P08637_1-16
auguggcagcuccuccuccccaccgcccuccuccuccucgucuccgcc

SEQ ID NO: 629 - RNA, 51 nt, Artificial Sequence
  P07237_1-17
augcuccgccgcgcccuccucugccucgccgucgccgcccucguccgcgcc

SEQ ID NO: 630 - RNA, 51 nt, Artificial Sequence
  O60911_1-17
augaaccucucccucguccucgccgccuucugccucggcaucgccuccgcc

SEQ ID NO: 631 - RNA, 51 nt, Artificial Sequence
  P20138_1-17
augccccuccuccuccuccucccccuccucugggccggcgcccucgccaug

SEQ ID NO: 632 - RNA, 51 nt, Artificial Sequence
  P27797_1-17
augcuccucuccgucccccuccuccucggccuccucggccucgccgucgcc

SEQ ID NO: 633 - RNA, 54 nt, Artificial Sequence
  P10747_1-18
augcuccgccuccuccucgcccucaaccucuuccccuccauccaggucaccggc

SEQ ID NO: 634 - RNA, 54 nt, Artificial Sequence
  O75487_1-18
auggcccgcuucggccuccccgcccuccucugcacccucgccguccucuccgcc

SEQ ID NO: 635 - RNA, 54 nt, Artificial Sequence
  P07996_1-18
augggccucgccuggggccucggcguccucuuccucaugcacgucugcggcacc

SEQ ID NO: 636 - RNA, 54 nt, Artificial Sequence
  P22748_1-18
augcgcaugcuccucgcccuccucgcccucuccgccgcccgccccuccgccucc

SEQ ID NO: 637 - RNA, 54 nt, Artificial Sequence
  Q15762_1-18
auggacuaccccacccuccuccucgcccuccuccacgucuaccgcgcccucugc

SEQ ID NO: 638 - RNA, 54 nt, Artificial Sequence
  P30273_1-18
augauccccgccgucguccuccuccuccuccuccucgucgagcaggccgccgcc

SEQ ID NO: 639 - RNA, 54 nt, Artificial Sequence
  P38570_1-18
auguggcucuuccacacccuccucugcaucgccucccucgcccuccucgccgcc

SEQ ID NO: 640 - RNA, 54 nt, Artificial Sequence
  Q01638_1-18
augggcuucuggauccucgccauccucaccauccucauguacuccaccgccgcc

SEQ ID NO: 641 - RNA, 54 nt, Artificial Sequence
  Q9NZQ7_1-18
augcgcaucuucgccgucuucaucuucaugaccuacuggcaccuccucaacgcc

SEQ ID NO: 642 - RNA, 57 nt, Artificial Sequence
  P13591_1-19
augcuccagaccaaggaccucaucuggacccucuucuuccucggcaccgccgucucc

SEQ ID NO: 643 - RNA, 57 nt, Artificial Sequence
  P26842_1-19
auggcccgcccccaccccugguggcucugcguccucggcacccucgucggccucucc

SEQ ID NO: 644 - RNA, 57 nt, Artificial Sequence
  P15391_1-19
augccccccccccgccuccucuucuuccuccucuuccucacccccauggagguccgc

SEQ ID NO: 645 - RNA, 57 nt, Artificial Sequence
  Q8NI17_1-19
augauguggaccugggcccucuggaugcuccccucccucugcaaguucucccucgcc

SEQ ID NO: 646 - RNA, 57 nt, Artificial Sequence
  P08571_1-19
auggagcgcgccuccugccuccuccuccuccuccucccccucguccacgucuccgcc

SEQ ID NO: 647 - RNA, 57 nt, Artificial Sequence
  P05154_1-19
augcagcucuuccuccuccucugccucguccuccucuccccccagggcgccucccuc

SEQ ID NO: 648 - RNA, 57 nt, Artificial Sequence
  P02787_1-19
augcgccucgccgucggcgcccuccucgucugcgccguccucggccucugccucgcc

SEQ ID NO: 649 - RNA, 57 nt, Artificial Sequence
  P02671_1-19
auguucuccaugcgcaucgucugccucguccucuccgucgucggcaccgccuggacc

SEQ ID NO: 650 - RNA, 57 nt, Artificial Sequence
  P04216_1-19
augaaccucgccaucuccaucgcccuccuccucaccguccuccaggucucccgcggc

SEQ ID NO: 651 - RNA, 57 nt, Artificial Sequence
  P00747_1-19
auggagcacaaggaggucguccuccuccuccuccucuuccucaaguccggccagggc

SEQ ID NO: 652 - RNA, 57 nt, Artificial Sequence
  P01764_1-19
auggaguucggccucuccuggcucuuccucgucgccauccucaagggcguccagugc

SEQ ID NO: 653 - RNA, 57 nt, Artificial Sequence
  P16150_1-19
auggccacccuccuccuccuccucggcguccucgucgucucccccgacgcccucggc

SEQ ID NO: 654 - RNA, 57 nt, Artificial Sequence
  Q6DN72_1-19
augcuccucuggaccgccguccuccucuucguccccugcgucggcaagaccgucugg

SEQ ID NO: 655 - RNA, 57 nt, Artificial Sequence
  Q01151_1-19
augucccgcggccuccagcuccuccuccucuccugcgccuacucccucgcccccgcc

SEQ ID NO: 656 - RNA, 57 nt, Artificial Sequence
  P07093_1-19
augaacuggcaccucccccucuuccuccucgccuccgucacccuccccuccaucugc

SEQ ID NO: 657 - RNA, 57 nt, Artificial Sequence
  Q8WWQ8_1-19
augaugcuccagcaccucgucaucuucugccucggccucgucguccagaacuucugc

SEQ ID NO: 658 - RNA, 60 nt, Artificial Sequence
  Q13291_1-20
auggaccccaagggccuccucucccucaccuucguccucuuccucucccucgccuucggc

SEQ ID NO: 659 - RNA, 60 nt, Artificial Sequence
  P35225_1-20
auggcccuccuccucaccaccgucaucgcccucaccugccucggcggcuucgccuccccc

SEQ ID NO: 660 - RNA, 60 nt, Artificial Sequence
  P25942_1-20
augguccgccucccccuccagugcguccucuggggcugccuccucaccgccguccacccc

SEQ ID NO: 661 - RNA, 60 nt, Artificial Sequence
  P52803_1-20
augcuccacgucgagaugcucacccucgucuuccucguccucuggaugugcgucuucucc

SEQ ID NO: 662 - RNA, 60 nt, Artificial Sequence
  Q15116_1-20
augcagaucccccaggcccccuggcccgucgucugggccguccuccagcucggcuggcgc

SEQ ID NO: 663 - RNA, 60 nt, Artificial Sequence
  P05556_1-20
augaaccuccagcccaucuucuggaucggccucaucuccuccgucugcugcgucuucgcc

SEQ ID NO: 664 - RNA, 60 nt, Artificial Sequence
  Q12891_1-20
augcgcgccggccccggccccaccgucacccucgcccucguccucgccgucgccugggcc

SEQ ID NO: 665 - RNA, 60 nt, Artificial Sequence
  Q8IV16_1-20
augaaggcccucggcgccguccuccucgcccuccuccucugcggccgccccggccgcggc

SEQ ID NO: 666 - RNA, 60 nt, Artificial Sequence
  Q03167_1-20
augaccucccacuacgucaucgccaucuucgcccucauguccuccugccucgccaccgcc

SEQ ID NO: 667 - RNA, 60 nt, Artificial Sequence
  Q14246_1-20
augcgcggcuucaaccuccuccucuucuggggcugcugcgucaugcacuccugggagggc

SEQ ID NO: 668 - RNA, 60 nt, Artificial Sequence
  P16871_1-20
augaccauccucggcaccaccuucggcauggucuucucccuccuccaggucgucuccggc

SEQ ID NO: 669 - RNA, 60 nt, Artificial Sequence
  P61769_1-20
augucccgcuccgucgcccucgccguccucgcccuccucucccucuccggccucgaggcc

SEQ ID NO: 670 - RNA, 60 nt, Artificial Sequence
  Q9Y6W8_1-20
augaaguccggccucugguacuucuuccucuucugccuccgcaucaagguccucaccggc

SEQ ID NO: 671 - RNA, 63 nt, Artificial Sequence
  P10966_1-21
augcgcccccgccucuggcuccuccucgccgcccagcucaccguccuccacggcaacuccguc

SEQ ID NO: 672 - RNA, 63 nt, Artificial Sequence
  Q9BZW8_1-21
augcucggccaggucgucacccucauccuccuccuccuccucaaggucuaccagggcaagggc

SEQ ID NO: 673 - RNA, 63 nt, Artificial Sequence
  P02778_1-21
augaaccagaccgccauccucaucugcugccucaucuuccucacccucuccggcauccagggc

SEQ ID NO: 674 - RNA, 63 nt, Artificial Sequence
  P18564_1-21
augggcaucgagcuccucugccucuucuuccucuuccucggccgcaacgaccacguccagggc

SEQ ID NO: 675 - RNA, 63 nt, Artificial Sequence
  O14525_1-21
auggcccucgccggccucugcgcccuccucgccugcugcuggggccccgccgccguccucgcc

SEQ ID NO: 676 - RNA, 63 nt, Artificial Sequence
  P01130_1-21
augggccccuggggcuggaagcuccgcuggaccgucgcccuccuccucgccgccgccggcacc

SEQ ID NO: 677 - RNA, 63 nt, Artificial Sequence
  P01732_1-21
auggcccuccccgucaccgcccuccuccucccccucgcccuccuccuccacgccgcccgcccc

SEQ ID NO: 678 - RNA, 63 nt, Artificial Sequence
  P48061_1-21
augaacgccaaggucgucgucguccucguccucguccucaccgcccucugccucuccgacggc

SEQ ID NO: 679 - RNA, 63 nt, Artificial Sequence
  P01589_1-21
auggacuccuaccuccucauguggggccuccucaccuucaucaugguccccggcugccaggcc

SEQ ID NO: 680 - RNA, 63 nt, Artificial Sequence
  Q86T13_1-21
augcgccccgccuucgcccucugccuccucuggcaggcccucuggcccggccccggcggcggc

SEQ ID NO: 681 - RNA, 63 nt, Artificial Sequence
  Q5DID0_1-21
augcuccgcaccuccggccucgcccuccucgcccucgucuccgccgucggccccucccaggcc

SEQ ID NO: 682 - RNA, 66 nt, Artificial Sequence
  P40189_1-22
augcucacccuccagaccuggcucguccaggcccucuucaucuuccucaccaccgaguccaccggc

SEQ ID NO: 683 - RNA, 66 nt, Artificial Sequence
  Q86YL7_1-22
auguggaaggucuccgcccuccucuucguccucggcuccgccucccucuggguccucgccgagggc

SEQ ID NO: 684 - RNA, 66 nt, Artificial Sequence
  P55075_1-22
augggcuccccccgcuccgcccucuccugccuccuccuccaccuccucguccucugccuccaggcc

SEQ ID NO: 685 - RNA, 66 nt, Artificial Sequence
  Q30201_1-22
augggcccccgcgcccgccccgcccuccuccuccucaugcuccuccagaccgccguccuccagggc

SEQ ID NO: 686 - RNA, 66 nt, Artificial Sequence
  P07766_1-22
augcaguccggcacccacuggcgcguccucggccucugccuccucuccgucggcgucuggggccag

SEQ ID NO: 687 - RNA, 66 nt, Artificial Sequence
  P18827_1-22
augcgccgcgccgcccucuggcucuggcucugcgcccucgcccucucccuccagcccgcccucccc

SEQ ID NO: 688 - RNA, 66 nt, Artificial Sequence
  P55290_1-22
augcagccccgcaccccccucguccucugcguccuccucucccagguccuccuccucaccuccgcc

SEQ ID NO: 689 - RNA, 66 nt, Artificial Sequence
  P37173_1-22
augggccgcggccuccuccgcggccucuggccccuccacaucguccucuggacccgcaucgccucc

SEQ ID NO: 690 - RNA, 66 nt, Artificial Sequence
  Q07325_1-22
augaagaaguccggcguccucuuccuccucggcaucauccuccucguccucaucggcguccagggc

SEQ ID NO: 691 - RNA, 66 nt, Artificial Sequence
  P04156_1-22
auggccaaccucggcugcuggaugcucguccucuucgucgccaccugguccgaccucggccucugc

SEQ ID NO: 692 - RNA, 66 nt, Artificial Sequence
  P31785_1-22
augcucaagcccucccuccccuucaccucccuccucuuccuccagcucccccuccucggcgucggc

SEQ ID NO: 693 - RNA, 69 nt, Artificial Sequence
  P01579_1-23
augaaguacaccuccuacauccucgccuuccagcucugcaucguccucggcucccucggcugcuacugc

SEQ ID NO: 694 - RNA, 69 nt, Artificial Sequence
  P23229_1-23
auggccgccgccggccagcucugccuccucuaccucuccgccggccuccucucccgccucggcgccgcc

SEQ ID NO: 695 - RNA, 69 nt, Artificial Sequence
  O60494_1-23
augaugaacaugucccuccccuuccucuggucccuccucacccuccucaucuucgccgaggucaacggc

SEQ ID NO: 696 - RNA, 69 nt, Artificial Sequence
  P08575_1-23
auguaccucuggcucaagcuccucgccuucggcuucgccuuccucgacaccgaggucuucgucaccggc

SEQ ID NO: 697 - RNA, 69 nt, Artificial Sequence
  Q8IWY4_1-23
augggcgccgccgccguccgcuggcaccucugcguccuccucgcccucggcacccgcggccgccucgcc

SEQ ID NO: 698 - RNA, 69 nt, Artificial Sequence
  Q08431_1-23
augccccgcccccgccuccucgccgcccucugcggcgcccuccucugcgcccccucccuccucgucgcc

SEQ ID NO: 699 - RNA, 69 nt, Artificial Sequence
  Q99665_1-23
auggcccacaccuuccgcggcugcucccucgccuucauguucaucaucaccuggcuccucaucaaggcc

SEQ ID NO: 700 - RNA, 69 nt, Artificial Sequence
  Q6Q8B3_1-23
auguccgccccccgccuccucaucuccaucaucaucauggucuccgccuccuccuccuccugcaugggc

SEQ ID NO: 701 - RNA, 69 nt, Artificial Sequence
  Q07011_1-23
augggcaacuccugcuacaacaucgucgccacccuccuccucguccucaacuucgagcgcacccgcucc

SEQ ID NO: 702 - RNA, 69 nt, Artificial Sequence
  Q8NHL6_1-23
augacccccauccucaccguccucaucugccucggccucucccucggcccccgcacccacguccaggcc

SEQ ID NO: 703 - RNA, 69 nt, Artificial Sequence
  P36894_1-23
augccccagcucuacaucuacauccgccuccucggcgccuaccucuucaucaucucccgcguccagggc

SEQ ID NO: 704 - RNA, 69 nt, Artificial Sequence
  Q16552_1-23
augacccccggcaagaccucccucgucucccuccuccuccuccucucccucgaggccaucgucaaggcc

SEQ ID NO: 705 - RNA, 69 nt, Artificial Sequence
  P42081_1-23
auggacccccagugcaccaugggccucuccaacauccucuucgucauggccuuccuccucuccggcgcc

SEQ ID NO: 706 - RNA, 69 nt, Artificial Sequence
  P43121_1-23
augggccucccccgccucgucugcgccuuccuccucgccgccugcugcugcugcccccgcgucgccggc

SEQ ID NO: 707 - RNA, 69 nt, Artificial Sequence
  O00206_1-23
augauguccgccucccgccucgccggcacccucauccccgccauggccuuccucuccugcguccgcccc

SEQ ID NO: 708 - RNA, 69 nt, Artificial Sequence
  P42701_1-23
auggagccccucgucaccugggucgucccccuccucuuccucuuccuccucucccgccagggcgccgcc

SEQ ID NO: 709 - RNA, 72 nt, Artificial Sequence
  P06729_1-24
auguccuuccccugcaaguucgucgccuccuuccuccucaucuucaacgucuccuccaagggcgccgucucc

SEQ ID NO: 710 - RNA, 72 nt, Artificial Sequence
  P15328_1-24
auggcccagcgcaugaccacccagcuccuccuccuccucgucugggucgccgucgucggcgaggcccagacc

SEQ ID NO: 711 - RNA, 72 nt, Artificial Sequence
  P05112_1-24
augggccucaccucccagcuccuccccccccucuucuuccuccucgccugcgccggcaacuucguccacggc

SEQ ID NO: 712 - RNA, 72 nt, Artificial Sequence
  P06127_1-24
augcccaugggcucccuccagccccucgccacccucuaccuccucggcaugcucgucgccuccugccucggc

SEQ ID NO: 713 - RNA, 72 nt, Artificial Sequence
  P32248_1-24
auggaccucggcaagcccaugaaguccguccucgucgucgcccuccucgucaucuuccaggucugccucugc

SEQ ID NO: 714 - RNA, 72 nt, Artificial Sequence
  Q7Z7D3_1-24
auggccucccucggccagauccucuucugguccaucaucuccaucaucaucauccucgccggcgccaucgcc

SEQ ID NO: 715 - RNA, 72 nt, Artificial Sequence
  P54756_1-24
augcgcggcuccggcccccgcggcgccggccgccgccgcccccccuccggcggcggcgacacccccaucacc

SEQ ID NO: 716 - RNA, 72 nt, Artificial Sequence
  Q92823_1-24
augcagcucaagaucaugcccaagaagaagcgccucuccgccggccgcgucccccucauccucuuccucugc

SEQ ID NO: 717 - RNA, 72 nt, Artificial Sequence
  P19320_1-24
augcccggcaagauggucgucauccucggcgccuccaacauccucuggaucauguucgccgccucccaggcc

SEQ ID NO: 718 - RNA, 72 nt, Artificial Sequence
  Q86UN2_1-24
augcuccgcaagggcugcugcgucgagcuccuccuccuccucgucgccgccgagcucccccucggcggcggc

SEQ ID NO: 719 - RNA, 75 nt, Artificial Sequence
  P33151_1-25
augcagcgccucaugaugcuccucgccaccuccggcgccugccucggccuccucgccgucgccgccgucgccgcc

SEQ ID NO: 720 - RNA, 75 nt, Artificial Sequence
  P17813_1-25
auggaccgcggcacccucccccucgccgucgcccuccuccucgccuccugcucccucucccccaccucccucgcc

SEQ ID NO: 721 - RNA, 75 nt, Artificial Sequence
  P25445_1-25
augcucggcaucuggacccuccucccccucguccucaccuccgucgcccgccucuccuccaaguccgucaacgcc

SEQ ID NO: 722 - RNA, 75 nt, Artificial Sequence
  P01730_1-25
augaaccgcggcguccccuuccgccaccuccuccucguccuccagcucgcccuccuccccgccgccacccagggc

SEQ ID NO: 723 - RNA, 75 nt, Artificial Sequence
  Q685J3_1-25
augccccgccccggcaccauggcccucugccuccucacccucguccucucccuccuccccccccaggccgccgcc

SEQ ID NO: 724 - RNA, 75 nt, Artificial Sequence
  P17787_1-25
auggcccgccgcugcggccccgucgcccuccuccucggcuucggccuccuccgccucugcuccggcgucuggggc

SEQ ID NO: 725 - RNA, 75 nt, Artificial Sequence
  Q6UQ28_1-25
auggccgucuuccacgacaugcuccuccagccccucggcauguuccucugccucucccuccagcucuccuccgcc

SEQ ID NO: 726 - RNA, 75 nt, Artificial Sequence
  P13987_1-25
augggcauccagggcggcuccguccucuucggccuccuccucguccucgccgucuucugccacuccggccacucc

SEQ ID NO: 727 - RNA, 75 nt, Artificial Sequence
  P10721_1-25
augcgcggcgcccgcggcgccugggacuuccucugcguccuccuccuccuccuccgcguccagaccggcuccucc

SEQ ID NO: 728 - RNA, 75 nt, Artificial Sequence
  P12319_1-25
auggcccccgccauggagucccccacccuccucugcgucgcccuccucuucuucgcccccgacggcguccucgcc

SEQ ID NO: 729 - RNA, 78 nt, Artificial Sequence
  Q9BZR6_1-26
augaagcgcgccuccgccggcggcucccgccuccucgccuggguccucuggcuccaggccuggcaggucgccgccccc

SEQ ID NO: 730 - RNA, 78 nt, Artificial Sequence
  P25063_1-26
augggccgcgccauggucgcccgccucggccucggccuccuccuccucgcccuccuccuccccacccagaucuacucc

SEQ ID NO: 731 - RNA, 78 nt, Artificial Sequence
  Q9NR97_1-26
auggagaacauguuccuccaguccuccaugcucaccugcaucuuccuccucaucuccggcuccugcgagcucugcgcc

SEQ ID NO: 732 - RNA, 78 nt, Artificial Sequence
  Q8N131_1-26
augggccucggcgcccgcggcgccugggccgcccuccuccucggcacccuccagguccucgcccuccucggcgccgcc

SEQ ID NO: 733 - RNA, 78 nt, Artificial Sequence
  P49771_1-26
augaccguccucgcccccgccuggucccccaccaccuaccuccuccuccuccuccuccucuccuccggccucuccggc

SEQ ID NO: 734 - RNA, 78 nt, Artificial Sequence
  P02679_1-26
auguccuggucccuccacccccgcaaccucauccucuacuucuacgcccuccucuuccucuccuccaccugcgucgcc

SEQ ID NO: 735 - RNA, 78 nt, Artificial Sequence
  P14784_1-26
auggccgcccccgcccucuccuggcgccucccccuccucauccuccuccucccccucgccaccuccugggccuccgcc

SEQ ID NO: 736 - RNA, 81 nt, Artificial Sequence
  P05362_1-27
auggcccccuccuccccccgccccgcccuccccgcccuccucguccuccucggcgcccucuuccccggccccggcaacgcc

SEQ ID NO: 737 - RNA, 81 nt, Artificial Sequence
  Q13740_1-27
auggaguccaagggcgccuccuccugccgccuccucuucugccuccucaucuccgccaccgucuuccgccccggccucggc

SEQ ID NO: 738 - RNA, 84 nt, Artificial Sequence
  Q13443_1-28
augggcuccggcgcccgcuuccccuccggcacccuccgcguccgcuggcuccuccuccucggccucgucggccccguccucggc

SEQ ID NO: 739 - RNA, 84 nt, Artificial Sequence
  P14151_1-28
augaucuuccccuggaagugccaguccacccagcgcgaccucuggaacaucuucaagcucuggggcuggaccaugcucugcugc

SEQ ID NO: 740 - RNA, 84 nt, Artificial Sequence
  P56199_1-28
auggccccccgcccccgcgcccgccccggcgucgccgucgccugcugcuggcuccucaccgucguccuccgcugcugcgucucc

SEQ ID NO: 741 - RNA, 84 nt, Artificial Sequence
  P11279_1-28
auggccgcccccggcuccgcccgccgcccccuccuccuccuccuccuccuccuccuccucggccucaugcacugcgccuccgcc

SEQ ID NO: 742 - RNA, 84 nt, Artificial Sequence
  P40259_1-28
auggcccgccucgcccucucccccguccccucccacuggauggucgcccuccuccuccuccucuccgccgagcccguccccgcc

SEQ ID NO: 743 - RNA, 84 nt, Artificial Sequence
  P43681_1-28
auggagcucggcggccccggcgccccccgccuccuccccccccuccuccuccuccucggcaccggccuccuccgcgccuccucc

SEQ ID NO: 744 - RNA, 84 nt, Artificial Sequence
  P18627_1-28
augugggaggcccaguuccucggccuccucuuccuccagccccucugggucgcccccgucaagccccuccagcccggcgccgag

SEQ ID NO: 745 - RNA, 84 nt, Artificial Sequence
  Q5ZPR3_1-28
augcuccgccgccgcggcucccccggcaugggcguccacgucggcgccgcccucggcgcccucugguucugccucaccggcgcc

SEQ ID NO: 746 - RNA, 84 nt, Artificial Sequence
  P23415_1-28
auguacuccuucaacacccuccgccucuaccucugggagaccaucgucuucuucucccucgccgccuccaaggaggccgaggcc

SEQ ID NO: 747 - RNA, 84 nt, Artificial Sequence
  Q8TD46_1-28
augcucugccccuggcgcaccgccaaccucggccuccuccucauccucaccaucuuccucgucgccgccuccuccucccucugc

SEQ ID NO: 748 - RNA, 87 nt, Artificial Sequence
  P17301_1-29
augggccccgagcgcaccggcgccgccccccucccccuccuccucguccucgcccucucccagggcauccucaacugcugccucgcc

SEQ ID NO: 749 - RNA, 87 nt, Artificial Sequence
  P12821_1-29
augggcgccgccuccggccgccgcggccccggccuccuccucccccucccccuccuccuccuccuccccccccagcccgcccucgcc

SEQ ID NO: 750 - RNA, 87 nt, Artificial Sequence
  Q14118_1-29
augcgcauguccgucggccucucccuccuccucccccucuggggccgcaccuuccuccuccuccucuccgucgucauggcccagucc

SEQ ID NO: 751 - RNA, 87 nt, Artificial Sequence
  P05231_1-29
augaacuccuucuccaccuccgccuucggccccgucgccuucucccucggccuccuccucguccuccccgccgccuuccccgccccc

SEQ ID NO: 752 - RNA, 87 nt, Artificial Sequence
  O00602_1-29
auggagcucuccggcgccaccauggcccgcggccucgccguccuccucguccucuuccuccacaucaagaaccuccccgcccaggcc

SEQ ID NO: 753 - RNA, 87 nt, Artificial Sequence
  Q9Y6Q6_1-29
auggccccccgcgcccgccgccgccgcccccucuucgcccuccuccuccucugcgcccuccucgcccgccuccaggucgcccuccag

SEQ ID NO: 754 - RNA, 87 nt, Artificial Sequence
  Q9ULI3_1-29
auggccuccccccgcgccucccgcuggccccccccccuccuccuccuccuccucccccuccuccuccucccccccgccgcccccggc

SEQ ID NO: 755 - RNA, 90 nt, Artificial Sequence
  Q8NBP7_1-30
augggcaccgucuccucccgccgcuccugguggccccucccccuccuccuccuccuccuccuccuccucggccccgccggcgcccgcgcc

SEQ ID NO: 756 - RNA, 90 nt, Artificial Sequence
  P02675_1-30
augaagcgcauggucuccugguccuuccacaagcucaagaccaugaagcaccuccuccuccuccuccucugcgucuuccucgucaagucc

SEQ ID NO: 757 - RNA, 90 nt, Artificial Sequence
  P06756_1-30
auggccuuccccccccgccgccgccuccgccucggcccccgcggccucccccuccuccucuccggccuccuccucccccucugccgcgcc

SEQ ID NO: 758 - RNA, 93 nt, Artificial Sequence
  O60609_1-31
augguccgcccccucaacccccgcccccucccccccgucguccucaugcuccuccuccuccucccccccuccccccucccccucgccgccggc

SEQ ID NO: 759 - RNA, 93 nt, Artificial Sequence
  P50895_1-31
auggagccccccgacgcccccgcccaggcccgcggcgccccccgccuccuccuccucgccguccuccucgccgcccaccccgacgcccaggcc

SEQ ID NO: 760 - RNA, 93 nt, Artificial Sequence
  P28906_1-31
augcucguccgccgcggcgcccgcgccggcccccgcaugccccgcggcuggaccgcccucugccuccucucccuccuccccuccggcuucaug

SEQ ID NO: 761 - RNA, 93 nt, Artificial Sequence
  P08514_1-31
auggcccgcgcccucugcccccuccaggcccucuggcuccucgaguggguccuccuccuccucggccccugcgccgccccccccgccugggcc

SEQ ID NO: 762 - RNA, 93 nt, Artificial Sequence
  P00742_1-31
augggccgcccccuccaccucguccuccucuccgccucccucgccggccuccuccuccucggcgagucccucuucauccgccgcgagcaggcc

SEQ ID NO: 763 - RNA, 96 nt, Artificial Sequence
  P26006_1-32
augggccccggccccucccgcgccccccgcgccccccgccucaugcucugcgcccucgcccucauggucgccgccggcggcugcgucgucuccgcc

SEQ ID NO: 764 - RNA, 96 nt, Artificial Sequence
  P13726_1-32
auggagacccccgccuggccccgcgucccccgccccgagaccgccgucgcccgcacccuccuccucggcugggucuucgcccaggucgccggcgcc

SEQ ID NO: 765 - RNA, 96 nt, Artificial Sequence
  P11912_1-32
augcccggcggccccggcguccuccaggcccuccccgccaccaucuuccuccucuuccuccucuccgccgucuaccucggccccggcugccaggcc

SEQ ID NO: 766 - RNA, 96 nt, Artificial Sequence
  Q9H6X2_1-32
auggccaccgccgagcgccgcgcccucggcaucggcuuccaguggcucucccucgccacccucguccucaucugcgccggccagggcggccgccgc

SEQ ID NO: 767 - RNA, 99 nt, Artificial Sequence
  Q8IWK6_1-33
auggagccccccggccgccgccgcggccgcgcccagcccccccuccuccucccccucucccuccucgcccuccucgcccuccucggcggcggcggcggc

SEQ ID NO: 768 - RNA, 99 nt, Artificial Sequence
  P58335_1-33
auggucgccgagcgcucccccgcccgcucccccggcuccuggcucuuccccggccucuggcuccucguccucuccggccccggcggccuccuccgcgcc

SEQ ID NO: 769 - RNA, 102 nt, Artificial Sequence
  P06731_1-34
auggagucccccuccgcccccccccaccgcuggugcauccccuggcagcgccuccuccucaccgccucccuccucaccuucuggaacccccccaccaccgcc

SEQ ID NO: 770 - RNA, 102 nt, Artificial Sequence
  P33681_1-34
augggccacacccgccgccagggcaccucccccuccaagugccccuaccucaacuucuuccagcuccucguccucgccggccucucccacuucugcuccggc

SEQ ID NO: 771 - RNA, 105 nt, Artificial Sequence
  P38567_1-35
augggcguccucaaguucaagcacaucuucuuccgcuccuucgucaaguccuccggcgucucccagaucgucuucaccuuccuccucauccccugcugccucacc

SEQ ID NO: 772 - RNA, 105 nt, Artificial Sequence
  P16410_1-35
auggccugccucggcuuccagcgccacaaggcccagcucaaccucgccacccgcaccuggcccugcacccuccucuucuuccuccucuucauccccgucuucugc

SEQ ID NO: 773 - RNA, 111 nt, Artificial Sequence
  P15814_1-37
augcgccccggcaccggccagggcggccucgaggcccccggcgagcccggccccaaccuccgccagcgcuggccccuccuccuccucggccucgccgucgucacccacggc

SEQ ID NO: 774 - RNA, 114 nt, Artificial Sequence
  Q92956_1-38
auggagccccccggcgacuggggccccccccccuggcgcuccacccccaagaccgacguccuccgccucguccucuaccucaccuuccucggcgcccccugcuacgcccccgcc

SEQ ID NO: 775 - RNA, 123 nt, Artificial Sequence
  Q86VB7_1-41
auguccaagcuccgcaugguccuccucgaggacuccggcuccgccgacuuccgccgccacuucgucaaccucucccccuucaccaucaccgucguccuccuccucuccgccugcuucgucacc

SEQ ID NO: 776 - RNA, 123 nt, Artificial Sequence
  P08648_1-41
augggcucccgcacccccgaguccccccuccacgccguccagcuccgcuggggcccccgccgccgccccccccuccucccccuccuccuccuccuccuccccccccccccccgcgucggcggc

SEQ ID NO: 777 - RNA, 123 nt, Artificial Sequence
  P16109_1-41
auggccaacugccagaucgccauccucuaccagcgcuuccagcgcgucgucuucggcaucucccagcuccucugcuucuccgcccucaucuccgagcucaccaaccagaaggaggucgccgcc

SEQ ID NO: 778 - RNA, 132 nt, Artificial Sequence
  O75326_1-44
augaccccccccccccccggccgcgccgcccccuccgccccccgcgcccgcguccccggcccccccgcccgccucggccucccccuccgccuccgccuccuccuccuccucugggccgccgccgccuccgcc

SEQ ID NO: 779 - RNA, 135 nt, Artificial Sequence
  Q8N2Q7_1-45
auggcccucccccgcugcaccuggcccaacuacgucuggcgcgccgucauggccugccucguccaccgcggccucggcgccccccucacccucugcaugcucggcugccuccuccaggccggccacguccucucc

SEQ ID NO: 780 - RNA, 138 nt, Artificial Sequence
  Q86UN3_1-46
augcuccccggccuccgccgccuccuccaggcccccgccuccgccugccuccuccucaugcuccucgcccucccccucgccgcccccuccugccccaugcucugcaccugcuacuccuccccccccaccgucuccugc

SEQ ID NO: 781 - RNA, 540 nt, Artificial Sequence
  A0A5B9
auggaccucaagaacgucuucccccccgaggucgccgucuucgagcccuccgaggccgagaucucccacacccagaaggccacccucgucugccucgccaccggcuucuaccccgaccacgucgagcucuccuggugggucaacggcaaggagguccacuccggcgucuccaccgacccccagccccucaaggagcagcccgcccucaacgacucccgcuacugccucuccucccgccuccgcgucuccgccaccuucuggcagaacccccgcaaccacuuccgcugccagguccaguucuacggccucuccgagaacgacgaguggacccaggaccgcgccaagcccgucacccagaucgucuccgccgaggccuggggccgcgccgacugcggcuucaccuccgaguccuaccagcagggcguccucuccgccaccauccucuacgagauccuccucggcaaggccacccucuacgccguccucgucuccgcccucguccucauggccauggucaagcgcaaggacucccgcggcuga

SEQ ID NO: 782 - RNA, 465 nt, Artificial Sequence
  B7Z8K6
augucccagccccacaccaagcccuccgucuucgucaugaagaacggcaccaacgucgccugccucgucaaggaguucuaccccaaggacauccgcaucaaccucgucuccuccaagaagaucaccgaguucgaccccgccaucgucaucucccccuccggcaaguacaacgccgucaagcucggcaaguacgaggacuccaacuccgucaccugcuccguccagcacgacaacaagaccguccacuccaccgacuucgaggucaagaccgacuccaccgaccacgucaagcccaaggagaccgagaacaccaagcagcccuccaaguccugccacaagcccaaggccaucguccacaccgagaaggucaacaugaugucccucaccguccucggccuccgcaugcucuucgccaagaccgucgccgucaacuuccuccucaccgccaagcucuucuuccucuga

SEQ ID NO: 783 - RNA, 645 nt, Artificial Sequence
  B9A064
augcgccccaagaccggccaggucggcugcgagacccccgaggagcucggccccggcccccgccagcgcuggccccuccuccuccucggccucgccauggucgcccacggccuccuccgccccauggucgccccccaguccggcgaccccgaccccggcgccuccgucggcuccucccgcuccucccuccgcucccucuggggccgccuccuccuccagcccuccccccagcgcgccgacccccgcugcuggccccgcggcuucugguccgagccccagucccucugcuacgucuucggcaccggcaccaaggucaccguccucggccagcccaaggccaaccccaccgucacccucuucccccccuccuccgaggagcuccaggccaacaaggccacccucgucugccucaucuccgacuucuaccccggcgccgucaccgucgccuggaaggccgacggcucccccgucaaggccggcgucgagaccaccaagcccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcuccuga

SEQ ID NO: 784 - RNA, 2520 nt, Artificial Sequence
  O00206
augauguccgccucccgccucgccggcacccucauccccgccauggccuuccucuccugcguccgccccgaguccugggagcccugcgucgaggucguccccaacaucaccuaccagugcauggagcucaacuucuacaagauccccgacaaccuccccuucuccaccaagaaccucgaccucuccuucaacccccuccgccaccucggcuccuacuccuucuucuccuuccccgagcuccagguccucgaccucucccgcugcgagauccagaccaucgaggacggcgccuaccagucccucucccaccucuccacccucauccucaccggcaaccccauccagucccucgcccucggcgccuucuccggccucuccucccuccagaagcucgucgccgucgagaccaaccucgccucccucgagaacuuccccaucggccaccucaagacccucaaggagcucaacgucgcccacaaccucauccaguccuucaagcuccccgaguacuucuccaaccucaccaaccucgagcaccucgaccucuccuccaacaagauccaguccaucuacugcaccgaccuccgcguccuccaccagaugccccuccucaaccucucccucgaccucucccucaaccccaugaacuucauccagcccggcgccuucaaggagauccgccuccacaagcucacccuccgcaacaacuucgacucccucaacgucaugaagaccugcauccagggccucgccggccucgagguccaccgccucguccucggcgaguuccgcaacgagggcaaccucgagaaguucgacaaguccgcccucgagggccucugcaaccucaccaucgaggaguuccgccucgccuaccucgacuacuaccucgacgacaucaucgaccucuucaacugccucaccaacgucuccuccuucucccucgucuccgucaccaucgagcgcgucaaggacuucuccuacaacuucggcuggcagcaccucgagcucgucaacugcaaguucggccaguuccccacccucaagcucaagucccucaagcgccucaccuucaccuccaacaagggcggcaacgccuucuccgaggucgaccuccccucccucgaguuccucgaccucucccgcaacggccucuccuucaagggcugcugcucccaguccgacuucggcaccaccucccucaaguaccucgaccucuccuucaacggcgucaucaccauguccuccaacuuccucggccucgagcagcucgagcaccucgacuuccagcacuccaaccucaagcagauguccgaguucuccgucuuccucucccuccgcaaccucaucuaccucgacaucucccacacccacacccgcgucgccuucaacggcaucuucaacggccucuccucccucgagguccucaagauggccggcaacuccuuccaggagaacuuccuccccgacaucuucaccgagcuccgcaaccucaccuuccucgaccucucccagugccagcucgagcagcucucccccaccgccuucaacucccucuccucccuccagguccucaacaugucccacaacaacuucuucucccucgacaccuuccccuacaagugccucaacucccuccagguccucgacuacucccucaaccacaucaugaccuccaagaagcaggagcuccagcacuuccccuccucccucgccuuccucaaccucacccagaacgacuucgccugcaccugcgagcaccaguccuuccuccaguggaucaaggaccagcgccagcuccucgucgaggucgagcgcauggagugcgccacccccuccgacaagcagggcaugcccguccucucccucaacaucaccugccagaugaacaagaccaucaucggcgucuccguccucuccguccucgucgucuccgucgucgccguccucgucuacaaguucuacuuccaccucaugcuccucgccggcugcaucaaguacggccgcggcgagaacaucuacgacgccuucgucaucuacuccucccaggacgaggacuggguccgcaacgagcucgucaagaaccucgaggagggcgucccccccuuccagcucugccuccacuaccgcgacuucauccccggcgucgccaucgccgccaacaucauccacgagggcuuccacaagucccgcaaggucaucgucgucgucucccagcacuucauccagucccgcuggugcaucuucgaguacgagaucgcccagaccuggcaguuccucuccucccgcgccggcaucaucuucaucguccuccagaaggucgagaagacccuccuccgccagcaggucgagcucuaccgccuccucucccgcaacaccuaccucgagugggaggacuccguccucggccgccacaucuucuggcgccgccuccgcaaggcccuccucgacggcaaguccuggaaccccgagggcaccgucggcaccggcugcaacuggcaggaggccaccuccaucuga

SEQ ID NO: 785 - RNA, 1377 nt, Artificial Sequence
  P01730
augaaccgcggcguccccuuccgccaccuccuccucguccuccagcucgcccuccuccccgccgccacccagggcaagaaggucguccucggcaagaagggcgacaccgucgagcucaccugcaccgccucccagaagaaguccauccaguuccacuggaagaacuccaaccagaucaagauccucggcaaccagggcuccuuccucaccaagggccccuccaagcucaacgaccgcgccgacucccgccgcucccucugggaccagggcaacuucccccucaucaucaagaaccucaagaucgaggacuccgacaccuacaucugcgaggucgaggaccagaaggaggagguccagcuccucgucuucggccucaccgccaacuccgacacccaccuccuccagggccagucccucacccucacccucgaguccccccccggcuccucccccuccguccagugccgcuccccccgcggcaagaacauccagggcggcaagacccucuccgucucccagcucgagcuccaggacuccggcaccuggaccugcaccguccuccagaaccagaagaaggucgaguucaagaucgacaucgucguccucgccuuccagaaggccuccuccaucgucuacaagaaggagggcgagcaggucgaguucuccuucccccucgccuucaccgucgagaagcucaccggcuccggcgagcucugguggcaggccgagcgcgccuccuccuccaaguccuggaucaccuucgaccucaagaacaaggaggucuccgucaagcgcgucacccaggaccccaagcuccagaugggcaagaagcucccccuccaccucacccucccccaggcccucccccaguacgccggcuccggcaaccucacccucgcccucgaggccaagaccggcaagcuccaccaggaggucaaccucgucgucaugcgcgccacccagcuccagaagaaccucaccugcgaggucuggggccccaccucccccaagcucaugcucucccucaagcucgagaacaaggaggccaaggucuccaagcgcgagaaggccgucuggguccucaaccccgaggccggcauguggcagugccuccucuccgacuccggccagguccuccucgaguccaacaucaagguccuccccaccugguccacccccguccagcccauggcccucaucguccucggcggcgucgccggccuccuccucuucaucggccucggcaucuucuucugcguccgcugccgccaccgccgccgccaggccgagcgcaugucccagaucaagcgccuccucuccgagaagaagaccugccagugcccccaccgcuuccagaagaccugcucccccaucuga

SEQ ID NO: 786 - RNA, 537 nt, Artificial Sequence
  P01850
auggaggaccucaacaaggucuucccccccgaggucgccgucuucgagcccuccgaggccgagaucucccacacccagaaggccacccucgucugccucgccaccggcuucuuccccgaccacgucgagcucuccuggugggucaacggcaaggagguccacuccggcgucuccaccgacccccagccccucaaggagcagcccgcccucaacgacucccgcuacugccucuccucccgccuccgcgucuccgccaccuucuggcagaacccccgcaaccacuuccgcugccagguccaguucuacggccucuccgagaacgacgaguggacccaggaccgcgccaagcccgucacccagaucgucuccgccgaggccuggggccgcgccgacugcggcuucaccuccgucuccuaccagcagggcguccucuccgccaccauccucuacgagauccuccucggcaaggccacccucuacgccguccucgucuccgcccucguccucauggccauggucaagcgcaaggacuucuga

SEQ ID NO: 787 - RNA, 624 nt, Artificial Sequence
  P07766
augcaguccggcacccacuggcgcguccucggccucugccuccucuccgucggcgucuggggccaggacggcaacgaggagaugggcggcaucacccagacccccuacaaggucuccaucuccggcaccaccgucauccucaccugcccccaguaccccggcuccgagauccucuggcagcacaacgacaagaacaucggcggcgacgaggacgacaagaacaucggcuccgacgaggaccaccucucccucaaggaguucuccgagcucgagcaguccggcuacuacgucugcuacccccgcggcuccaagcccgaggacgccaacuucuaccucuaccuccgcgcccgcgucugcgagaacugcauggagauggacgucauguccgucgccaccaucgucaucgucgacaucugcaucaccggcggccuccuccuccucgucuacuacugguccaagaaccgcaaggccaaggccaagcccgucacccgcggcgccggcgccggcggccgccagcgcggccagaacaaggagcgccccccccccguccccaaccccgacuacgagcccauccgcaagggccagcgcgaccucuacuccggccucaaccagcgccgcaucuga

SEQ ID NO: 788 - RNA, 3915 nt, Artificial Sequence
  P08575
auguaccucuggcucaagcuccucgccuucggcuucgccuuccucgacaccgaggucuucgucaccggccagucccccacccccucccccaccggccucaccaccgccaagaugcccuccgucccccucuccuccgacccccuccccacccacaccaccgccuucucccccgccuccaccuucgagcgcgagaacgacuucuccgagaccaccaccucccucucccccgacaacaccuccacccaggucucccccgacucccucgacaacgccuccgccuucaacaccaccggcgucuccuccguccagaccccccaccuccccacccacgccgacucccagacccccuccgccggcaccgacacccagaccuucuccggcuccgccgccaacgccaagcucaaccccacccccggcuccaacgccaucuccgacguccccggcgagcgcuccaccgccuccaccuuccccaccgaccccgucuccccccucaccaccacccucucccucgcccaccacuccuccgccgcccuccccgcccgcaccuccaacaccaccaucaccgccaacaccuccgacgccuaccucaacgccuccgagaccaccacccucucccccuccggcuccgccgucaucuccaccaccaccaucgccaccacccccuccaagcccaccugcgacgagaaguacgccaacaucaccgucgacuaccucuacaacaaggagaccaagcucuucaccgccaagcucaacgucaacgagaacgucgagugcggcaacaacaccugcaccaacaacgagguccacaaccucaccgagugcaagaacgccuccgucuccaucucccacaacuccugcaccgcccccgacaagacccucauccucgacgucccccccggcgucgagaaguuccagcuccacgacugcacccaggucgagaaggccgacaccaccaucugccucaaguggaagaacaucgagaccuucaccugcgacacccagaacaucaccuaccgcuuccagugcggcaacaugaucuucgacaacaaggagaucaagcucgagaaccucgagcccgagcacgaguacaagugcgacuccgagauccucuacaacaaccacaaguucaccaacgccuccaagaucaucaagaccgacuucggcucccccggcgagccccagaucaucuucugccgcuccgaggccgcccaccagggcgucaucaccuggaaccccccccagcgcuccuuccacaacuucacccucugcuacaucaaggagaccgagaaggacugccucaaccucgacaagaaccucaucaaguacgaccuccagaaccucaagcccuacaccaaguacguccucucccuccacgccuacaucaucgccaagguccagcgcaacggcuccgccgccaugugccacuucaccaccaaguccgccccccccucccaggucuggaacaugaccgucuccaugaccuccgacaacuccaugcacgucaagugccgccccccccgcgaccgcaacggcccccacgagcgcuaccaccucgaggucgaggccggcaacacccucguccgcaacgagucccacaagaacugcgacuuccgcgucaaggaccuccaguacuccaccgacuacaccuucaaggccuacuuccacaacggcgacuaccccggcgagcccuucauccuccaccacuccaccuccuacaacuccaaggcccucaucgccuuccucgccuuccucaucaucgucaccuccaucgcccuccucgucguccucuacaagaucuacgaccuccacaagaagcgcuccugcaaccucgacgagcagcaggagcucgucgagcgcgacgacgagaagcagcucaugaacgucgagcccauccacgccgacauccuccucgagaccuacaagcgcaagaucgccgacgagggccgccucuuccucgccgaguuccaguccaucccccgcgucuucuccaaguuccccaucaaggaggcccgcaagcccuucaaccagaacaagaaccgcuacgucgacauccuccccuacgacuacaaccgcgucgagcucuccgagaucaacggcgacgccggcuccaacuacaucaacgccuccuacaucgacggcuucaaggagccccgcaaguacaucgccgcccagggcccccgcgacgagaccgucgacgacuucuggcgcaugaucugggagcagaaggccaccgucaucgucauggucacccgcugcgaggagggcaaccgcaacaagugcgccgaguacuggcccuccauggaggagggcacccgcgccuucggcgacgucgucgucaagaucaaccagcacaagcgcugccccgacuacaucauccagaagcucaacaucgucaacaagaaggagaaggccaccggccgcgaggucacccacauccaguucaccuccuggcccgaccacggcguccccgaggacccccaccuccuccucaagcuccgccgccgcgucaacgccuucuccaacuucuucuccggccccaucgucguccacugcuccgccggcgucggccgcaccggcaccuacaucggcaucgacgccaugcucgagggccucgaggccgagaacaaggucgacgucuacggcuacgucgucaagcuccgccgccagcgcugccucaugguccaggucgaggcccaguacauccucauccaccaggcccucgucgaguacaaccaguucggcgagaccgaggucaaccucuccgagcuccaccccuaccuccacaacaugaagaagcgcgacccccccuccgagcccuccccccucgaggccgaguuccagcgccuccccuccuaccgcuccuggcgcacccagcacaucggcaaccaggaggagaacaaguccaagaaccgcaacuccaacgucauccccuacgacuacaaccgcgucccccucaagcacgagcucgagauguccaaggaguccgagcacgacuccgacgaguccuccgacgacgacuccgacuccgaggagcccuccaaguacaucaacgccuccuucaucauguccuacuggaagcccgaggucaugaucgccgcccagggcccccucaaggagaccaucggcgacuucuggcagaugaucuuccagcgcaaggucaaggucaucgucaugcucaccgagcucaagcacggcgaccaggagaucugcgcccaguacuggggcgagggcaagcagaccuacggcgacaucgaggucgaccucaaggacaccgacaaguccuccaccuacacccuccgcgucuucgagcuccgccacuccaagcgcaaggacucccgcaccgucuaccaguaccaguacaccaacugguccgucgagcagcuccccgccgagcccaaggagcucaucuccaugauccaggucgucaagcagaagcucccccagaagaacuccuccgagggcaacaagcaccacaaguccaccccccuccucauccacugccgcgacggcucccagcagaccggcaucuucugcgcccuccucaaccuccucgaguccgccgagaccgaggaggucgucgacaucuuccaggucgucaaggcccuccgcaaggcccgccccggcauggucuccaccuucgagcaguaccaguuccucuacgacgucaucgccuccaccuaccccgcccagaacggccaggucaagaagaacaaccaccaggaggacaagaucgaguucgacaacgaggucgacaaggucaagcaggacgccaacugcgucaacccccucggcgcccccgagaagcuccccgaggccaaggagcaggccgagggcuccgagcccaccuccggcaccgagggccccgagcacuccgucaacggccccgccucccccgcccucaaccagggcuccuga

SEQ ID NO: 789 - RNA, 765 nt, Artificial Sequence
  P08637
auguggcagcuccuccuccccaccgcccuccuccuccucgucuccgccggcaugcgcaccgaggaccuccccaaggccgucgucuuccucgagccccagugguaccgcguccucgagaaggacuccgucacccucaagugccagggcgccuacucccccgaggacaacuccacccagugguuccacaacgagucccucaucuccucccaggccuccuccuacuucaucgacgccgccaccgucgacgacuccggcgaguaccgcugccagaccaaccucuccacccucuccgaccccguccagcucgagguccacaucggcuggcuccuccuccaggccccccgcugggucuucaaggaggaggaccccauccaccuccgcugccacuccuggaagaacaccgcccuccacaaggucaccuaccuccagaacggcaagggccgcaaguacuuccaccacaacuccgacuucuacauccccaaggccacccucaaggacuccggcuccuacuucugccgcggccucuucggcuccaagaacgucuccuccgagaccgucaacaucaccaucacccagggccucgccgucuccaccaucuccuccuucuucccccccggcuaccaggucuccuucugccucgucaugguccuccucuucgccgucgacaccggccucuacuucuccgucaagaccaacauccgcuccuccacccgcgacuggaaggaccacaaguucaaguggcgcaaggacccccaggacaaguga

SEQ ID NO: 790 - RNA, 663 nt, Artificial Sequence
  P10747
augcuccgccuccuccucgcccucaaccucuuccccuccauccaggucaccggcaacaagauccucgucaagcagucccccaugcucgucgccuacgacaacgccgucaaccucuccugcaaguacuccuacaaccucuucucccgcgaguuccgcgccucccuccacaagggccucgacuccgccgucgaggucugcgucgucuacggcaacuacucccagcagcuccaggucuacuccaagaccggcuucaacugcgacggcaagcucggcaacgaguccgucaccuucuaccuccagaaccucuacgucaaccagaccgacaucuacuucugcaagaucgaggucauguaccccccccccuaccucgacaacgagaaguccaacggcaccaucauccacgucaagggcaagcaccucugccccuccccccucuuccccggccccuccaagcccuucuggguccucgucgucgucggcggcguccucgccugcuacucccuccucgucaccgucgccuucaucaucuucuggguccgcuccaagcgcucccgccuccuccacuccgacuacaugaacaugaccccccgccgccccggccccacccgcaagcacuaccagcccuacgcccccccccgcgacuucgccgccuaccgcuccuga

SEQ ID NO: 791 - RNA, 681 nt, Artificial Sequence
  P11912
augcccggcggccccggcguccuccaggcccuccccgccaccaucuuccuccucuuccuccucuccgccgucuaccucggccccggcugccaggcccucuggaugcacaagguccccgccucccucauggucucccucggcgaggacgcccacuuccagugcccccacaacuccuccaacaacgccaacgucaccugguggcgcguccuccacggcaacuacaccuggccccccgaguuccucggccccggcgaggaccccaacggcacccucaucauccagaacgucaacaagucccacggcggcaucuacgucugccgcguccaggagggcaacgaguccuaccagcaguccugcggcaccuaccuccgcguccgccagccccccccccgccccuuccucgacaugggcgagggcaccaagaaccgcaucaucaccgccgagggcaucauccuccucuucugcgccgucguccccggcacccuccuccucuuccgcaagcgcuggcagaacgagaagcucggccucgacgccggcgacgaguacgaggacgagaaccucuacgagggccucaaccucgacgacugcuccauguacgaggacaucucccgcggccuccagggcaccuaccaggacgucggcucccucaacaucggcgacguccagcucgagaagcccuga

SEQ ID NO: 792 - RNA, 1671 nt, Artificial Sequence
  P15391
augccccccccccgccuccucuucuuccuccucuuccucacccccauggagguccgccccgaggagccccucgucgucaaggucgaggagggcgacaacgccguccuccagugccucaagggcaccuccgacggccccacccagcagcucaccuggucccgcgaguccccccucaagcccuuccucaagcucucccucggccuccccggccucggcauccacaugcgcccccucgccaucuggcucuucaucuucaacgucucccagcagaugggcggcuucuaccucugccagcccggcccccccuccgagaaggccuggcagcccggcuggaccgucaacgucgagggcuccggcgagcucuuccgcuggaacgucuccgaccucggcggccucggcugcggccucaagaaccgcuccuccgagggccccuccucccccuccggcaagcucaugucccccaagcucuacgucugggccaaggaccgccccgagaucugggagggcgagccccccugccuccccccccgcgacucccucaaccagucccucucccaggaccucaccauggcccccggcuccacccucuggcucuccugcggcgucccccccgacuccgucucccgcggcccccucuccuggacccacguccaccccaagggccccaagucccuccucucccucgagcucaaggacgaccgccccgcccgcgacaugugggucauggagaccggccuccuccucccccgcgccaccgcccaggacgccggcaaguacuacugccaccgcggcaaccucaccauguccuuccaccucgagaucaccgcccgccccguccucuggcacuggcuccuccgcaccggcggcuggaaggucuccgccgucacccucgccuaccucaucuucugccucugcucccucgucggcauccuccaccuccagcgcgcccucguccuccgccgcaagcgcaagcgcaugaccgaccccacccgccgcuucuucaaggucacccccccccccggcuccggcccccagaaccaguacggcaacguccucucccuccccacccccaccuccggccucggccgcgcccagcgcugggccgccggccucggcggcaccgcccccuccuacggcaaccccuccuccgacguccaggccgacggcgcccucggcucccgcuccccccccggcgucggccccgaggaggaggagggcgagggcuacgaggagcccgacuccgaggaggacuccgaguucuacgagaacgacuccaaccucggccaggaccagcucucccaggacggcuccggcuacgagaaccccgaggacgagccccucggccccgaggacgaggacuccuucuccaacgccgaguccuacgagaacgaggacgaggagcucacccagcccgucgcccgcaccauggacuuccucuccccccacggcuccgccugggaccccucccgcgaggccaccucccucggcucccaguccuacgaggacaugcgcggcauccucuacgccgccccccagcuccgcuccauccgcggccagcccggccccaaccacgaggaggacgccgacuccuacgagaacauggacaaccccgacggccccgaccccgccuggggcggcggcggccgcaugggcaccugguccacccgcuga

SEQ ID NO: 793 - RNA, 672 nt, Artificial Sequence
  P16410
auggccugccucggcuuccagcgccacaaggcccagcucaaccucgccacccgcaccuggcccugcacccuccucuucuuccuccucuucauccccgucuucugcaaggccaugcacgucgcccagcccgccgucguccucgccuccucccgcggcaucgccuccuucgucugcgaguacgccucccccggcaaggccaccgagguccgcgucaccguccuccgccaggccgacucccaggucaccgaggucugcgccgccaccuacaugaugggcaacgagcucaccuuccucgacgacuccaucugcaccggcaccuccuccggcaaccaggucaaccucaccauccagggccuccgcgccauggacaccggccucuacaucugcaaggucgagcucauguaccccccccccuacuaccucggcaucggcaacggcacccagaucuacgucaucgaccccgagcccugccccgacuccgacuuccuccucuggauccucgccgccgucuccuccggccucuucuucuacuccuuccuccucaccgccgucucccucuccaagaugcucaagaagcgcuccccccucaccaccggcgucuacgucaagaugccccccaccgagcccgagugcgagaagcaguuccagcccuacuucauccccaucaacuga

SEQ ID NO: 794 - RNA, 1419 nt, Artificial Sequence
  P16671
augggcugcgaccgcaacugcggccucaucgccggcgccgucaucggcgccguccucgccgucuucggcggcauccucaugcccgucggcgaccuccucauccagaagaccaucaagaagcaggucguccucgaggagggcaccaucgccuucaagaacugggucaagaccggcaccgaggucuaccgccaguucuggaucuucgacguccagaacccccaggaggucaugaugaacuccuccaacauccaggucaagcagcgcggccccuacaccuaccgcguccgcuuccucgccaaggagaacgucacccaggacgccgaggacaacaccgucuccuuccuccagcccaacggcgccaucuucgagcccucccucuccgucggcaccgaggccgacaacuucaccguccucaaccucgccgucgccgccgccucccacaucuaccagaaccaguucguccagaugauccucaacucccucaucaacaaguccaaguccuccauguuccagguccgcacccuccgcgagcuccucuggggcuaccgcgaccccuuccucucccucguccccuaccccgucaccaccaccgucggccucuucuaccccuacaacaacaccgccgacggcgucuacaaggucuucaacggcaaggacaacaucuccaaggucgccaucaucgacaccuacaagggcaagcgcaaccucuccuacugggagucccacugcgacaugaucaacggcaccgacgccgccuccuucccccccuucgucgagaagucccagguccuccaguucuucuccuccgacaucugccgcuccaucuacgccgucuucgaguccgacgucaaccucaagggcauccccgucuaccgcuucguccuccccuccaaggccuucgccucccccgucgagaaccccgacaacuacugcuucugcaccgagaagaucaucuccaagaacugcaccuccuacggcguccucgacaucuccaagugcaaggagggccgccccgucuacaucucccucccccacuuccucuacgccucccccgacgucuccgagcccaucgacggccucaaccccaacgaggaggagcaccgcaccuaccucgacaucgagcccaucaccggcuucacccuccaguucgccaagcgccuccaggucaaccuccucgucaagcccuccgagaagauccagguccucaagaaccucaagcgcaacuacaucguccccauccucuggcucaacgagaccggcaccaucggcgacgagaaggccaacauguuccgcucccaggucaccggcaagaucaaccuccucggccucaucgagaugauccuccucuccgucggcgucgucauguucgucgccuucaugaucuccuacugcgccugccgcuccaagaccaucaaguga

SEQ ID NO: 795 - RNA, 651 nt, Artificial Sequence
  P26718
augggcuggauccgcggccgccgcucccgccacuccugggagauguccgaguuccacaacuacaaccucgaccucaagaaguccgacuucuccacccgcuggcagaagcagcgcugccccgucgucaaguccaagugccgcgagaacgccucccccuucuucuucugcugcuucaucgccgucgccaugggcauccgcuucaucaucauggucgccaucugguccgccgucuuccucaacucccucuucaaccaggagguccagaucccccucaccgaguccuacugcggccccugccccaagaacuggaucugcuacaagaacaacugcuaccaguucuucgacgaguccaagaacugguacgagucccaggccuccugcaugucccagaacgccucccuccucaaggucuacuccaaggaggaccaggaccuccucaagcucgucaaguccuaccacuggaugggccucguccacauccccaccaacggcuccuggcagugggaggacggcuccauccucucccccaaccuccucaccaucaucgagaugcagaagggcgacugcgcccucuacgccuccuccuucaagggcuacaucgagaacugcuccacccccaacaccuacaucugcaugcagcgcaccgucuga

SEQ ID NO: 796 - RNA, 261 nt, Artificial Sequence
  P30273
augauccccgccgucguccuccuccuccuccuccucgucgagcaggccgccgcccucggcgagccccagcucugcuacauccucgacgccauccucuuccucuacggcaucguccucacccuccucuacugccgccucaagauccagguccgcaaggccgccaucaccuccuacgagaaguccgacggcgucuacaccggccucuccacccgcaaccaggagaccuacgagacccucaagcacgagaagcccccccaguag

SEQ ID NO: 797 - RNA, 1137 nt, Artificial Sequence
  P32248
auggaccucggcaagcccaugaaguccguccucgucgucgcccuccucgucaucuuccaggucugccucugccaggacgaggucaccgacgacuacaucggcgacaacaccaccgucgacuacacccucuucgagucccucugcuccaagaaggacguccgcaacuucaaggccugguuccuccccaucauguacuccaucaucugcuucgucggccuccucggcaacggccucgucguccucaccuacaucuacuucaagcgccucaagaccaugaccgacaccuaccuccucaaccucgccgucgccgacauccucuuccuccucacccuccccuucugggccuacuccgccgccaaguccugggucuucggcguccacuucugcaagcucaucuucgccaucuacaagauguccuucuucuccggcaugcuccuccuccucugcaucuccaucgaccgcuacgucgccaucguccaggccgucuccgcccaccgccaccgcgcccgcguccuccucaucuccaagcucuccugcgucggcaucuggauccucgccaccguccucuccauccccgagcuccucuacuccgaccuccagcgcuccuccuccgagcaggccaugcgcugcucccucaucaccgagcacgucgaggccuucaucaccauccaggucgcccagauggucaucggcuuccucgucccccuccucgccauguccuucugcuaccucgucaucauccgcacccuccuccaggcccgcaacuucgagcgcaacaaggccaucaaggucaucaucgccgucgucgucgucuucaucgucuuccagcuccccuacaacggcgucguccucgcccagaccgucgccaacuucaacaucaccuccuccaccugcgagcucuccaagcagcucaacaucgccuacgacgucaccuacucccucgccugcguccgcugcugcgucaaccccuuccucuacgccuucaucggcgucaaguuccgcaacgaccucuucaagcucuucaaggaccucggcugccucucccaggagcagcuccgccagugguccuccugccgccacauccgccgcuccuccauguccgucgaggccgagaccaccaccaccuucucccccuga

SEQ ID NO: 798 - RNA, 690 nt, Artificial Sequence
  P40259
auggcccgccucgcccucucccccguccccucccacuggauggucgcccuccuccuccuccucuccgccgagcccguccccgccgcccgcuccgaggaccgcuaccgcaaccccaagggcuccgccugcucccgcaucuggcaguccccccgcuucaucgcccgcaagcgcggcuucaccgucaagaugcacugcuacaugaacuccgccuccggcaacgucuccuggcucuggaagcaggagauggacgagaacccccagcagcucaagcucgagaagggccgcauggaggagucccagaacgagucccucgccacccucaccauccagggcauccgcuucgaggacaacggcaucuacuucugccagcagaagugcaacaacaccuccgaggucuaccagggcugcggcaccgagcuccgcgucaugggcuucuccacccucgcccagcucaagcagcgcaacacccucaaggacggcaucaucaugauccagacccuccucaucauccucuucaucaucguccccaucuuccuccuccucgacaaggacgacuccaaggccggcauggaggaggaccacaccuacgagggccucgacaucgaccagaccgccaccuacgaggacaucgucacccuccgcaccggcgaggucaagugguccgucggcgagcaccccggccaggaguga

SEQ ID NO: 799 - RNA, 990 nt, Artificial Sequence
  P42081
auggacccccagugcaccaugggccucuccaacauccucuucgucauggccuuccuccucuccggcgccgccccccucaagauccaggccuacuucaacgagaccgccgaccuccccugccaguucgccaacucccagaaccagucccucuccgagcucgucgucuucuggcaggaccaggagaaccucguccucaacgaggucuaccucggcaaggagaaguucgacuccguccacuccaaguacaugggccgcaccuccuucgacuccgacuccuggacccuccgccuccacaaccuccagaucaaggacaagggccucuaccagugcaucauccaccacaagaagcccaccggcaugauccgcauccaccagaugaacuccgagcucuccguccucgccaacuucucccagcccgagaucguccccaucuccaacaucaccgagaacgucuacaucaaccucaccugcuccuccauccacggcuaccccgagcccaagaagauguccguccuccuccgcaccaagaacuccaccaucgaguacgacggcgucaugcagaagucccaggacaacgucaccgagcucuacgacgucuccaucucccucuccgucuccuuccccgacgucaccuccaacaugaccaucuucugcauccucgagaccgacaagacccgccuccucuccucccccuucuccaucgagcucgaggacccccagcccccccccgaccacauccccuggaucaccgccguccuccccaccgucaucaucugcgucauggucuucugccucauccucuggaaguggaagaagaagaagcgcccccgcaacuccuacaagugcggcaccaacaccauggagcgcgaggaguccgagcagaccaagaagcgcgagaagauccacauccccgagcgcuccgacgaggcccagcgcgucuucaaguccuccaagaccuccuccugcgacaaguccgacaccugcuucuga

SEQ ID NO: 800 - RNA, 1011 nt, Artificial Sequence
  Q15762
auggacuaccccacccuccuccucgcccuccuccacgucuaccgcgcccucugcgaggagguccucuggcacaccuccguccccuucgccgagaacaugucccucgagugcgucuaccccuccaugggcauccucacccaggucgagugguucaagaucggcacccagcaggacuccaucgccaucuucucccccacccacggcauggucauccgcaagcccuacgccgagcgcgucuacuuccucaacuccaccauggccuccaacaacaugacccucuucuuccgcaacgccuccgaggacgacgucggcuacuacuccugcucccucuacaccuacccccagggcaccuggcagaaggucauccaggucguccaguccgacuccuucgaggccgccguccccuccaacucccacaucgucuccgagcccggcaagaacgucacccucaccugccagccccagaugaccuggcccguccaggccguccgcugggagaagauccagccccgccagaucgaccuccucaccuacugcaaccucguccacggccgcaacuucaccuccaaguucccccgccagaucgucuccaacugcucccacggccgcugguccgucaucgucauccccgacgucaccgucuccgacuccggccucuaccgcugcuaccuccaggccuccgccggcgagaacgagaccuucgucaugcgccucaccgucgccgagggcaagaccgacaaccaguacacccucuucgucgccggcggcaccguccuccuccuccucuucgucaucuccaucaccaccaucaucgucaucuuccucaaccgccgccgccgccgcgagcgccgcgaccucuucaccgaguccugggacacccagaaggcccccaacaacuaccgcucccccaucuccaccucccagcccaccaaccaguccauggacgacacccgcgaggacaucuacgucaacuaccccaccuucucccgccgccccaagacccgcgucuga

SEQ ID NO: 801 - RNA, 13482 nt, Artificial Sequence
  Q685J3
augccccgccccggcaccauggcccucugccuccucacccucguccucucccuccuccccccccaggccgccgccgagcaggaccucuccgucaaccgcgccgucugggacggcggcggcugcaucucccagggcgacguccucaaccgccagugccagcagcucucccagcacguccgcaccggcuccgccgccaacaccgccaccggcaccaccuccaccaacgucgucgagccccgcauguaccucuccugcuccaccaaccccgagaugaccuccaucgaguccuccgucaccuccgacacccccggcgucuccuccacccgcaugacccccaccgagucccgcaccaccuccgaguccaccuccgacuccaccacccucuuccccuccuccaccgaggacaccuccucccccaccacccccgagggcaccgacguccccauguccacccccuccgaggaguccaucuccuccaccauggccuucgucuccaccgccccccuccccuccuucgaggccuacaccucccucaccuacaaggucgacauguccaccccccucaccaccuccacccaggccuccuccucccccaccacccccgaguccaccaccauccccaaguccaccaacuccgagggcuccaccccccucaccuccaugcccgccuccaccaugaaggucgccuccuccgaggccaucacccuccucaccacccccgucgagaucuccacccccgucaccaucuccgcccaggccuccuccucccccaccaccgccgagggccccucccucuccaacuccgcccccuccggcggcuccaccccccucacccgcaugccccucuccgucaugcucgucgucuccuccgaggccuccacccucuccaccacccccgccgccaccaacauccccgucaucaccuccaccgaggccuccuccucccccaccaccgccgagggcaccuccauccccaccuccaccuacaccgagggcuccaccccccucaccuccacccccgccuccaccaugcccgucgccaccuccgagauguccacccucuccaucacccccgucgacaccuccacccucgucaccaccuccaccgagcccuccucccuccccaccaccgccgaggccaccuccaugcucaccuccacccucuccgagggcuccaccccccucaccaacaugcccgucuccaccauccucgucgccuccuccgaggccuccaccaccuccaccauccccgucgacuccaagaccuucgucaccaccgccuccgaggccuccuccucccccaccaccgccgaggacaccuccaucgccaccuccacccccuccgagggcuccaccccccucaccuccaugcccgucuccaccacccccgucgccuccuccgaggccuccaaccucuccaccacccccgucgacuccaagacccaggucaccaccuccaccgaggccuccuccuccccccccaccgccgaggucaacuccaugcccaccuccacccccuccgagggcuccaccccccucaccuccauguccgucuccaccaugcccgucgccuccuccgaggccuccacccucuccaccacccccgucgacaccuccacccccgucaccaccuccuccgaggccuccuccuccuccaccacccccgagggcaccuccauccccaccuccacccccuccgagggcuccaccccccucaccaacaugcccgucuccacccgccucgucgucuccuccgaggccuccaccaccuccaccacccccgccgacuccaacaccuucgucaccaccuccuccgaggccuccuccuccuccaccaccgccgagggcaccuccaugcccaccuccaccuacuccgagcgcggcaccaccaucaccuccauguccgucuccaccacccucgucgccuccuccgaggccuccacccucuccaccacccccgucgacuccaacacccccgucaccaccuccaccgaggccaccuccuccuccaccaccgccgagggcaccuccaugcccaccuccaccuacaccgagggcuccaccccccucaccuccaugcccgucaacaccacccucgucgccuccuccgaggccuccacccucuccaccacccccgucgacaccuccacccccgucaccaccuccaccgaggccuccuccucccccaccaccgccgacggcgccuccaugcccaccuccacccccuccgagggcuccaccccccucaccuccaugcccgucuccaagacccuccucaccuccuccgaggccuccacccucuccaccaccccccucgacaccuccacccacaucaccaccuccaccgaggccuccugcucccccaccaccaccgagggcaccuccaugcccaucuccacccccuccgagggcuccccccuccucaccuccauccccgucuccaucacccccgucaccucccccgaggccuccacccucuccaccacccccgucgacuccaacucccccgucaccaccuccaccgaggucuccuccucccccacccccgccgagggcaccuccaugcccaccuccaccuacuccgagggccgcaccccccucaccuccaugcccgucuccaccacccucgucgccaccuccgccaucuccacccucuccaccacccccgucgacaccuccacccccgucaccaacuccaccgaggcccgcuccucccccaccaccuccgagggcaccuccaugcccaccuccacccccggcgagggcuccaccccccucaccuccaugcccgacuccaccacccccgucgucuccuccgaggcccgcacccucuccgccacccccgucgacaccuccacccccgucaccaccuccaccgaggccaccuccucccccaccaccgccgagggcaccuccauccccaccuccacccccuccgagggcaccaccccccucaccuccacccccgucucccacacccucgucgccaacuccgaggccuccacccucuccaccacccccgucgacuccaacaccccccucaccaccuccaccgaggccuccucccccccccccaccgccgagggcaccuccaugcccaccuccacccccuccgagggcuccaccccccucacccgcaugcccgucuccaccaccauggucgccuccuccgagaccuccacccucuccaccacccccgccgacaccuccacccccgucaccaccuacucccaggccuccuccuccuccaccaccgccgacggcaccuccaugcccaccuccaccuacuccgagggcuccaccccccucaccuccguccccgucuccacccgccucgucgucuccuccgaggccuccacccucuccaccacccccgucgacaccuccauccccgucaccaccuccaccgaggccuccuccucccccaccaccgccgagggcaccuccauccccaccuccccccccuccgagggcaccaccccccucgccuccaugcccgucuccaccacccucgucgucuccuccgaggccaacacccucuccaccacccccgucgacuccaagacccaggucgccaccuccaccgaggccuccucccccccccccaccgccgaggucaccuccaugcccaccuccacccccggcgagcgcuccaccccccucaccuccaugcccguccgccacacccccgucgccuccuccgaggccuccacccucuccaccucccccgucgacaccuccacccccgucaccaccuccgccgagaccuccuccucccccaccaccgccgagggcaccucccuccccaccuccaccaccuccgagggcuccacccuccucaccuccauccccgucuccaccacccucgucaccucccccgaggccuccacccuccucaccacccccgucgacaccaagggccccgucgucaccuccaacgaggucuccuccucccccacccccgccgagggcaccuccaugcccaccuccaccuacuccgagggccgcaccccccucaccuccauccccgucaacaccacccucgucgccuccuccgccaucuccauccucuccaccacccccgucgacaacuccacccccgucaccaccuccaccgaggccugcuccucccccaccaccuccgagggcaccuccaugcccaacuccaaccccuccgagggcaccaccccccucaccuccauccccgucuccaccacccccgucgucuccuccgaggccuccacccucuccgccacccccgucgacaccuccacccccggcaccaccuccgccgaggccaccuccucccccaccaccgccgagggcaucuccauccccaccuccacccccuccgagggcaagaccccccucaaguccauccccgucuccaacacccccgucgccaacuccgaggccuccacccucuccaccacccccgucgacuccaacucccccgucgucaccuccaccgccgucuccuccucccccacccccgccgagggcaccuccaucgccaucuccacccccuccgagggcuccaccgcccucaccuccauccccgucuccaccaccaccgucgccuccuccgagaucaacucccucuccaccacccccgccgucaccuccacccccgucaccaccuacucccaggccuccuccucccccaccaccgccgacggcaccuccaugcagaccuccaccuacuccgagggcuccaccccccucaccucccuccccgucuccaccaugcucgucgucuccuccgaggccaacacccucuccaccacccccaucgacuccaagacccaggucaccgccuccaccgaggccuccuccuccaccaccgccgagggcuccuccaugaccaucuccacccccuccgagggcuccccccuccucaccuccauccccgucuccaccacccccgucgccucccccgaggccuccacccucuccaccacccccgucgacuccaacucccccgucaucaccuccaccgaggucuccuccucccccacccccgccgagggcaccuccaugcccaccuccaccuacaccgagggccgcaccccccucaccuccaucaccguccgcaccacccccgucgccuccuccgccaucuccacccucuccaccacccccgucgacaacuccacccccgucaccaccuccaccgaggcccgcuccucccccaccaccuccgagggcaccuccaugcccaacuccacccccuccgagggcaccaccccccucaccuccauccccgucuccaccacccccguccucuccuccgaggccuccacccucuccgccacccccaucgacaccuccacccccgucaccaccuccaccgaggccaccuccucccccaccaccgccgagggcaccuccauccccaccuccacccucuccgagggcaugaccccccucaccuccacccccgucucccacacccucgucgccaacuccgaggccuccacccucuccaccacccccgucgacuccaacucccccgucgucaccuccaccgccgucuccuccucccccacccccgccgagggcaccuccaucgccaccuccacccccuccgagggcuccaccgcccucaccuccauccccgucuccaccaccaccgucgccuccuccgagaccaacacccucuccaccacccccgccgucaccuccacccccgucaccaccuacgcccaggucuccuccucccccaccaccgccgacggcuccuccaugcccaccuccaccccccgcgagggccgccccccccucaccuccauccccgucuccaccaccaccgucgccuccuccgagaucaacacccucuccaccacccucgccgacacccgcacccccgucaccaccuacucccaggccuccuccucccccaccaccgccgacggcaccuccaugcccacccccgccuacuccgagggcuccaccccccucaccuccaugccccucuccaccacccucgucgucuccuccgaggccuccacccucuccaccacccccgucgacaccuccacccccgccaccaccuccaccgagggcuccuccucccccaccaccgccggcggcaccuccauccagaccuccacccccuccgagcgcaccaccccccucgccggcaugcccgucuccaccacccucgucgucuccuccgagggcaacacccucuccaccacccccgucgacuccaagacccaggucaccaacuccaccgaggccuccuccuccgccaccgccgagggcuccuccaugaccaucuccgcccccuccgagggcuccccccuccucaccuccaucccccucuccaccacccccgucgccucccccgaggccuccacccucuccaccacccccgucgacuccaacucccccgucaucaccuccaccgaggucuccuccucccccauccccaccgagggcaccuccaugcagaccuccaccuacuccgaccgccgcaccccccucaccuccaugcccgucuccaccaccgucgucgccuccuccgccaucuccacccucuccaccacccccgucgacaccuccacccccgucaccaacuccaccgaggcccgcuccucccccaccaccuccgagggcaccuccaugcccaccuccacccccuccgagggcuccacccccuucaccuccaugcccgucuccaccaugcccgucgucaccuccgaggccuccacccucuccgccacccccgucgacaccuccacccccgucaccaccuccaccgaggccaccuccucccccaccaccgccgagggcaccuccauccccaccuccacccucuccgagggcaccaccccccucaccuccauccccgucucccacacccucgucgccaacuccgaggucuccacccucuccaccacccccgucgacuccaacacccccuucaccaccuccaccgaggccuccucccccccccccaccgccgagggcaccuccaugcccaccuccaccuccuccgagggcaacaccccccucacccgcaugcccgucuccaccaccauggucgccuccuucgagaccuccacccucuccaccacccccgccgacaccuccacccccgucaccaccuacucccaggccggcuccucccccaccaccgccgacgacaccuccaugcccaccuccaccuacuccgagggcuccaccccccucaccuccguccccgucuccaccaugcccgucgucuccuccgaggccuccacccacuccaccacccccgucgacaccuccacccccgucaccaccuccaccgaggccuccuccucccccaccaccgccgagggcaccuccauccccaccuccccccccuccgagggcaccaccccccucgccuccaugcccgucuccaccacccccgucgucuccuccgaggccggcacccucuccaccacccccgucgacaccuccacccccaugaccaccuccaccgaggccuccuccucccccaccaccgccgaggacaucgucguccccaucuccaccgccuccgagggcuccacccuccucaccuccauccccgucuccaccacccccgucgccucccccgaggccuccacccucuccaccacccccgucgacuccaacucccccgucgucaccuccaccgagaucuccuccuccgccaccuccgccgagggcaccuccaugcccaccuccaccuacuccgagggcuccaccccccuccgcuccaugcccgucuccaccaagccccucgccuccuccgaggccuccacccucuccaccacccccgucgacaccuccauccccgucaccaccuccaccgagaccuccuccucccccaccaccgccaaggacaccuccaugcccaucuccacccccuccgaggucuccaccucccucaccuccauccucgucuccaccaugcccgucgccuccuccgaggccuccacccucuccaccacccccgucgacacccgcacccucgucaccaccuccaccggcaccuccuccucccccaccaccgccgagggcuccuccaugcccaccuccacccccggcgagcgcuccaccccccucaccaacauccucgucuccaccacccuccucgccaacuccgaggccuccacccucuccaccacccccgucgacaccuccacccccgucaccaccuccgccgaggccuccuccucccccaccaccgccgagggcaccuccaugcgcaucuccacccccuccgacggcuccaccccccucaccuccauccucgucuccacccuccccgucgccuccuccgaggccuccaccgucuccaccaccgccgucgacaccuccauccccgucaccaccuccaccgaggccuccuccucccccaccaccgccgaggucaccuccaugcccaccuccacccccuccgagaccuccaccccccucaccuccaugcccgucaaccacacccccgucgccuccuccgaggccggcacccucuccaccacccccgucgacaccuccacccccgucaccaccuccaccaaggccuccuccucccccaccaccgccgagggcaucgucguccccaucuccaccgccuccgagggcuccacccuccucaccuccauccccgucuccaccacccccgucgccuccuccgaggccuccacccucuccaccacccccgucgacaccuccauccccgucaccaccuccaccgagggcuccuccucccccaccaccgccgagggcaccuccaugcccaucuccacccccuccgaggucuccaccccccucaccuccauccucgucuccaccguccccgucgccggcuccgaggccuccacccucuccaccacccccgucgacacccgcacccccgucaccaccuccgccgaggccuccuccucccccaccaccgccgagggcaccuccaugcccaucuccacccccggcgagcgccgcaccccccucaccuccauguccgucuccaccaugcccgucgccuccuccgaggccuccacccucucccgcacccccgccgacaccuccacccccgucaccaccuccaccgaggccuccuccucccccaccaccgccgagggcaccggcauccccaucuccacccccuccgagggcuccaccccccucaccuccauccccgucuccaccacccccgucgccauccccgaggccuccacccucuccaccacccccgucgacuccaacucccccgucgucaccuccaccgaggucuccuccucccccacccccgccgagggcaccuccaugcccaucuccaccuacuccgagggcuccaccccccucaccggcguccccgucuccaccacccccgucaccuccuccgccaucuccacccucuccaccacccccgucgacaccuccacccccgucaccaccuccaccgaggcccacuccucccccaccaccuccgagggcaccuccaugcccaccuccacccccuccgagggcuccaccccccucaccuacaugcccgucuccaccaugcucgucgucuccuccgaggacuccacccucuccgccacccccgucgacaccuccacccccgucaccaccuccaccgaggccaccuccuccaccaccgccgagggcaccuccauccccaccuccacccccuccgagggcaugaccccccucaccuccguccccgucuccaacacccccgucgccuccuccgaggccuccauccucuccaccacccccgucgacuccaacaccccccucaccaccuccaccgaggccuccuccuccccccccaccgccgagggcaccuccaugcccaccuccacccccuccgagggcuccaccccccucaccuccaugcccgucuccaccaccaccgucgccuccuccgagaccuccacccucuccaccacccccgccgacaccuccacccccgucaccaccuacucccaggccuccuccuccccccccaucgccgacggcaccuccaugcccaccuccaccuacuccgagggcuccaccccccucaccaacauguccuucuccaccacccccgucgucuccuccgaggccuccacccucuccaccacccccgucgacaccuccacccccgucaccaccuccaccgaggccucccucucccccaccaccgccgagggcaccuccauccccaccuccucccccuccgagggcaccaccccccucgccuccaugcccgucuccaccacccccgucgucuccuccgaggucaacacccucuccaccacccccgucgacuccaacacccucgucaccaccuccaccgaggccuccuccucccccaccaucgccgagggcaccucccuccccaccuccaccaccuccgagggcuccaccccccucuccaucaugccccucuccaccacccccgucgccuccuccgaggccuccacccucuccaccacccccgucgacaccuccacccccgucaccaccuccucccccaccaacuccucccccaccaccgccgaggucaccuccaugcccaccuccaccgccggcgagggcuccaccccccucaccaacaugcccgucuccaccacccccgucgccuccuccgaggccuccacccucuccaccacccccgucgacuccaacaccuucgucaccuccuccucccaggccuccuccucccccgccacccuccaggucaccaccaugcgcauguccacccccuccgagggcuccuccucccucaccaccaugcuccucuccuccaccuacgucaccuccuccgaggccuccacccccuccacccccuccgucgaccgcuccacccccgucaccaccuccacccaguccaacuccacccccaccccccccgaggucaucacccuccccauguccacccccuccgaggucuccaccccccucaccaucaugcccgucuccaccaccuccgucaccaucuccgaggccggcaccgccuccacccuccccgucgacaccuccacccccgucaucaccuccacccaggucuccuccucccccgucacccccgagggcaccaccaugcccaucuggacccccuccgagggcuccaccccccucaccaccaugcccgucuccaccacccgcgucaccuccuccgagggcuccacccucuccacccccuccgucgucaccuccacccccgucaccaccuccaccgaggccaucuccuccuccgccacccucgacuccaccaccauguccgucuccaugcccauggagaucuccacccucggcaccaccauccucgucuccaccacccccgucacccgcuuccccgaguccuccacccccuccauccccuccgucuacaccuccauguccaugaccaccgccuccgagggcuccuccucccccaccacccucgagggcaccaccaccaugcccauguccaccaccuccgagcgcuccacccuccucaccaccguccucaucucccccaucuccgucaugucccccuccgaggccuccacccucuccaccccccccggcgacaccuccaccccccuccucaccuccaccaaggccggcuccuucuccauccccgccgaggucaccaccauccgcaucuccaucaccuccgagcgcuccaccccccucaccacccuccucgucuccaccacccuccccaccuccuuccccggcgccuccaucgccuccacccccccccucgacaccuccaccaccuucacccccuccaccgacaccgccuccacccccaccauccccgucgccaccaccaucuccgucuccgucaucaccgagggcuccacccccggcaccaccaucuucauccccuccacccccgucaccuccuccaccgccgacgucuuccccgccaccaccggcgccgucuccacccccgucaucaccuccaccgagcucaacacccccuccaccuccuccuccuccaccaccaccuccuucuccaccaccaaggaguucaccacccccgccaugaccaccgccgccccccucaccuacgucaccauguccaccgcccccuccaccccccgcaccaccucccgcggcugcaccaccuccgccuccacccucuccgccaccuccaccccccacaccuccaccuccgucaccacccgccccgucacccccuccuccgaguccucccgccccuccaccaucaccucccacaccaucccccccaccuucccccccgcccacuccuccaccccccccaccaccuccgccuccuccaccaccgucaaccccgaggccgucaccaccaugaccacccgcaccaagcccuccacccgcaccaccuccuuccccaccgucaccaccaccgccguccccaccaacaccaccaucaaguccaaccccaccuccacccccaccgucccccgcaccaccaccugcuucggcgacggcugccagaacaccgccucccgcugcaagaacggcggcaccugggacggccucaagugccagugccccaaccucuacuacggcgagcucugcgaggaggucgucuccuccaucgacaucggcccccccgagaccaucuccgcccagauggagcucaccgucaccgucaccuccgucaaguucaccgaggagcucaagaaccacuccucccaggaguuccaggaguucaagcagaccuucaccgagcagaugaacaucgucuacuccggcauccccgaguacgucggcgucaacaucaccaagcuccgccucggcuccgucgucgucgagcacgacguccuccuccgcaccaaguacacccccgaguacaagaccguccucgacaacgccaccgaggucgucaaggagaagaucaccaaggucaccacccagcagaucaugaucaacgacaucugcuccgacaugaugugcuucaacaccaccggcacccagguccagaacaucaccgucacccaguacgaccccgaggaggacugccgcaagauggccaaggaguacggcgacuacuucgucgucgaguaccgcgaccagaagcccuacugcaucucccccugcgagcccggcuucuccgucuccaagaacugcaaccucggcaagugccagaugucccucuccggcccccagugccucugcgucaccaccgagacccacugguacuccggcgagaccugcaaccagggcacccagaagucccucgucuacggccucgucggcgccggcgucguccucaugcucaucauccucgucgcccuccucaugcucgucuuccgcuccaagcgcgaggucaagcgccagaaguaccgccucucccagcucuacaaguggcaggaggaggacuccggccccgcccccggcaccuuccagaacaucggcuucgacaucugccaggacgacgacuccauccaccucgaguccaucuacuccaacuuccagcccucccuccgccacaucgaccccgagaccaagauccgcauccagcgcccccaggucaugaccaccuccuucuga

SEQ ID NO: 802 - RNA, 1215 nt, Artificial Sequence
  Q9NNX6
auguccgacuccaaggagccccgccuccagcagcucggccuccucgaggaggagcagcuccgcggccucggcuuccgccagacccgcggcuacaagucccucgccggcugccucggccacggcccccucguccuccagcuccucuccuucacccuccucgccggccuccucguccaggucuccaagguccccuccuccaucucccaggagcagucccgccaggacgccaucuaccagaaccucacccagcucaaggccgccgucggcgagcucuccgagaaguccaagcuccaggagaucuaccaggagcucacccagcucaaggccgccgucggcgagcuccccgagaaguccaagcuccaggagaucuaccaggagcucacccgccucaaggccgccgucggcgagcuccccgagaaguccaagcuccaggagaucuaccaggagcucaccuggcucaaggccgccgucggcgagcuccccgagaaguccaagaugcaggagaucuaccaggagcucacccgccucaaggccgccgucggcgagcuccccgagaaguccaagcagcaggagaucuaccaggagcucacccgccucaaggccgccgucggcgagcuccccgagaaguccaagcagcaggagaucuaccaggagcucacccgccucaaggccgccgucggcgagcuccccgagaaguccaagcagcaggagaucuaccaggagcucacccagcucaaggccgccgucgagcgccucugccaccccugccccugggaguggaccuucuuccagggcaacugcuacuucauguccaacucccagcgcaacuggcacgacuccaucaccgccugcaaggaggucggcgcccagcucgucgucaucaaguccgccgaggagcagaacuuccuccagcuccaguccucccgcuccaaccgcuucaccuggaugggccucuccgaccucaaccaggagggcaccuggcagugggucgacggcuccccccuccuccccuccuucaagcaguacuggaaccgcggcgagcccaacaacgucggcgaggaggacugcgccgaguucuccggcaacggcuggaacgacgacaagugcaaccucgccaaguucuggaucugcaagaaguccgccgccuccugcucccgcgacgaggagcaguuccucucccccgcccccgccacccccaaccccccccccgccuga

SEQ ID NO: 803 - RNA, 3126 nt, Artificial Sequence
  Q9NR97
auggagaacauguuccuccaguccuccaugcucaccugcaucuuccuccucaucuccggcuccugcgagcucugcgccgaggagaacuucucccgcuccuaccccugcgacgagaagaagcagaacgacuccgucaucgccgagugcuccaaccgccgccuccaggaggucccccagaccgucggcaaguacgucaccgagcucgaccucuccgacaacuucaucacccacaucaccaacgaguccuuccagggccuccagaaccucaccaagaucaaccucaaccacaaccccaacguccagcaccagaacggcaaccccggcauccaguccaacggccucaacaucaccgacggcgccuuccucaaccucaagaaccuccgcgagcuccuccucgaggacaaccagcucccccagauccccuccggccuccccgagucccucaccgagcucucccucauccagaacaacaucuacaacaucaccaaggagggcaucucccgccucaucaaccucaagaaccucuaccucgccuggaacugcuacuucaacaaggucugcgagaagaccaacaucgaggacggcgucuucgagacccucaccaaccucgagcuccucucccucuccuucaacucccucucccacgucccccccaagcuccccuccucccuccgcaagcucuuccucuccaacacccagaucaaguacaucuccgaggaggacuucaagggccucaucaaccucacccuccucgaccucuccggcaacugcccccgcugcuucaacgcccccuuccccugcguccccugcgacggcggcgccuccaucaacaucgaccgcuucgccuuccagaaccucacccagcuccgcuaccucaaccucuccuccaccucccuccgcaagaucaacgccgccugguucaagaacaugccccaccucaagguccucgaccucgaguucaacuaccucgucggcgagaucgccuccggcgccuuccucaccaugcucccccgccucgagauccucgaccucuccuucaacuacaucaagggcuccuacccccagcacaucaacaucucccgcaacuucuccaagcuccucucccuccgcgcccuccaccuccgcggcuacgucuuccaggagcuccgcgaggacgacuuccagccccucaugcagcuccccaaccucuccaccaucaaccucggcaucaacuucaucaagcagaucgacuucaagcucuuccagaacuucuccaaccucgagaucaucuaccucuccgagaaccgcaucuccccccucgucaaggacacccgccaguccuacgccaacuccuccuccuuccagcgccacauccgcaagcgccgcuccaccgacuucgaguucgacccccacuccaacuucuaccacuucacccgcccccucaucaagccccagugcgccgccuacggcaaggcccucgaccucucccucaacuccaucuucuucaucggccccaaccaguucgagaaccuccccgacaucgccugccucaaccucuccgccaacuccaacgcccagguccucuccggcaccgaguucuccgccaucccccacgucaaguaccucgaccucaccaacaaccgccucgacuucgacaacgccuccgcccucaccgagcucuccgaccucgagguccucgaccucuccuacaacucccacuacuuccgcaucgccggcgucacccaccaccucgaguucauccagaacuucaccaaccucaagguccucaaccucucccacaacaacaucuacacccucaccgacaaguacaaccucgaguccaagucccucgucgagcucgucuucuccggcaaccgccucgacauccucuggaacgacgacgacaaccgcuacaucuccaucuucaagggccucaagaaccucacccgccucgaccucucccucaaccgccucaagcacauccccaacgaggccuuccucaaccuccccgccucccucaccgagcuccacaucaacgacaacaugcucaaguucuucaacuggacccuccuccagcaguucccccgccucgagcuccucgaccuccgcggcaacaagcuccucuuccucaccgacucccucuccgacuucaccuccucccuccgcacccuccuccucucccacaaccgcaucucccaccuccccuccggcuuccucuccgaggucuccucccucaagcaccucgaccucuccuccaaccuccucaagaccaucaacaaguccgcccucgagaccaagaccaccaccaagcucuccaugcucgagcuccacggcaaccccuucgagugcaccugcgacaucggcgacuuccgccgcuggauggacgagcaccucaacgucaagaucccccgccucgucgacgucaucugcgccucccccggcgaccagcgcggcaaguccaucgucucccucgagcucaccaccugcgucuccgacgucaccgccgucauccucuucuucuucaccuucuucaucaccaccauggucaugcucgccgcccucgcccaccaccucuucuacugggacgucugguucaucuacaacgucugccucgccaaggucaagggcuaccgcucccucuccaccucccagaccuucuacgacgccuacaucuccuacgacaccaaggacgccuccgucaccgacugggucaucaacgagcuccgcuaccaccucgaggagucccgcgacaagaacguccuccucugccucgaggagcgcgacugggaccccggccucgccaucaucgacaaccucaugcaguccaucaaccaguccaagaagaccgucuucguccucaccaagaaguacgccaaguccuggaacuucaagaccgccuucuaccucgcccuccagcgccucauggacgagaacauggacgucaucaucuucauccuccucgagcccguccuccagcacucccaguaccuccgccuccgccagcgcaucugcaaguccuccauccuccaguggcccgacaaccccaaggccgagggccucuucuggcagacccuccgcaacgucguccucaccgagaacgacucccgcuacaacaacauguacgucgacuccaucaagcaguacuga

SEQ ID NO: 804 - RNA, 66 nt, Artificial Sequence
  P16671_TM_1_8-29
ggccucaucgccggcgccgucaucggcgccguccucgccgucuucggcggcauccucaugcccguc

SEQ ID NO: 805 - RNA, 81 nt, Artificial Sequence
  P32248_TM_1_60-86
uuccuccccaucauguacuccaucaucugcuucgucggccuccucggcaacggccucgucguccucaccuacaucuacuuc

SEQ ID NO: 806 - RNA, 66 nt, Artificial Sequence
  P16671_TM_2_440-461
cuccucggccucaucgagaugauccuccucuccgucggcgucgucauguucgucgccuucaugauc

SEQ ID NO: 807 - RNA, 63 nt, Artificial Sequence
  P32248_TM_2_96-116
uaccuccucaaccucgccgucgccgacauccucuuccuccucacccuccccuucugggccuac

SEQ ID NO: 808 - RNA, 66 nt, Artificial Sequence
  P32248_TM_3_131-152
cucaucuucgccaucuacaagauguccuucuucuccggcaugcuccuccuccucugcaucuccauc

SEQ ID NO: 809 - RNA, 63 nt, Artificial Sequence
  P32248_TM_4_171-191
guccuccucaucuccaagcucuccugcgucggcaucuggauccucgccaccguccucuccauc

SEQ ID NO: 810 - RNA, 84 nt, Artificial Sequence
  P32248_TM_5_220-247
uucaucaccauccaggucgcccagauggucaucggcuuccucgucccccuccucgccauguccuucugcuaccucgucaucauc

SEQ ID NO: 811 - RNA, 78 nt, Artificial Sequence
  P32248_TM_6_264-289
gucaucaucgccgucgucgucgucuucaucgucuuccagcuccccuacaacggcgucguccucgcccagaccgucgcc

SEQ ID NO: 812 - RNA, 54 nt, Artificial Sequence
  P32248_TM_7_314-331
cucgccugcguccgcugcugcgucaaccccuuccucuacgccuucaucggcguc

SEQ ID NO: 813 - RNA, 69 nt, Artificial Sequence
  A0A5B9_TM_145-167
accauccucuacgagauccuccucggcaaggccacccucuacgccguccucgucuccgcccucguccuc

SEQ ID NO: 814 - RNA, 69 nt, Artificial Sequence
  B7Z8K6_TM_130-152
cucggccuccgcaugcucuucgccaagaccgucgccgucaacuuccuccucaccgccaagcucuucuuc

SEQ ID NO: 815 - RNA, 63 nt, Artificial Sequence
  O00206_TM_632-652
accaucaucggcgucuccguccucuccguccucgucgucuccgucgucgccguccucgucuac

SEQ ID NO: 816 - RNA, 66 nt, Artificial Sequence
  P01730_TM_397-418
auggcccucaucguccucggcggcgucgccggccuccuccucuucaucggccucggcaucuucuuc

SEQ ID NO: 817 - RNA, 63 nt, Artificial Sequence
  P01850_TM_151-171
auccuccucggcaaggccacccucuacgccguccucgucuccgcccucguccucauggccaug

SEQ ID NO: 818 - RNA, 78 nt, Artificial Sequence
  P07766_TM_127-152
gucauguccgucgccaccaucgucaucgucgacaucugcaucaccggcggccuccuccuccucgucuacuacuggucc

SEQ ID NO: 819 - RNA, 66 nt, Artificial Sequence
  P08575_TM_576-597
gcccucaucgccuuccucgccuuccucaucaucgucaccuccaucgcccuccucgucguccucuac

SEQ ID NO: 820 - RNA, 63 nt, Artificial Sequence
  P08637_TM_209-229
gucuccuucugccucgucaugguccuccucuucgccgucgacaccggccucuacuucuccguc

SEQ ID NO: 821 - RNA, 81 nt, Artificial Sequence
  P10747_TM_153-179
uucuggguccucgucgucgucggcggcguccucgccugcuacucccuccucgucaccgucgccuucaucaucuucuggguc

SEQ ID NO: 822 - RNA, 66 nt, Artificial Sequence
  P11912_TM_144-165
aucaucaccgccgagggcaucauccuccucuucugcgccgucguccccggcacccuccuccucuuc

SEQ ID NO: 823 - RNA, 66 nt, Artificial Sequence
  P15391_TM_292-313
gucuccgccgucacccucgccuaccucaucuucugccucugcucccucgucggcauccuccaccuc

SEQ ID NO: 824 - RNA, 63 nt, Artificial Sequence
  P16410_TM_162-182
uuccuccucuggauccucgccgccgucuccuccggccucuucuucuacuccuuccuccucacc

SEQ ID NO: 825 - RNA, 63 nt, Artificial Sequence
  P26718_TM_52-72
cccuucuucuucugcugcuucaucgccgucgccaugggcauccgcuucaucaucauggucgcc

SEQ ID NO: 826 - RNA, 63 nt, Artificial Sequence
  P30273_TM_24-44
cucugcuacauccucgacgccauccucuuccucuacggcaucguccucacccuccucuacugc

SEQ ID NO: 827 - RNA, 63 nt, Artificial Sequence
  P40259_TM_160-180
ggcaucaucaugauccagacccuccucaucauccucuucaucaucguccccaucuuccuccuc

SEQ ID NO: 828 - RNA, 63 nt, Artificial Sequence
  P42081_TM_248-268
uggaucaccgccguccuccccaccgucaucaucugcgucauggucuucugccucauccucugg

SEQ ID NO: 829 - RNA, 63 nt, Artificial Sequence
  Q15762_TM_255-275
ggcggcaccguccuccuccuccucuucgucaucuccaucaccaccaucaucgucaucuuccuc

SEQ ID NO: 830 - RNA, 63 nt, Artificial Sequence
  Q685J3_TM_4394-4414
cucgucggcgccggcgucguccucaugcucaucauccucgucgcccuccucaugcucgucuuc

SEQ ID NO: 831 - RNA, 63 nt, Artificial Sequence
  Q9NNX6_TM_38-58
cucggccacggcccccucguccuccagcuccucuccuucacccuccucgccggccuccucguc

SEQ ID NO: 832 - RNA, 63 nt, Artificial Sequence
  Q9NR97_TM_828-848
gccgucauccucuucuucuucaccuucuucaucaccaccauggucaugcucgccgcccucgcc

SEQ ID NO: 833 - RNA, 48 nt, Artificial Sequence
  P14207_1-16
augguguggaaguggaugccccugcuccuucuguuggucugcguugcc

SEQ ID NO: 834 - RNA, 48 nt, Artificial Sequence
  O75787_1-16
auggccguguucgucguucugcucgcucuuguggcaggcguacugggg

SEQ ID NO: 835 - RNA, 48 nt, Artificial Sequence
  P07359_1-16
augccccugcuccuucuguuguuacugcuaccuagcccacuccacccg

SEQ ID NO: 836 - RNA, 48 nt, Artificial Sequence
  P08637_1-16
auguggcagcugcuccuucccaccgcccuguuguuacuggugagcgcu

SEQ ID NO: 837 - RNA, 51 nt, Artificial Sequence
  P07237_1-17
augcugagaagggcccuccuuugccuggcuguggcagccuugguccgggcg

SEQ ID NO: 838 - RNA, 51 nt, Artificial Sequence
  O60911_1-17
augaaccugagccucgugcuugccgcuuucugccugggcaucgcauccgcc

SEQ ID NO: 839 - RNA, 51 nt, Artificial Sequence
  P20138_1-17
augccccugcuccuucuguugccuuuacugugggccggcgcucuagcaaug

SEQ ID NO: 840 - RNA, 51 nt, Artificial Sequence
  P27797_1-17
augcugcucagcgugccccuucuguugggcuuacuggggcuagccgucgcu

SEQ ID NO: 841 - RNA, 54 nt, Artificial Sequence
  P10747_1-18
augcugagacuccuucuggccuugaacuuauuccccagcauccaggugaccggc

SEQ ID NO: 842 - RNA, 54 nt, Artificial Sequence
  O75487_1-18
auggccagauucggccugcccgcucuccuuugcacccuggcaguguugagcgcc

SEQ ID NO: 843 - RNA, 54 nt, Artificial Sequence
  P07996_1-18
augggccuggccugggggcucggagugcuuuuccugaugcacgucugcgguacc

SEQ ID NO: 844 - RNA, 54 nt, Artificial Sequence
  P22748_1-18
augagaaugcugcucgcccuucuggcuuugagcgcagccaggcccuccgcgucu

SEQ ID NO: 845 - RNA, 54 nt, Artificial Sequence
  Q15762_1-18
auggacuaccccacccugcuccuugcccuguugcacguguauagagcuuuaugc

SEQ ID NO: 846 - RNA, 54 nt, Artificial Sequence
  P30273_1-18
augauccccgccgugguccugcuccuucuguuguuaguugagcaggcugcagcc

SEQ ID NO: 847 - RNA, 54 nt, Artificial Sequence
  P38570_1-18
auguggcuguuccacacccuccuuugcaucgccagccuggcuuuguuagcagcc

SEQ ID NO: 848 - RNA, 54 nt, Artificial Sequence
  Q01638_1-18
augggcuucuggauccuggccauucucaccauacuuauguacagcacagcugca

SEQ ID NO: 849 - RNA, 54 nt, Artificial Sequence
  Q9NZQ7_1-18
augagaaucuucgccguguuuauuuucaugaccuacuggcaccuccugaacgcu

SEQ ID NO: 850 - RNA, 57 nt, Artificial Sequence
  P13591_1-19
augcugcagaccaaggaccucaucuggacacuuuucuuucugggcacugccgugagc

SEQ ID NO: 851 - RNA, 57 nt, Artificial Sequence
  P26842_1-19
auggccagaccccacccuugguggcugugcgugcucggcacccuugucgggcugagc

SEQ ID NO: 852 - RNA, 57 nt, Artificial Sequence
  P15391_1-19
augcccccuccaagacuccuguucuuucuucuguucuugaccccgauggaggugagg

SEQ ID NO: 853 - RNA, 57 nt, Artificial Sequence
  Q8NI17_1-19
augauguggaccugggcccuguggaugcuccccagccuuugcaaguucucccuggcu

SEQ ID NO: 854 - RNA, 57 nt, Artificial Sequence
  P08571_1-19
auggagagagccagcugccugcuccuucuguuguuaccccuggugcacgucuccgcu

SEQ ID NO: 855 - RNA, 57 nt, Artificial Sequence
  P05154_1-19
augcagcuguuccuccuucugugcuugguguuacugagcccccaaggcgccucccua

SEQ ID NO: 856 - RNA, 57 nt, Artificial Sequence
  P02787_1-19
augagacuggccgugggcgcucuccuugucugcgcaguucugggguuguguuuagcc

SEQ ID NO: 857 - RNA, 57 nt, Artificial Sequence
  P02671_1-19
auguucagcaugagaaucgugugccugguccucuccguugugggcaccgccuggaca

SEQ ID NO: 858 - RNA, 57 nt, Artificial Sequence
  P04216_1-19
augaaccuggccaucagcauugcucuccuucugaccguguugcaggucuccagaggc

SEQ ID NO: 859 - RNA, 57 nt, Artificial Sequence
  P00747_1-19
auggagcacaaggaagugguccugcuccuucuguuguucuuaaaaagcggccagggg

SEQ ID NO: 860 - RNA, 57 nt, Artificial Sequence
  P01764_1-19
auggaguucggccugagcuggcucuuucuuguggccauccugaaggggguccagugc

SEQ ID NO: 861 - RNA, 57 nt, Artificial Sequence
  P16150_1-19
auggccacccugcuccuucuguugggcguguuagucguuagccccgacgcucugggg

SEQ ID NO: 862 - RNA, 57 nt, Artificial Sequence
  Q6DN72_1-19
augcugcucuggaccgccgugcuucuguucguccccugcguuggcaagacagugugg

SEQ ID NO: 863 - RNA, 57 nt, Artificial Sequence
  Q01151_1-19
augagcagaggccugcagcuccuucuguuguccugcgccuacucuuuagcucccgca

SEQ ID NO: 864 - RNA, 57 nt, Artificial Sequence
  P07093_1-19
augaacuggcaccucccccuguuccuucuggccagcgugaccuugccuuccaucugc

SEQ ID NO: 865 - RNA, 57 nt, Artificial Sequence
  Q8WWQ8_1-19
augaugcugcagcaccucgugaucuucugccuuggccuggucguucaaaacuuuugu

SEQ ID NO: 866 - RNA, 60 nt, Artificial Sequence
  Q13291_1-20
auggaccccaagggccugcucagccuuaccuucgugcuguuuuuguccuuagccuucggg

SEQ ID NO: 867 - RNA, 60 nt, Artificial Sequence
  P35225_1-20
auggcccugcuccuuaccacagugaucgcucugacuugcuugggcggguucgcaagcccc

SEQ ID NO: 868 - RNA, 60 nt, Artificial Sequence
  P25942_1-20
auggugagacugccccuccagugcguccuuuggggcugucuguugaccgccguucacccu

SEQ ID NO: 869 - RNA, 60 nt, Artificial Sequence
  P52803_1-20
augcugcacguggagaugcucacccuugucuuccugguuuuguggaugugcguguuuagc

SEQ ID NO: 870 - RNA, 60 nt, Artificial Sequence
  Q15116_1-20
augcagaucccccaagccccuuggccaguggucugggcuguucugcagcucggcuggaga

SEQ ID NO: 871 - RNA, 60 nt, Artificial Sequence
  P05556_1-20
augaaccugcagcccaucuucuggauuggccucauaagcuccgugugcugugucuuugcc

SEQ ID NO: 872 - RNA, 60 nt, Artificial Sequence
  Q12891_1-20
augagagccggccccgggccuaccgugacacuggcucucguccuugcaguugccugggcg

SEQ ID NO: 873 - RNA, 60 nt, Artificial Sequence
  Q8IV16_1-20
augaaggcccugggcgcugugcuccuugcacuguuguuaugcgggagacccggaaggggu

SEQ ID NO: 874 - RNA, 60 nt, Artificial Sequence
  Q03167_1-20
augaccagccacuacgugaucgccauuuucgcucugauguccucuugccucgcaacagcc

SEQ ID NO: 875 - RNA, 60 nt, Artificial Sequence
  Q14246_1-20
augagaggcuucaaccuucuccuguuuugggggugcugugugaugcacagcugggaggga

SEQ ID NO: 876 - RNA, 60 nt, Artificial Sequence
  P16871_1-20
augaccauccugggcacaacuuucgggaugguguuuagccuccuucaggucguuuccgga

SEQ ID NO: 877 - RNA, 60 nt, Artificial Sequence
  P61769_1-20
augagcagauccguggcccuggcuguccucgcacuucugucuuugucaggcuuagaggcc

SEQ ID NO: 878 - RNA, 60 nt, Artificial Sequence
  Q9Y6W8_1-20
augaaaagcggccugugguacuucuuucucuucugccuuagaaucaaggugcugaccggg

SEQ ID NO: 879 - RNA, 63 nt, Artificial Sequence
  P10966_1-21
augagacccaggcuguggcuccuucuggccgcucaguugaccguguuacacggcaacagcguc

SEQ ID NO: 880 - RNA, 63 nt, Artificial Sequence
  Q9BZW8_1-21
augcugggccagguggucacccucauccuucuguuguuacugaagguuuaccaagggaaagga

SEQ ID NO: 881 - RNA, 63 nt, Artificial Sequence
  P02778_1-21
augaaccagaccgccauccugauuugcugucucauauuccuuacacugagcggcauccaaggg

SEQ ID NO: 882 - RNA, 63 nt, Artificial Sequence
  P18564_1-21
augggcaucgagcugcucugccuuuucuuucuguucuuggggagaaacgaccacgugcaggga

SEQ ID NO: 883 - RNA, 63 nt, Artificial Sequence
  O14525_1-21
auggcccuggcuggccucugcgcacuucuggccuguugcugggggcccgcggcuguguuggcc

SEQ ID NO: 884 - RNA, 63 nt, Artificial Sequence
  P01130_1-21
augggccccuggggguggaagcugagauggaccguggcccuccuucuggcugcagccggaaca

SEQ ID NO: 885 - RNA, 63 nt, Artificial Sequence
  P01732_1-21
auggcccugcccgugaccgcucuccuucugccuuuggcauuacugcuacacgccgcgagacca

SEQ ID NO: 886 - RNA, 63 nt, Artificial Sequence
  P48061_1-21
augaacgccaagguggucguugugcugguacucgugcuuaccgcucugugcuugagcgacggc

SEQ ID NO: 887 - RNA, 63 nt, Artificial Sequence
  P01589_1-21
auggacagcuaccugcucauguggggccuucugaccuucaucauggugcccgggugccaggcc

SEQ ID NO: 888 - RNA, 63 nt, Artificial Sequence
  Q86T13_1-21
augagacccgccuucgcucugugccuccuuuggcaggcacuguggccuggcccagggggaggu

SEQ ID NO: 889 - RNA, 63 nt, Artificial Sequence
  Q5DID0_1-21
augcugagaaccagcggccucgcccuucuggcuuugguguccgcagucgggcccucucaggcc

SEQ ID NO: 890 - RNA, 66 nt, Artificial Sequence
  P40189_1-22
augcugacccuccagacauggcuugugcaagcccuguucaucuuuuugacuacggagagcaccggc

SEQ ID NO: 891 - RNA, 66 nt, Artificial Sequence
  Q86YL7_1-22
auguggaaggugagcgcccuccuguucguccuuggcuccgcuucucuguggguuuuggcagagggg

SEQ ID NO: 892 - RNA, 66 nt, Artificial Sequence
  P55075_1-22
augggcagccccagauccgcccugucuugccuccuucugcacuuguuagugcugugucuacaggcu

SEQ ID NO: 893 - RNA, 66 nt, Artificial Sequence
  Q30201_1-22
augggccccagagccaggccugcucugcuccuucugauguuguuacagaccgcagugcugcaaggg

SEQ ID NO: 894 - RNA, 66 nt, Artificial Sequence
  P07766_1-22
augcagagcggcacccacuggagagugcuggggcucugccuucuguccgucggaguuuggggucaa

SEQ ID NO: 895 - RNA, 66 nt, Artificial Sequence
  P18827_1-22
augagaagggccgcucuguggcucuggcuuugcgcacuggccuugagcuuacagcccgcgcugccu

SEQ ID NO: 896 - RNA, 66 nt, Artificial Sequence
  P55290_1-22
augcagcccagaaccccucuggugcucugcguccuucugagccaaguuuuguuacugacauccgcc

SEQ ID NO: 897 - RNA, 66 nt, Artificial Sequence
  P37173_1-22
augggcagagggcugcucaggggacuuuggccccugcacaucguguuguggacccggauugccagc

SEQ ID NO: 898 - RNA, 66 nt, Artificial Sequence
  Q07325_1-22
augaagaaaagcggcgugcuguuccuccuugggaucauucuguuggucuuaauaggaguucagggu

SEQ ID NO: 899 - RNA, 66 nt, Artificial Sequence
  P04156_1-22
auggccaaccugggcugcuggaugcucgugcuuuucgucgcuaccuggagcgaccugggguugugu

SEQ ID NO: 900 - RNA, 66 nt, Artificial Sequence
  P31785_1-22
augcugaagcccagccucccuuucaccucccuucuguuuuugcaguuaccacugcuaggcgugggg

SEQ ID NO: 901 - RNA, 69 nt, Artificial Sequence
  P01579_1-23
augaaguacaccagcuauauccuggccuuccagcucugcauugugcuuggcucccugggguguuacugc

SEQ ID NO: 902 - RNA, 69 nt, Artificial Sequence
  P23229_1-23
auggccgcugcaggccagcugugccuccuuuaccugagcgccggguuguuauccagacugggagcggcu

SEQ ID NO: 903 - RNA, 69 nt, Artificial Sequence
  O60494_1-23
augaugaacaugagccugcccuuccucuggucccuucugaccuuguuaaucuuugccgaggugaauggc

SEQ ID NO: 904 - RNA, 69 nt, Artificial Sequence
  P08575_1-23
auguaccuguggcucaagcugcuugccuucggcuuugcuuucuuggacaccgagguguuugucacaggg

SEQ ID NO: 905 - RNA, 69 nt, Artificial Sequence
  Q8IWY4_1-23
augggcgccgcugcagugagauggcaccugugcguccuccuugcccuggggaccaggggacgguuggcg

SEQ ID NO: 906 - RNA, 69 nt, Artificial Sequence
  Q08431_1-23
augccaagaccuaggcugcucgccgcucuuugcggcgcacuguugugugcccccagcuuacugguggcg

SEQ ID NO: 907 - RNA, 69 nt, Artificial Sequence
  Q99665_1-23
auggcccacaccuucagaggcugcagccuggcuuuuauguucaucauuacauggcuccuuauaaaggca

SEQ ID NO: 908 - RNA, 69 nt, Artificial Sequence
  Q6Q8B3_1-23
augagcgcccccagacugcucaucuccauuauaaucauggugucugcuucaaguagcuccugcaugggc

SEQ ID NO: 909 - RNA, 69 nt, Artificial Sequence
  Q07011_1-23
augggcaacagcugcuacaauaucguggccacccugcuccuuguccugaacuucgagagaacaaggucc

SEQ ID NO: 910 - RNA, 69 nt, Artificial Sequence
  Q8NHL6_1-23
augacccccauccugacagugcucauuugccuuggccugagcuuggggccuagaacucacguccaggcc

SEQ ID NO: 911 - RNA, 69 nt, Artificial Sequence
  P36894_1-23
augccccagcuguacaucuauauuagacuccuuggcgccuaccuguucauaaucagcagggugcaaggg

SEQ ID NO: 912 - RNA, 69 nt, Artificial Sequence
  Q16552_1-23
augacccccggcaagacaagccuggugucccuccuucuguuguuaucucuggaggccaucgucaaagcu

SEQ ID NO: 913 - RNA, 69 nt, Artificial Sequence
  P42081_1-23
auggacccccagugcaccaugggccugagcaacauccucuucgugauggccuuucuucuguccggggcu

SEQ ID NO: 914 - RNA, 69 nt, Artificial Sequence
  P43121_1-23
augggccugcccagacucgugugcgccuuccuucuggcugcauguugcuguugcccuagggucgccggg

SEQ ID NO: 915 - RNA, 69 nt, Artificial Sequence
  O00206_1-23
augaugagcgccuccagacuggcuggcacccucauccccgcaauggccuuccuuucuugcgugaggccu

SEQ ID NO: 916 - RNA, 69 nt, Artificial Sequence
  P42701_1-23
auggagccccuggugaccugggucguuccucuccuuuuccuguuuuuguuaagcagacagggcgccgcu

SEQ ID NO: 917 - RNA, 72 nt, Artificial Sequence
  P06729_1-24
augagcuuccccugcaaguuuguggccuccuuccugcucaucuuuaacgucucuucaaaaggcgcuguuagu

SEQ ID NO: 918 - RNA, 72 nt, Artificial Sequence
  P15328_1-24
auggcccagagaaugaccacacaacugcuccuucuguuggugugggucgcuguugugggcgaggcacagacu

SEQ ID NO: 919 - RNA, 72 nt, Artificial Sequence
  P05112_1-24
augggccugaccagccagcuccuucccccucuguucuuuuuguuagccugcgcugggaacuucgugcacgga

SEQ ID NO: 920 - RNA, 72 nt, Artificial Sequence
  P06127_1-24
augcccaugggcagccugcagccucucgccacccuuuaccuguuggggauguuaguggcuuccugccuggga

SEQ ID NO: 921 - RNA, 72 nt, Artificial Sequence
  P32248_1-24
auggaccugggcaagcccaugaaaagcgugcucgucguugcccuucuggugaucuuccagguaugcuugugu

SEQ ID NO: 922 - RNA, 72 nt, Artificial Sequence
  Q7Z7D3_1-24
auggccagccugggccagauccucuucugguccauuauaucuaucauuaucauucuugcuggggcaaucgcc

SEQ ID NO: 923 - RNA, 72 nt, Artificial Sequence
  P54756_1-24
augagaggcagcgggcccaggggagccggucggcgccgaccuccauccggcgggggagacaccccgaucaca

SEQ ID NO: 924 - RNA, 72 nt, Artificial Sequence
  Q92823_1-24
augcagcugaagaucaugcccaaaaagaaaagacucagcgccggcagggugccucuuauucuguucuugugc

SEQ ID NO: 925 - RNA, 72 nt, Artificial Sequence
  P19320_1-24
augcccggcaagaugguggucauccugggggccagcaacauucucuggauaauguucgcugcaucccaggcc

SEQ ID NO: 926 - RNA, 72 nt, Artificial Sequence
  Q86UN2_1-24
augcugagaaagggcugcuguguggagcuccuucuguuguuagucgccgcugaacugccccuagggggaggu

SEQ ID NO: 927 - RNA, 75 nt, Artificial Sequence
  P33151_1-25
augcagagacugaugaugcuccuugccaccagcggcgcuugccugggguuguuagcaguggccgcggucgcugcc

SEQ ID NO: 928 - RNA, 75 nt, Artificial Sequence
  P17813_1-25
auggacagaggcacccugccccucgccguggcacuucuguuggcuagcugcuccuuaucuccuacaucacuggcc

SEQ ID NO: 929 - RNA, 75 nt, Artificial Sequence
  P25445_1-25
augcugggcaucuggacccuccuuccccugguguugacaagcgucgccagauuauccucuaagucaguuaacgcu

SEQ ID NO: 930 - RNA, 75 nt, Artificial Sequence
  P01730_1-25
augaacagaggcgugcccuucaggcaccuccugcuuguccugcaguuggccuuacugccugcugcaacccaaggg

SEQ ID NO: 931 - RNA, 75 nt, Artificial Sequence
  Q685J3_1-25
augcccagaccuggcaccauggcccugugccuccuuacacugguguugagcuuacugccaccgcaggcugcagcc

SEQ ID NO: 932 - RNA, 75 nt, Artificial Sequence
  P17787_1-25
auggccagaaggugcggccccguggcucugcuccuuggguucggacuguugcgguuauguagcggugucuggggc

SEQ ID NO: 933 - RNA, 75 nt, Artificial Sequence
  Q6UQ28_1-25
auggccguguuccacgacaugcugcuccagccccuuggcauguuucugugcuugagcuuacaacuguccucugcu

SEQ ID NO: 934 - RNA, 75 nt, Artificial Sequence
  P13987_1-25
augggcauccagggagggagcguucuguucggucuccuucuggucuuggccguguuuugccacuccggccauucu

SEQ ID NO: 935 - RNA, 75 nt, Artificial Sequence
  P10721_1-25
augagaggcgccaggggagcuugggacuuccugugcgugcuccuucuguuguuacggguccagaccgggagcucc

SEQ ID NO: 936 - RNA, 75 nt, Artificial Sequence
  P12319_1-25
auggcccccgcuauggagagcccuacccugcucugcguggcacuucuguucuuugccccagacggcgucuuggcg

SEQ ID NO: 937 - RNA, 78 nt, Artificial Sequence
  Q9BZR6_1-26
augaagagagccagcgcuggcggguccaggcugcucgcaugggugcuuuggcugcaggccuggcaagucgcggcuccc

SEQ ID NO: 938 - RNA, 78 nt, Artificial Sequence
  P25063_1-26
augggcagagccaugguggcuaggcuggggcucggacuucuguuguuagcacugcuacuccccacccagaucuacagc

SEQ ID NO: 939 - RNA, 78 nt, Artificial Sequence
  Q9NR97_1-26
auggagaacauguuccugcagagcuccaugcuuaccugcaucuuucuccugauuucuggcucaugugaauugugcgcc

SEQ ID NO: 940 - RNA, 78 nt, Artificial Sequence
  Q8N131_1-26
augggccugggggccagaggagcuugggcagcccuccuucuggguaccuuacagguguuggcgcugcuaggcgcugcc

SEQ ID NO: 941 - RNA, 78 nt, Artificial Sequence
  P49771_1-26
augaccgugcuggcccccgcuuggagcccuacaacuuaccuccuucuguuguuacugcuauccucuggccucucaggg

SEQ ID NO: 942 - RNA, 78 nt, Artificial Sequence
  P02679_1-26
augagcuggucccugcaccccagaaaccucauccuuuacuucuaugcccuguuguuuuuaucuucaaccugcguggcu

SEQ ID NO: 943 - RNA, 78 nt, Artificial Sequence
  P14784_1-26
auggccgcucccgcacugagcuggagacucccucuucugaucuuguuacugccacuagccaccuccugggcgucugcu

SEQ ID NO: 944 - RNA, 81 nt, Artificial Sequence
  P05362_1-27
auggcccccagcuccccuagaccagcucugccggcacuccuugugcuguugggcgccuuauuccccgggccuggaaacgcg

SEQ ID NO: 945 - RNA, 81 nt, Artificial Sequence
  Q13740_1-27
auggagagcaagggcgccuccucuugcagacuccuguucugucuucugaucucagcuaccguguuuaggcccggguuggga

SEQ ID NO: 946 - RNA, 84 nt, Artificial Sequence
  Q13443_1-28
augggcagcggggccagauuccccuccggaacccugagggugcgguggcuccuucuguuggguuuagucggcccuguucugggg

SEQ ID NO: 947 - RNA, 84 nt, Artificial Sequence
  P14151_1-28
augaucuuccccuggaagugccagagcacccaaagagaccuguggaacauuuuuaaacucuggggcuggacaaugcuuuguugc

SEQ ID NO: 948 - RNA, 84 nt, Artificial Sequence
  P56199_1-28
auggcccccagaccuagggcucggccaggcguggcagucgccugcuguuggcugcucaccguugugcuucgcugcuguguaagc

SEQ ID NO: 949 - RNA, 84 nt, Artificial Sequence
  P11279_1-28
auggccgcucccggcagcgcaagaaggccucugcuccuucuguuguuacugcuacuccuggggcuuaugcacugcgccuccgcg

SEQ ID NO: 950 - RNA, 84 nt, Artificial Sequence
  P40259_1-28
auggccagacuggcucucagccccgugccuucccacuggauggucgcacuucuguuguuacugucugccgagccaguuccggcg

SEQ ID NO: 951 - RNA, 84 nt, Artificial Sequence
  P43681_1-28
auggagcugggcgggcccggagccccuagacuccuuccaccgcuguuguuacugcuagguaccggccuccugagggcuagcucc

SEQ ID NO: 952 - RNA, 84 nt, Artificial Sequence
  P18627_1-28
augugggaggcccaguuccugggccuccuuuuucugcaacccuuguggguggcuccugucaagccauuacagccgggggcagaa

SEQ ID NO: 953 - RNA, 84 nt, Artificial Sequence
  Q5ZPR3_1-28
augcugagaaggcggggcagccccgggaugggagugcacgucggugccgcucucggcgcacuuugguucugccugaccggggcc

SEQ ID NO: 954 - RNA, 84 nt, Artificial Sequence
  P23415_1-28
auguacagcuucaacacccugagacucuaucuuugggagacaaucguguuuuucucccuggccgcuucuaaggaagcagaggcc

SEQ ID NO: 955 - RNA, 84 nt, Artificial Sequence
  Q8TD46_1-28
augcugugccccuggagaaccgccaaccucggccuucuguugaucuuaacaauuuuccugguggcugcaagcuccucucuaugu

SEQ ID NO: 956 - RNA, 87 nt, Artificial Sequence
  P17301_1-29
augggccccgagagaaccggggccgcuccucugccacuccuucugguguuggcauuaagccagggaauccugaacugcugucuagcc

SEQ ID NO: 957 - RNA, 87 nt, Artificial Sequence
  P12821_1-29
augggcgccgcuagcgggagaaggggacccggucugcuccuuccucugccauuguuacugcuacucccgccccagccugcacuggcc

SEQ ID NO: 958 - RNA, 87 nt, Artificial Sequence
  Q14118_1-29
augagaaugagcgugggccugucccuccuucugcccuugugggggaggaccuucuuacugcuacucucugucguuauggcccaguca

SEQ ID NO: 959 - RNA, 87 nt, Artificial Sequence
  P05231_1-29
augaacagcuucuccaccucugccuuuggccccguggcuuucucacuggggcuccuucuggucuugccugcagccuuuccagcgccg

SEQ ID NO: 960 - RNA, 87 nt, Artificial Sequence
  O00602_1-29
auggagcugagcggcgccaccauggcuagagggcucgcagugcuucuggucuuguucuuacacaucaagaaccugcccgcccaggcg

SEQ ID NO: 961 - RNA, 87 nt, Artificial Sequence
  Q9Y6Q6_1-29
auggcccccagagcuaggcggcgccgaccucuguucgcacuccuucuguugugcgccuuacuggcgcgucuacagguggcucuccaa

SEQ ID NO: 962 - RNA, 87 nt, Artificial Sequence
  Q9ULI3_1-29
auggccagccccagagcuuccagguggccuccaccgcugcuccuucuguuguuaccccugcuacuccugccuccagcagcccccggc

SEQ ID NO: 963 - RNA, 90 nt, Artificial Sequence
  Q8NBP7_1-30
augggcaccgugagcuccagaaggucuugguggccccugccucuccuucuguuguuacugcuacuccuggggccagccggagcucgggca

SEQ ID NO: 964 - RNA, 90 nt, Artificial Sequence
  P02675_1-30
augaagagaauggugagcugguccuuccacaaacugaagaccaugaaacaucuccuucuguuguuacugugcgucuuucuaguuaagucu

SEQ ID NO: 965 - RNA, 90 nt, Artificial Sequence
  P06756_1-30
auggccuucccucccagaaggcggcugcgccucggcccacgagggcuuccgcuguuguuaagcggacugcuacucccccugugccgugcu

SEQ ID NO: 966 - RNA, 93 nt, Artificial Sequence
  O60609_1-31
auggugagaccccugaacccuaggccacucccgcccgucguucuuaugcuguuguuacugcuaccuccaagcccccucccucuggccgcuggc

SEQ ID NO: 967 - RNA, 93 nt, Artificial Sequence
  P50895_1-31
auggagcccccugacgccccagcucaggcaagaggcgccccgaggcugcuccuucuggcgguguuguuagcugcccaccccgaugcacaagcc

SEQ ID NO: 968 - RNA, 93 nt, Artificial Sequence
  P28906_1-31
augcuggugagaaggggcgcccgggcugggccccgcaugccucgaggauggaccgcacucugccuucugagcuuguuaccauccgguuucaug

SEQ ID NO: 969 - RNA, 93 nt, Artificial Sequence
  P08514_1-31
auggccagagcucugugcccccuccaggcacuuuggcuguuggaguggguguuacugcuacucggcccuugugccgcgccaccggcuugggcc

SEQ ID NO: 970 - RNA, 93 nt, Artificial Sequence
  P00742_1-31
augggcagaccccugcaccucgugcuucugagcgccuccuuggcuggguuacugcuacucggagagucucuguucaucaggcgggaacaggca

SEQ ID NO: 971 - RNA, 96 nt, Artificial Sequence
  P26006_1-32
augggccccgggccuagcagagccccaagggcuccgcggcugaugcucugcgcacuugcccugaugguggcggcuggagguugugucguuuccgcc

SEQ ID NO: 972 - RNA, 96 nt, Artificial Sequence
  P13726_1-32
auggagacccccgccuggccuagagugccaaggccggaaacagcugucgcacggacucugcuccuuggcuggguuuucgcccagguggcgggggcu

SEQ ID NO: 973 - RNA, 96 nt, Artificial Sequence
  P11912_1-32
augcccggcgggccuggagugcugcaggcccucccagcuaccaucuuccuucuguuuuuguuaagcgcagucuaccuggguccgggcugccaagcc

SEQ ID NO: 974 - RNA, 96 nt, Artificial Sequence
  Q9H6X2_1-32
auggccaccgcugagagaagggcacugggcaucggguuccaguggcucagccuugccacacugguguugauuugcgcgggacaagguggccggcgc

SEQ ID NO: 975 - RNA, 99 nt, Artificial Sequence
  Q8IWK6_1-33
auggagcccccuggcagaaggcgggggcgcgcccagccaccgcugcuccuuccccugagcuuguuagcucugcuagcacuccugggagguggcggggga

SEQ ID NO: 976 - RNA, 99 nt, Artificial Sequence
  P58335_1-33
augguggccgagagaagccccgcuagguccccuggcucuuggcuguucccagggcucuggcuucuggucuugucaggaccggguggcuuacugcgggca

SEQ ID NO: 977 - RNA, 102 nt, Artificial Sequence
  P06731_1-34
auggagagccccuccgccccuccacacagauggugcaucccguggcagaggcugcuccuuaccgcuucucuguugacauucuggaacccucccacuacggca

SEQ ID NO: 978 - RNA, 102 nt, Artificial Sequence
  P33681_1-34
augggccacaccagaaggcaggggacaagccccuccaagugcccuuaccugaacuucuuucaacuccuugugcuggccggauugucucauuucuguucaggu

SEQ ID NO: 979 - RNA, 105 nt, Artificial Sequence
  P38567_1-35
augggcgugcugaaguucaaacacaucuuuuucagauccuuugucaagagcucugggguuucacagauuguguucaccuuucuccuuauacccugcugucugaca

SEQ ID NO: 980 - RNA, 105 nt, Artificial Sequence
  P16410_1-35
auggccugccugggcuuccagagacacaaggcucaacucaaccuugcaaccaggacauggcccuguacucuguuguuuuucuuacuguuuaucccuguguucugc

SEQ ID NO: 981 - RNA, 111 nt, Artificial Sequence
  P15814_1-37
augagacccggcaccgggcagggaggucuggaggccccuggcgaaccagggccgaaccucaggcaacgguggccccuucuguuguuaggacuggcuguggucacacacggc

SEQ ID NO: 982 - RNA, 114 nt, Artificial Sequence
  Q92956_1-38
auggagcccccuggcgacugggggccaccgcccuggagaagcaccccuaagacagaugugcugaggcucguccuuuaccugacuuucuugggagccccaugcuaugcucccgca

SEQ ID NO: 983 - RNA, 123 nt, Artificial Sequence
  Q86VB7_1-41
augagcaagcugagaauggugcuccuugaggacuccggcucugccgauuucaggcggcacuuugucaaccugucacccuucaccaucacaguuguguuguuacugagugcuugcuuuguaacu

SEQ ID NO: 984 - RNA, 123 nt, Artificial Sequence
  P08648_1-41
augggcagcagaacccccgaguccccucugcacgccgugcagcucaggugggggccacggcgccgaccgccccuucugccuuuguuacugcuacuccugccacccccuccacgugucggaggu

SEQ ID NO: 985 - RNA, 123 nt, Artificial Sequence
  P16109_1-41
auggccaacugccagaucgcuauucuguaccaaagauuccagaggguggucuuuggcauaagccagcuccuuuguuucuccgcacugaucucugaguugaccaaucagaaggaaguugccgcg

SEQ ID NO: 986 - RNA, 132 nt, Artificial Sequence
  O75326_1-44
augaccccucccccaccgggcagagccgcucccagcgcaccuagggcccgggugccagggcccccugcgcgccugggacucccacuucgacugcguuuguuacugcuacucugggcugccgcagccuccgcu

SEQ ID NO: 987 - RNA, 135 nt, Artificial Sequence
  Q8N2Q7_1-45
auggcccugcccagaugcaccuggccuaacuacguguggagggcugucauggcaugucucguucaccggggccuuggggccccacugacauugugcauguuaggaugucugcuacaggcgggucaugugcucagc

SEQ ID NO: 988 - RNA, 138 nt, Artificial Sequence
  Q86UN3_1-46
augcugcccggccucagaaggcuucugcaggccccugcuagcgcaugcuuguuacugaugcuacucgcccugccacuugcggcuccguccugucccaugcugugcaccuguuacucuucaccuccaacagugaguugc

SEQ ID NO: 989 - RNA, 540 nt, Artificial Sequence
  A0A5B9
auggaccugaagaacguguuucccccugaggucgccguuuucgaaccaagcgaggcugaaaucucccacacccagaaagcaacacucgugugccuugccacuggcuucuacccggaucauguagagcugucuuggugggugaaugggaaggaaguccacucaggagugaguacggacccccaaccuuugaaagagcagccagcguuaaacgauagcagauauugucuguccucuaggcuacggguuucggcuaccuuuuggcagaauccccgcaaccauuuccgaugccaggugcaauuuuacggucucucagagaaugacgaauggacacaggaucgugccaagccugucacucagauugugagcgcagaggccuggggcagagcugacuguggguucaccagugaauccuaucagcaaggaguacugucugcaacaauacuuuacgagauccuguugggcaaagccacccucuaugcuguucuggugagcgcccugguccucauggcgauggugaagaggaaggauucccgggguuga

SEQ ID NO: 990 - RNA, 465 nt, Artificial Sequence
  B7Z8K6
augagccagccccacaccaagccuuccguguucgucaugaaaaacggcacaaauguugccugccuggugaaggaguuuuacccaaaagacaucagaauuaaccucguaucuucaaagaaaauaacugaguucgauccggcuaucgugauuagucccagcgggaaguauaaugcagucaaacuuggaaaguacgaagacuccaacucugugacguguucgguucaacaugauaauaagaccgugcacucaacagacuuugaagucaaaacugauagcaccgaccaugugaagccuaaagagacagaaaacaccaagcagccaaguaaguccugccacaaacccaaggccaucguacauacugagaaaguuaauaugaugucucugacaguguuggguuuaaggaugcuguucgcgaagaccgucgcugugaacuuucuacucacggccaaacuguucuuucuuuga

SEQ ID NO: 991 - RNA, 645 nt, Artificial Sequence
  B9A064
augagacccaagaccggccagguggggugcgagacaccugaggaacugggaccagguccgaggcaacgguggccccuccuucuguugggcuuagccauggucgcucacgggcugcuacgcccuaugguugcaccacagagcggagaccccgauccuggcgccuccguggguucuucacgaaguagccuccguucccugugggggagacuucuguugcagccaucuccccagagggcggacccucgguguuggccacgcggauucuggucggaaccgcaaucacucugcuacguauuuggcacuggcacgaaagugaccguccuggggcagcccaaggcuaacccuacagugacucuguucccacccagcagugaggaacuccaggccaauaaagcaaccuuaguuugucugaucuccgauuuuuauccuggagccgugacagucgcuuggaaggcagacgguucuccagugaaagccggcguagagaccacuaagcccagcaagcaguccaacaauaaauacgcugccucaaguuaucuuagcuugacaccggagcaauggaagucucauagauccuacucaugccagguuacccacgaagggagcacgguggagaaaacugucgcgccuaccgaauguaguuga

SEQ ID NO: 992 - RNA, 2520 nt, Artificial Sequence
  O00206
augaugagcgccuccagacuggcuggcacccucauccccgcaauggccuuccuuucuugcgugaggccugagucaugggaaccaugugucgagguugugccgaacauuacauaccagugcauggaacugaauuuuuauaagauacccgacaacuugccuuucaguacuaaaaauuuagaucugagcuuuaacccacuacggcaccucggguccuacucuuucuuuucguuccccgagcugcaaguacuugaccugucacgcugugaaauccagacgauugaggauggagcguaucagagcuugagucaucucuccacccugauccugacagguaauccuauucagucucucgcuuuaggcgccuuuagcgggcuguccucacuucaaaaguugguggcagucgagacuaaccuggccagucuagaaaauuucccaaucggacaccucaaaacccugaaggagcuuaacguggcucauaaucugauacagagcuuuaaauugcccgaauacuucucuaaccucacaaaucuggagcacuuagaccuguccucaaacaagauccagagcauuuauugcaccgaucuccgaguucuucaucagaugccucuguugaaucuaagucuggaccucucucugaacccaaugaauuuuauccaaccgggcgcauucaaggagauucgucuucacaaacugacuuugagaaacaacuuugauucccucaaugugaugaagacauguauccagggucuggccggguuagaaguccacaggcuggugcuaggagaguuccggaacgaaggcaaucucgagaaauucgacaagagcgcucuggaaggccuuugcaacuugaccauagaggaguuucgccuggccuaccucgauuauuaccuggacgauauuaucgaccuuuucaauugucugacgaacguaucgucuuuuuccuugguuucagugacuauugaaagagucaaagauuucaguuacaauuuuggguggcagcaucucgagcuggugaacugcaaguucggacaguuucccaccuuaaagcugaaaagccuaaagaggcucacauucacuuccaauaaagguggcaacgcguuuucugaaguggaccugccuagccuugaguucuuggaccugucacggaaugggcucaguuuuaagggauguugcucccaaagcgauuucggcaccacaucucugaaauauuuagaccugucauuuaacggugucaucaccaugaguagcaauuuccuuggguuggaacagcucgagcaccuggauuuccagcauuccaaccuaaagcaaaugucugaguuuucgguuuuccugagccuccgcaaucugaucuaccuugacauuucccacacgcacacucgaguggcauuuaacggaauauucaacggcuugucaagucuggaaguauuaaaaauggccggcaauucuuuucaggagaacuuccucccagauaucuuuacagaacugagaaaucuuaccuuccuggacuugagccagugucagcucgagcaacugucccccacugcuuuuaacucacuaagcucucuccaggugcugaauaugucccauaacaauuucuuuagucuggauacauucccuuauaagugccuuaacagcuugcagguccuggacuacucuuuaaaucacauuaugaccuccaagaaacaggaacuccaacauuuuccaucaagucuggccuuccuuaaccugacgcagaaugauuucgcaugcaccugugagcaccagagcuuucuacaguggaucaaggaccaaaggcagcuccugguggagguugaacggauggagugcgcuacacccucggauaaacaggggaugccgguguugucccugaacauaacuugucagaugaauaagaccauuaucggagucucuguguuaagcguacucguugugucagucguggccguccugguguauaaauucuacuuucaucuuaugcuguuggcggguugcaucaaguauggccguggggaaaacauuuacgacgccuucguuaucuacaguucccaagacgaggauugggugcgcaaugagcucguaaagaaccuggaagagggagucccucccuuucagcuaugucugcacuauagagacuucauuccaggcguggcaauagcugccaacaucauucacgaagguuuucauaaaucuaggaagguuaucguggucgugagccagcacuucauccaaucccgguggugcauuuuugaguacgaaauagcucagacauggcaguuccuuucaagccgagccgggaucauuuuuaucguacuccagaaaguggagaagacucuguugcgccaacagguugagcuguauagauuacucaguaggaauaccuaccuggaaugggaggauucuguccuuggccggcauauuuucuggcgcagacugaggaaagcauugcucgacggaaaguccuggaacccugaaggcacaguggggaccggauguaauuggcaggaggccacuagcaucuga

SEQ ID NO: 993 - RNA, 1377 nt, Artificial Sequence
  P01730
augaacagaggcgugcccuucaggcaucugcuccuuguccugcaguuggccuuacugccugcugcaacccaagggaagaaaguugugcuaggaaagaaaggugacacaguagagcucacuugcacggccagccagaagaaauccauccaguuucacuggaaaaauucuaaccagauuaagauacugggcaaucaagggucauuccuuaccaaaggaccaaguaagcugaacgaucgggcggacagccgccgauccuugugggaucagggcaauuuuccgcucaucauuaaaaaccugaagaucgaagacucugauacauacauuugugagguggaagaccagaaagaggaaguccagcugcucguguucgguuuaacugcuaauucggauacccaucugcuucaagggcagucauugacacugacccuagagagucccccuggaagcuccccaucuguucagugccguagccccagaggcaagaacauccagggcgggaagacucucuccgugucacaacuggagcuucaggacaguggaacauggaccuguacgguccugcagaaucaaaagaagguggaauuuaaaauagauaucguaguuuuggccuuccagaaggcaagcucuauuguguauaaaaaggagggugaacaggucgaguuuuccuucccucucgccuuuacuguggagaaacugaccggcucaggggaauuaugguggcaggcugagagggcaagcaguucuaaguccuggaucacauucgaccugaagaacaaagaagugagcgucaagcggguuacucaagauccaaaacuccagaugggaaagaaacuuccccugcacuugacccuaccucaggcccugccacaguacgcuggcucggguaaucucacacuggcccuugaggcgaagaccgggaagcugcaccaagaagugaacuugguagugaugcgcgcaacgcagcuccagaaaaaucugacuugcgaggucuggggaccgacaucucccaaguuaaugcugucccuaaaacucgagaacaaggaagccaaagugucaaagagagagaaggcuguuugggugcugaauccugaagccggcauguggcagugucuuuugagugacagcggccaaguccugcucgaguccaacauuaaagugcugccaaccuggucuacucccguacagccuauggcacuuaucguucugggagggguggcugguuugcuccuguuuauaggcuuagggauuuucuuuugcgucaggugucggcaucgccgaagacaggccgaaaggaugagccagaucaagcggcugcuaucagagaaaaagacaugccaauguccacaccguuuccagaaaaccugcagucccauuuga

SEQ ID NO: 994 - RNA, 537 nt, Artificial Sequence
  P01850
auggaggaccugaacaagguguuucccccugaagucgccguuuucgagccaagcgaagcugagaucucccacacccagaaagcaacacucgugugccuugccacuggcuucuuuccggaucauguagaacugucuuggugggugaaugggaaggagguccacucaggagugaguacggacccccaaccuuugaaagagcagccagcguuaaacgauagcagauacugucuguccucuaggcuacggguuucggcuaccuucuggcagaauccccgcaaccauuuucgaugccaggugcaauucuauggucucucagaaaaugacgaguggacacaggaucgugccaagccugucacucagauugugagcgcagaagccuggggcagagcugacuguggguuuaccaguguauccuaccagcaaggaguucugucugcaacaauacuuuaugagauccuguugggcaaagccacccucuacgcugugcuggucagcgcccuggugcucauggcgauggugaagaggaaggauuucuga

SEQ ID NO: 995 - RNA, 624 nt, Artificial Sequence
  P07766
augcagagcggcacccacuggagagugcuggggcucugccuucuguccgucggaguuuggggucaagacggcaacgaggaaaugggagggaucacacagacucccuacaaggugucuauuucaggcacgaccguaauauugacauguccucaguauccagguagugagaucuuauggcagcauaaugauaaaaacauugggggagacgaagaugacaagaauaucggcagcgaugaggaccaccugucccuaaaagaguucucugaacucgagcaaucgggcuacuaugugugcuacccgagggggucaaagcccgaagaugccaacuuuuaucuguaccuucgggcucgcgucugugagaauugcauggaaauggacgugaugagcguugcaacuauugugaucgucgauauauguaucaccggaggucuguugcuccugguguauuacuggaguaaaaaccgaaaggccaaggcgaaaccuguaacacguggcgcuggggccggaggcagacagaggggucagaauaaggagcggccacccccuguuccaaaccccgacuacgagccuauucgcaaagggcagagagaucuguauuccggacucaaucaaaggcggaucuga

SEQ ID NO: 996 - RNA, 3915 nt, Artificial Sequence
  P08575
auguaccuguggcucaagcuccuggccuucggcuuugcuuucuuggacaccgagguguuugucacagggcagagccccacuccuuccccaacgggauuaaccacagcaaaaaugccgucuguuccccugucaagugauccucuaccaacucacaccacagccuucagccccgcguccaccuuugaaagagagaacgacuucucugaaacuacaaccucgcucucaccugauaauacgagcacucaagugaguccagacucccuggauaacgcuucugccuuuaauaccacagguguaagcuccgugcagacuccccaucuuccuacccacgcagacucacagacaccaagugccggcaccgauacgcagacuuucagcgggucugcugcaaacgccaagcugaauccgacacccggauccaacgcuaucucagacgucccuggcgagaggagcaccgccaguacuuuuccaacagaucccgugucuccuuugaccacgacccucucccuggcgcaucacagcucggcagcccugccagcucggacaucuaauacuaccauuacagccaacacuuccgacgcauaucucaaugcuucagaaaccacaaccuuaagucccagcgguuccgccguuauaucuacuacgacaaucgcgaccacuccgagcaaaccuaccugcgaugagaaguacgccaacauuacaguggacuaucuguacaauaaagagaccaaacuuuucacugcaaaguugaacgucaaugaaaacguggagugugggaauaacacaugcacgaacaaugaaguacauaaccugaccgaguguaagaaugcuucaguuaguaucucccacaacagcugcacugcccccgauaagacacuaauucucgacgugccaccuggagucgagaaauuucaacugcacgacuguacccagguggaaaaggcugauacaacuaucugccuuaaauggaagaauauagagaccuucacgugugacacccagaacaucacauaucgcuuucagugcggcaauaugauuuucgauaacaaggaaaucaaacuggagaauuuggaacccgagcaugaguacaagugugacucugaaauucucuauaacaaucacaaauucacuaacgccucaaagaucauaaaaaccgauuuuggcaguccaggggagccccaaauuaucuucugccgaagcgaagcagcccaucagggagugauuacauggaauccuccacagcguuccuuucacaacuucacucuguguuacaucaaggagaccgaaaaagacugcuuaaaucuggauaagaaccucaucaaguacgaccuucagaaccugaaaccguauacgaaguacgucuugucucuacacgcuuauauuauagcgaaaguucaaagaaaugguucggcagccaugugccauuuuacaaccaagagcgcucccccuucccagguguggaacaugacuguaucaaugacaagugauaauucuaugcacgugaaauguaggccaccccgggaccgcaacggcccucaugagagauaccaccuggaggucgaagccgggaauacccucgugaggaacgagagccauaagaauugcgauuuccggguuaaggaccugcaguauuccacugacuacaccuuuaaagcauauuuccacaacggagauuacccaggcgaacccuuuauccuucaccauucaacaagcuacaauucuaaggcccugauugcuuucuuggccuuucucaucauagugacguccauugcacuguuagucgugcuguauaaaaucuacgaccuacacaagaaacgcaguuguaaccucgaugagcaacaggaacugguagagcgagacgaugagaagcagcuuaugaauguugaaccgauccaugcggacauuuugcuggagaccuauaagagaaaaaucgcugaugaagguaggcuuuuccuggccgaguuucagagcauuccucggguguucucuaaguucccaauaaaagaggcacguaagcccuuuaaccaaaauaaaaaccgcuacgucgacauccuuccuuaugauuacaauagaguggaacuguccgagauuaacggggacgccggaucaaacuauaucaaugcuaguuacaucgauggcuucaaggaacccaggaaguacauugccgcacagggcccacgggacgagacugucgaugacuuuuggcgaaugauaugggaacagaaagcuacagugaucguuauggugacccgcugcgaggaggggaacagaaauaagugugccgaauauuggccuagcauggaggaaggaacaagggcguucggugacguagucgugaaaauuaaccagcacaagcggugccccgauuacaucauucaaaaauugaauaucguuaacaagaaagagaaggccacuggccgcgaagugacccacauacaguuuacgucguggccagaccauggggucccggaggauccucaccuccuguuaaagcugagaaggcgugugaaugcuuucuccaacuuuuucucuggacccaucguagugcauuguagcgcaggcguuggucggacagggaccuauauuggcaucgacgccaugcuagagggacucgaagcugagaauaaagucgauguguacggcuauguggucaagcugcgaagacagaggugccuuaugguucagguggaagcccaauacauuuugauccaccaggcacugguggaguauaaccaguuuggggaaacugagguaaaucucucagagcugcauccauacuuacacaacaugaaaaagcgcgaucccccuagugaaccaucaccccuggaggcggaguuccagcggcuuccuucuuacagaagcuggaggacccaacacauaggaaaucaggaagagaacaaauccaagaaucgcaacucaaacgucauuccguaugacuacaaucgagugccauugaagcaugaacucgagaugagcaaagaaagugagcacgacucugaugaauccagcgacgaugacucggauucagaggagcccucuaaguauaucaacgccaguuuuauuauguccuacuggaaaccugaaguuaugaucgcugcccaggguccacugaaggagacaauaggcgacuucuggcaaaugaucuuucagcggaaagugaaggucauugugaugcuaacugaacugaagcauggggaccaggagaucugugcacaguauuggggagaaggcaaacaaaccuacggugauauugagguugaccucaaggauacagacaaaagcucuacguauacccugcguguguucgagcuuagacacagcaagaggaaagauucccgcacuguauaccaguaccaguauacaaauuggucagucgaacaguugcccgcugagccuaaggaacugaucaguaugauacaaguggugaagcagaaauuaccgcagaagaacagcucugaggggaauaaacaucacaaguccacuccccuccugauucacugccgggacggcucacagcaaaccggaaucuucugugcccuucugaacuugcucgaaagugcagagacagaggaagucguugauaucuuucaggugguaaaagcccugagaaaggcuaggccaggcauggugagcaccuucgagcaguaccaauuucuauaugacgucauugcguccacguacccugcccagaauggacaggugaaaaagaacaaucaucaggaagauaagaucgaguucgacaacgagguugauaaagugaagcaagacgcaaauugcgucaacccccugggggcuccagaaaaacucccugaggccaaggaacaggccgaggguucugaacccacuucgggcaccgaggggccagagcacagcgugaauggaccggcuuccccugcacugaaccagggcuccuga

SEQ ID NO: 997 - RNA, 765 nt, Artificial Sequence
  P08637
auguggcagcugcuccuucccaccgcccuguuguuacuggugagcgcuggcaugagaacagaggaccuaccuaaggcagucguuuuccucgaaccacaaugguacagggugcuggagaaagauuccguaacucuuaagugccagggggccuauucuccggaagacaacucaacgcagugguuucacaaugagagucugaucagcucccaggcgucuucguacuucauugaugcugccaccguggacgauucaggagaauaucggugucaaacaaacuugagcacucucagugaccccguccagcuggaggugcauauagguuggcugcucuuacaggcaccucgcuggguuuuuaaagaggaagauccaauccaucugcgaugccacuccuggaagaauaccgcccuucacaaagugacauacuugcagaacggcaaggggcguaaguauuuccaucacaauucugacuuuuacauucccaaagcuacccugaaggauagcggauccuauuucuguagaggccuauuugguaguaaaaacgucucaagcgagacugugaauaucacaauuacccaagggcucgcaguaucuacgaucuccucauucuuuccuccaggauaccagguuagcuucugccuggugaugguccuucuguuugccguggacacuggcuuguacuucagugugaagaccaacauaaggucuuccacacgggauuggaaagaccacaaguuuaaguggcgcaaagauccccaggacaaguga

SEQ ID NO: 998 - RNA, 663 nt, Artificial Sequence
  P10747
augcugagacuccuucuggccuugaacuuauuccccagcauccaggugaccggcaauaagauucuggucaaacaauccccuaugcuaguugcuuacgacaacgcagugaaucucucuugcaaguauucauacaaccuguuuaguagggaguuccgggccagccuucacaaagggcuggauuccgcgguagaggugugugucguguauggaaauuacucucagcaguugcagguuuauucgaagacagguuuuaacugcgacggcaaacucgggaaugagucagugacuuucuaccugcaaaaccuguaugucaaucagacggauauauacuuuuguaagaucgaagugauguacccaccgcccuaucucgacaacgaaaagagcaauggaaccauuauccauguaaaaggcaagcacuuaugcccuaguccacuguuccccgguccuuccaaaccauuuuggguucuuguggucgucgggggaguguuggcuuguuacucucugcuagugacaguugccuucauuaucuuuugggugcgcagcaagcgaucccgucuccugcauucagauuauaugaacaugacucccagaaggccuggcccaacccggaaacacuaccagccguaugcacccccucgcgacuucgccgcuuacagaaguuga

SEQ ID NO: 999 - RNA, 681 nt, Artificial Sequence
  P11912
augcccggcgggccuggagugcugcaggcccucccagcuaccaucuuccuucuguuuuuguuaagcgcagucuaccuggguccgggcugccaagcccuauggaugcacaagguucccgcgucccucauggugucucugggggaggacgcucauuuccaguguccucacaacucaaguaauaacgccaauguaacaugguggagagugcuucauggaaacuauacuuggccacccgaauuucugggcccuggugaggauccaaaugggacguugauuauacagaacgucaauaaaagccacggaggcaucuacgugugcaggguucaggaaggcaacgaguccuaucaacagucuugugggaccuaccuccgggugcgccagcccccuccacgaccguuccuggacaugggagaagguacaaagaaucguauuaucacugcagagggcauuauccugcucuuuugcgccgucgugcccgggaccuuacugcuuuucagaaaaagguggcagaacgagaaguugggacuggaugcuggcgacgaauaugaggaugaaaaucuauacgagggucucaaccuggacgauuguucgauguaugaggacauaucacgggggcuucaaggaacauaccaggauguaggcagccugaauaucggcgacguucaguuggaaaaaccuuga

SEQ ID NO: 1000 - RNA, 1671 nt, Artificial Sequence
  P15391
augcccccuccaagacuccucuucuuucuucuguucuugaccccgauggaggugaggcccgaggaaccuuuagucguuaagguggaagagggcgacaacgccguacugcagugccuaaaagggacaagcgauggaccaacucaacagcucacguggucccgggaaucuccccugaagccuuuucuuaaacugucauugggucucccaggccuggggauccacaugcgcccccuggcuauuuggcuguucauauuuaaugugagucagcagaugggaggcuucuacuuaugucaaccugguccaccgagcgagaaggcauggcagcccggguggaccgucaacguggagggauccggcgaacuguuucgauggaauguuucugaccuuggcggguugggaugcggucugaaaaaccguucgucagagggcccuagcaguccauccgggaagcuaaugucucccaagcucuaugugugggccaaagauagaccugaaaucugggagggagagccacccugucugccgccuagggacagccuuaaucagucccugucacaggauuugacaauggcgcccggcaguacucucuggcugagcugcggugucccaccugacucugugucccgggggcccuuaucauggacccauguacacccaaagggacccaaaagccugcucagucuugaacugaaggaugaccgcccugcuagagauauguggguuauggagacaggcuugcuacugccaagggccaccgcacaagacgccggcaaauacuauugucaucgggggaaccucacuaugucuuuccaccuggaaauuacagcucgcccggugcuuuggcauuggcuguugcgaaccggagguuggaaggucuccgcagugacgcucgccuaccugaucuuuugcuuauguagccuggugggcauucuacaccuccagagagcucugguccuuaggcggaagcguaaacgcaugacugaucccaccagaagguucuuuaagguuacaccuccacccgggucgggaccucagaaucaguauggcaacguguugucucugccaacucccaccuccggucucgggcgggcccaacgaugggcggcaggccugggaggcacagccccgucauacgggaauccuaguagcgacguacaggcugauggagcccuugguucccgcucuccacccggcguggggccugaggaagaggagggagaaggcuaugaggaacccgacagcgaggaagacucagaguucuacgagaacgauaguaaucugggucaggaccaauugucccaggaugggagcggcuacgaaaacccagaggacgaaccucucggacccgaggaugaagacucuuuuucaaaugcagagaguuaugagaacgaagaugaggaacugacccagccagucgcuagaacgauggacuucuuaagcccgcacggcuccgccugggauccuucuagggaggcgacuucgcuggggagccaguccuacgaggacaugcggggaauccuauaugccgcaccccaacuccgcucaauaagaggucagccaggccccaaucaugaagaggaugcugacaguuacgaaaacauggacaacccugaugggccagaccccgccuggggaggcggugggaggaugggcacauggucuacccguuga

SEQ ID NO: 1001 - RNA, 672 nt, Artificial Sequence
  P16410
auggccugccugggcuuccagagacacaaggcucaacucaaccuugcaaccaggacauggcccuguacucuguuguuuuucuuacuguuuaucccuguguucugcaaagccaugcaugucgcgcagccagcuguugugcuagccagcucccgggggauugcaucuuuuguaugugaguacgccucaccgggaaaggcuacggaagugcgcgucaccgugcuccgacaggcagacagucagguuacagaggugugcgccgcuacuuauaugauggguaaugaacugaccuuccuugaugacagcauauguacaggcaccuccucugggaaccaagucaaucugacuauccagggauugcgugccauggauacaggccucuacauuugcaaaguggagcugauguaucccccuccauacuaucuggguaucgggaacggaacccagauuuacguaaucgaccccgaaccuuguccagauucggacuuucucuuauggauacuggcggcaguuucaagcggccuuuucuuuuauaguuucuugcugacggccgugucccuaucuaagaugcucaaaaagagaagcccccugacuaccggcgucuacgugaagaugccuccaacagagccggagugcgaaaaacaguuucaacccuacuucaucccuauuaauuga

SEQ ID NO: 1002 - RNA, 1419 nt, Artificial Sequence
  P16671
augggcugcgacagaaacugugggcugaucgccggagcugugauuggugcaguccucgccguuuucggcgggauacuuaugcccgugggagaucuguugauccagaagaccauuaaaaagcaaguaguguuagaggaaggcacaaucgcguuuaaaaauugggucaagacugguacggagguguacaggcaguucuggauuuuugacguucagaacccucaggaagugaugaugaauagcuccaacauccaagucaaacagcgggggccauauaccuaccgcgugcgauuccuggcuaaggagaauguaacacaggaugccgaagacaacacuguuucuuuucuacagccgaauggagcaauauucgagcccucacucagugugggcaccgaggccgauaacuuuacaguccugaaucuugcuguggcagccgcuagccacaucuaucaaaaccaguucgugcagaugauucugaauaguuugaucaacaagucuaaaucgucaauguuucagguccguacccucagagaacugcuguggggcuacagggacccuuuccucagcuuaguuccauaucccgugacuacaaccguagggcuguuuuacccuuauaauaacacggccgauggaguguacaaggucuucaaugguaaagacaacauuaguaagguggcgaucauagauacuuacaaaggcaagcggaaccuuuccuauugggagucucauugcgacaugauuaaugggaccgaugcagccagcuuuccacccuucguugaaaagucccaaguguugcaguucuuuucaagugacaucugucgcagcauuuacgcugucuucgagucugaugugaaccugaaaggaaucccuguauauagauuuguucuaccauccaaggccuucgcaucaccgguggagaaucccgacaacuacugcuuuuguacagagaaaaucauuagcaagaauugcacuuccuauggcguccucgacauaucuaaauguaaggaggguaggccuguguacaucucccugccacacuuccuuuaugcuagccccgaugucucggaaccuauugacgggcugaacccaaaugaggaagaacaucggaccuacuuggauaucgagcccauaacaggauuuacccuccaguucgccaaacgccugcaagugaacuuacugguuaagccgucugaaaagauucaggugcucaaaaaucuuaagcgaaacuacaucguaccuauccugugguugaaugagacgggcacuauuggcgacgaaaaagcgaacauguuuagaucccaggucacagggaagaucaaucuacugggacucauugagaugauacugcuuucaguggguguugugauguucgucgccuuuaugaucaguuauugcgcauguaggagcaaaaccauuaaguga

SEQ ID NO: 1003 - RNA, 651 nt, Artificial Sequence
  P26718
augggcuggaucagagggaggcggagccgccacuccugggagaugucugaguuccauaacuacaaucuggaccucaagaaaucagauuuuaguacccgauggcagaagcaacguugccccguggucaaaagcaaguguagagaaaacgccuccccuuucuuuuucugcuguuuuauugcuguugcaaugggaauaagguucaucauuaugguggccaucuggucugcgguauuucuuaauucgcuguucaaccaggaagugcagauuccauugacagagucauauugcgguccgugucccaaaaauuggaucugcuacaagaacaauuguuaucaguuuuucgacgaaagcaagaacugguacgagagucaggcuuccugcaugucucaaaaugccagcuuacugaaagucuauuccaaggaggaucaggaccuacucaaacuggugaagucauaccacuggaugggccuuguucauauaccuacuaacgggaguuggcagugggaagauggaagcauccugucuccaaauuugcucacgauuaucgagaugcaaaaaggcgacugugcacuguaugccuccucauuuaaggguuacauugaaaacugcagcacccccaauacauacaucuguaugcagcggacuguguga

SEQ ID NO: 1004 - RNA, 261 nt, Artificial Sequence
  P30273
augauccccgccgugguccugcuccuucuguuguuaguugagcaggcugcagcccugggcgaaccucaacuaugcuacauucucgacgcgauacuguuccuuuaugggaucgugcugaccuugcucuacuguagacugaagauucagguaaggaaagcugccaucacaagcuaugagaaguccgauggaguguacacuggucugucuacgcggaaccaggaaaccuaugagacacucaaacacgaaaagccaccgcaguag

SEQ ID NO: 1005 - RNA, 1137 nt, Artificial Sequence
  P32248
auggaccugggcaagcccaugaaaagcgugcucgucguugcccuucuggugaucuuccagguaugcuugugucaagaugaggugaccgacgauuacauuggggacaacacaacugucgauuauacguuauuugaaucccugugcucuaagaaagacgugagaaauuucaaggcuugguuucuaccuauaauguacucaaucauuuguuucguuggacuccuggguaacggccuugugguccugaccuauaucuacuuuaaaagguugaagacaaugacugauaccuaucuccugaaucuggcaguggccgacauucucuucuuacugacacuuccauuuugggcguacagugcugccaagagcuggguauucgggguucacuuuugcaaauugaucuucgcaauauauaagauguccuuuuucucuggaaugcugcuacuccuguguaucucgauugaucgguacguggccaucguccaggcugugucagcacaucgccaccgagcccgugugcuucugauuagcaaauugaguugcgucggcaucuggauacucgcuaccguucuguccauuccggaguuacuguacucugaccuccagagaagcuccucagaacaggccaugagguguagucuuaucacugagcauguggaagcguuuauuacaauccaaguagcacagauggugaucgguuuccugguccccuugcuagccaugagcuucugcuaucuggugauuauacggacccuccugcaggcucgcaacuuugagagaaauaaggccaucaaaguuauuaucgcaguggucgugguauucauaguuuuucagcuuccuuacaacggggugguccuggcucaaacgguggccaauuucaacauuacuucuuccaccugugaguugucaaagcagcucaauaucgcguaugaugucacauacagccuggccugcgugagguguugcguuaacccauuuuuauaugcauucaucggagugaaguuucggaaugaccuguucaaacuauuuaaggaucucggcugccugagucaggaacagcuucgccaauggucuuccugucgacacauuagaaggagcucgaugucuguagaggcugaaacuaccacaaccuucucccccuga

SEQ ID NO: 1006 - RNA, 690 nt, Artificial Sequence
  P40259
auggccagacuggcucucagccccgugccuucccacuggauggucgcacuucuguuguuacugucugccgagccaguuccggcggcuaggucagaagaccgguaccgcaaccccaagggcagugccugcagccgaaucuggcaguccccucguuucauugcaagaaaaaggggguuuaccgugaagaugcauuguuauaugaacucugccucgggaaauguaucauggcuauggaaacaagagauggaugaaaauccacagcagcucaagcuggagaaaggucggauggaagagagccagaacgagagucuugcuacacugacuauacaaggcauccgcuucgaagacaaugggauuuacuuuugccagcagaaguguaacaauacguccgagguguaucagggaugcggcaccgaauugagagucauggguuucucuacacucgcacaacugaagcagaggaacacucugaaagaugggaucauuaugauccagacccucuuaauaauccuguuuauuaucgugcccauuuuccuuuugcuggacaaggaugacagcaaagccggaauggaggaggaucacacauacgaaggccuagacaucgaucagaccgcuacuuaugaggacauaguuacacuccggaccggcgaagugaagugguccgucggggagcauccuggacaagaauga

SEQ ID NO: 1007 - RNA, 990 nt, Artificial Sequence
  P42081
auggacccccagugcaccaugggccugagcaacauccucuucgugauggccuuucuucuguccggggcugcaccuuugaagauucaagccuacuucaaugagacagcggauuuaccaugucaguuugcuaacucucagaaucagucacugagugagcuagucguuuucuggcaagaccaggaaaaccucgugcugaaugaaguauaucuuggaaaagagaaguuugauagcgugcacuccaaauacauggguagaacuucuuucgacucggauucauggacgcugagguugcauaaccuccagauaaaggacaaaggccuguaucagugcaucauucaccauaagaagccgaccgggaugauccggauucaccaaaugaauagcgaacugaguguccucgccaacuuuucccagcccgagaucgugccuauaucuaauaucacagagaacguuuacauuaauuuaacuuguagcuccauccauggauauccagaacccaaaaagaugucagugcugcuucgcaccaaaaacaguacaauugaguacgauggcgucaugcagaagagucaggacaaugugaccgaauuguaugauguaucuaucucccugucaguuagcuucccugacgugacuagcaacaugacaauauuuugcauucuagagaccgauaaaacgcgacuccugucuuccccauucagcaucgagcuugaagacccccaaccuccaccggaucacauucccuggaucacugcaguccugccuaccgugaucauuugugugauggucuuuugcuugauacucuggaaguggaagaaaaagaaacguccaagaaauucguacaagugugguacaaacacuauggagagggaagagucugaacagaccaaaaagcgggagaaaauccacauucccgagcgcuccgacgaagcccagagaguuuucaagucaaguaagacaagcuccugcgacaaaucugauaccuguuuuuga

SEQ ID NO: 1008 - RNA, 1011 nt, Artificial Sequence
  Q15762
auggacuaccccacccugcuccuugcccuguugcacguguauagagcuuuaugcgaggaaguccuguggcauacaagcguuccuuucgcagagaacaugucccuagaauguguguacccaucuaugggcauccucacucagguagagugguuuaagauugggacgcaacaggauucaauagccaucuucaguccgacccacggaauggugauuaggaaacccuaugcggaacgggucuacuuucugaauagcacaauggcuuccaacaauaugacucuuuucuuucgcaacgccucugaggacgauguggguuauuacucgugcucacuguauaccuacccucagggcacauggcagaagguuauccaagugguccagagcgacaguuucgaggcagccgugccauccaauucucauauuguaagcgaacccgggaaaaacguuaccuugacuugucagccucagaugacauggccagugcaagcuguccgaugggagaagauccagccccgucagauagaucuccugaccuacugcaaucuggugcacggaagaaacuuuacguccaaauucccuaggcagaucgugucaaauuguagucauggccgguggagcgucauuguuaucccagacgugacuguaucugauuccggucucuaucgcugcuacuuacaagcaucagccggggaaaacgagaccuuugugaugagacugacagucgcugagggaaagacugacaaucaguauacccuuuucguggccggcggcacaguuuugcugcuacucuuugugauuagcaucaccacgauaauugucaucuuccugaacaggcggcgccgaagagaaaggcgggaucuuuuuacugagaguugggacacacagaaggcgccgaauaacuaccguucucccauuuccaccagccaaccuacuaaucagucgauggaugacacacgcgaagauaucuaugugaacuacccaaccuucucuagaaggcccaaaacgcggguauga

SEQ ID NO: 1009 - RNA, 13482 nt, Artificial Sequence
  Q685J3
augccccgaccuggaaccauggcccugugccuccuuacucugguguuguccuuacugcccccgcaggcugcagccgaacaagaccuauccgucaacagggcgguuugggaugggggagguuguaucucucagggcgacgugcucaaucggcagugccagcaacugucacagcacguacgcacugggagugcugccaacacggcaaccggaacuacuagcaccaauguggucgaaccccgaauguaccuuuccuguucuacuaacccugagaugaccucgauugaaucaagcgugacaagugauacuccaggcguuuccucuacccguaugacgcccacugagagcagaaccacuuccgaaucaacaagugacagcaccacucuguucccuucuuccaccgaggauacgucaagcccaacuacucccgaggguaccgacgugccuaugaguacuccaucugaagaguccaucagcucgaccauggccuuugucucuaccgcuccguugcccuccuucgaagcauauacgucacucaccuacaagguggauaugaguaccccucugacuaccagcacccaggccuccucuagcccaacuacccccgagucaaccaccaucccuaaaaguacuaauuccgaggggagcacgccacugaccucuaugcccgcuucaaccaugaagguagccaguagcgaagcgauuacucucuuaaccacaccgguugagaucuccaccccugugacuauuucugcacaggccucgagcucccccacaacggcugaaggaccaucacugaguaacucugccccuagcggcggcuccacaccccuuacuaggaugccauugucagucaugcugguggugagcucugaggcauccacacuaaguaccacacccgcugccacuaauaucccugucauaaccagcacggaagcgucuuccucaccaaccacagccgaggggacaaguaucccgaccagcacauauacugagggaucgacaccccucacguccacuccugcaucuaccaugccaguugcuacuagcgaaaugucaacacugaguauuacccccguggacacuuccacccuuguaacaacgucuaccgagccuagcucccugccaacuacagccgaagcuaccucaauguugacaagcacucucagugaggguucuacaccccugacgaacaugccgguguccacaaucuuagucgccagcucggaagcaucaaccacuucuaccauuccuguggauaguaaaacauuuguuacuaccgccuccgaggcuagcucuagcccaacaacggcggaggacaccuccaucgcaacuucaacacccagugaaggcagcaccccucugacuucuaugcccguguccacaaccccagucgccucaagugaggcuagcaaucucuccacgacuccuguggauucuaagacccaaguaacaaccucgacugaagccagcucaagucccccaacagcagagguuaacagcaugccgaccucuacaccuagcgaaggguccacuccccuuaccucaaugucugugagcacgaugccagucgccaguuccgaggcuagcacacugucuaccacucccguggacaccucaacaccugucacuaccuccagugaggccagcucgucuuccacgacaccagaaggaaccagcauacccacuucaacaccuagugagggcucuaccccguugacuaauaugccaguguccacacggcuaguugugagcucagaagcaaguaccacgagcacuacccccgcggauuccaacacauucguaaccacaucuagcgaggcuuccucaucuaguacuaccgccgaggguacgucgaugccuacaagcacuuacuccgaacgcgggaccacaauuaccucuaugucagucagcacuacccugguggcauccagugaggccucuacacucagcacgacuccaguugacucaaauacccccgugacaaccuccacugaagcuacaaguagcucuaccacggccgagggaacuuccaugccuacaucaaccuauaccgaaggcagcacuccgcugacaucgaugcccgucaacaccacacuuguggcaucuagugaggcuuccacucugagcacgaccccaguagacacaucaacuccugugaccacauccaccgaggccucuagcagucccacuacggcggauggcgccuccaugccaaccagcacaccuucugaagggucaacucccuugaccaguaugccaguuuccaaaacacuccugaccagcucugaggcuucgacuuuaucaacaacgccgcuggacaccagcacucauaucacaaccuccaccgaagcaaguugcucuccuacaacuacggagggaaccagcaugcccauuuccacaccaucagaagguaguccccuacucacuucuaucccugucagcaucaccccagugacaucccccgaggccucaacccugagcacuacgccuguggauucuaauuccccggucacaaccaguacugagguuagcucguccccaacccccgcugaaggcacaucuaugccuacuucaaccuacagcgaggggagaacaccccuuacgaguaugccaguguccaccacuuugguggccacaucugcaauuagcacccugucaacuacaccuguagacaccuccacgcccgucaccaacaguacagaagcgaggagcucuccaacuaccucagagggaacauccaugccuacuagcaccccgggcgaagguucuacaccccucaccaguaugccagauucgacuacgccugugguuuccagcgaggcccggacacugucagcuacccccguggacacuucuaccccagucacaacgagcaccgaggccacuuccaguccuacaaccgcagaagggacuucaauacccacaucuaccccgagcgagggcacaacuccacuuaccuccacgccugugagucacacccugguugcuaacagcgaagccuccacauugucuacuacccccguggauucaaauacaccacucacuaccagcacggaggcaucguccccaccuccgacagccgagggaaccaguaugcccacuucuacaccaagcgaaggcucaaccccucugacucgcaugcccguauccaccacaauggucgcuucuagugagacgagcaccuuauccacuacuccugcggacaccucaacuccagugacaaccuauagccaggccucuaguuccagcacgacagcagaugggaccucaaugcccacuucuaccuacuccgaaggaucgacaccucugacuagcgugccagucaguaccagacugguugugucuuccgaggcuagcacacucucaacgacucccguagacaccaguaucccggugacaaccuccacugaagccuccucuucaccuacaaccgccgaggguacgagcauuccaacuucucccccuagcgagggcaccacaccacuggcuaguaugcccgucucgaccacucuugugguuagcuccgaagcaaacacauugucaaccacaccgguggauucuaagacucaggucgccaccagcacggaggcgaguuccccucccccaacagcugaagugaccucaaugccuacuucuacccccggggagagaagcacaccacugacuuccaugcccguuaggcauacgccuguggccaguagcgaagcaucuacccucucaacauccccagucgacaccagcacuccgguaacaaccagugccgagacuucuuccucgcccacaaccgcugagggaacgagccugccuacuucaaccacauccgaaggcucuaccuuacugacaaguaucccagugagcacaacccuuguuacgucacccgaggcauccacauugcucacuaccccuguggacacaaaggguccagucgugaccagcaaugaaguaucuaguucccccacuccugccgaggggacgagcaugccgaccucaacauacucugaaggccggacuccacugaccucgauacccgugaacacaacccuagucgcgagcuccgcuauuaguauccugucuacuacaccuguugauaauucaacccccgugacgacuagcacagaggccuguuccaguccaaccacuucugagggaaccagcaugccuaacuccaaucccucagaaggcacaaccccacucacgagcaucccggugucuacaacuccugucguguccagugaggcaucaacccugagcgccacacccguugacacuucgaccccagggacaaccuccgcugaagccacuucuagucccacgaccgcagagggaauuagcaucccuacaucaacuccauccgaggguaaaacaccccuuaagucuauuccuguaagcaacacaccgguggcuaauagugaagccuccaccuugagcacuacaccagucgauucuaacucacccgugguuacguccaccgcggugagcaguucuccuacuccagccgagggcacaucaauagcaaucuccacccccagcgaagggucgaccgcucugacuucuauuccugucaguacaacgaccguggccuccagcgagaucaauucauuaucuacaacucccgcuguaaccagcacaccagucacuaccuauucccaggcaaguucaagcccgacgacagccgacggaaccuccaugcaaacuucuaccuacagugaaggcagcacaccucucacuucccugcccgugucaaccaugcuuguugugucuucggaggccaacacacugagcacgaccccaaucgauuccaaaacucaggucacagcuaguaccgaggcgucuagcucaacuacagcagaagguuccagcaugaccauuucuacgccuagugaggggucccccuugcucaccucaauaccagugagcacaacuccuguugccucucccgaggcuucgacccuguccacaacuccgguggacaguaauagcccagucaucaccucaacagaggugucuuccagcccuacgcccgccgaaggcaccaguaugccaacuucaacauauaccgagggacguacuccccuaaccuccauuacaguacgcacgaccccuguggcaagcucugccaucaguacucugagcacaaccccgguugauaacuccacuccagucacaaccucuacugaggcuagaucaagccccacaaccuccgaaggcacgucgaugccuaauucuacccccagugaggggacaacuccacucaccagcauuccugugucaacaacucccgugcuguccucugaagcgagcacccuuuccgccacgccaaucgacacaaguaccccugucacuacaucaaccgaggcaacuagcucuccgaccacagcugaaggaacguccauacccaccaguacuuugagcgagggcaugacaccacugaccucaacuccuguaucucacacauuaguggccaacuccgaggcaucgacccucagcacgacacccguugauaguaacuccccaguggucaccucuacugccgugucaagcuccccuacccccgcugaagguacaucuaucgccacuagcaccccgagugaggggucaacagcgcugacguccauuccaguuagcacuaccacaguggcaucuagugaaaccaauacucuuuccacaaccccugccgucacgagcacucccgugaccacauacgcucagguaucaucgucuccaaccacugccgacggaagcuccaugcccacaaguaccccuagggagggccggcccccacugacgucaaucccugugucuacaacuaccguugcuagcuccgagauuaacacacuaaguaccacucucgcagauacccgaacaccggucacuacguauagccaagccucuuccucacccaccacagcugacgguacuagcaugccaaccccugccuacucggaaggcuccacaccccugaccucuaugccauugaguacuacgcugguggugucaagcgaggcauccacauuaucuaccacuccugucgauaccagcacacccgcgaccacaaguacagaagggucauccagcccgaccacggccggaggcacaucuauccagacuuccaccccuagugagcgcacaaccccacucgcugggaugcccguuagcacuacgcuggugguaucaucugaaggaaauacccuuuccacaacuccuguggacagcaagacccaggucacaaacucgaccgaggccaguucuucagcaacugcugagggcuccagcaugacaauaucugccccaagcgaagguagcccccuguugaccaguauuccucucucaacgacuccaguggcaagccccgaggccuccacacugucuaccacuccgguugacaguaauucaccugugaucaccagcacagaagucuccucuucgcccauuccaaccgaggggacgagcaugcagacauccacuuauagugauagaaggacaccccuaacaucaaugccuguaucuacuaccgugguugcuagcuccgcgaucaguacacugucuaccacuccaguggacacgagcacccccgucacaaacucaacugaagcccgguccagcccuaccacaucugagggaaccucaaugccaacaaguacgccguccgagggcagcacacccuuuaccucgaugccugugucuacuaugccagucgugacauccgaagcaagcacccuuucagcuacucccguugauaccaguacaccugugacgaccucuacagaggccacuuccagcccaaccacagccgaagguacuucaauacccaccaguacgcucuccgagggcacaaccccgcugacuagcaucccuguaucucauaccuugguggcaaauucggaagucagcacacuguccacuaccccaguugacucaaacacacccuucacgaccucuacugaggcuaguagcccucccccaacagccgaggggaccuccaugccgacuucuacaucaagcgaaggaaauaccccuuuaacgcgcaugcccgugaguaccacaauggucgcguccuuugagacuucuacccucagcacaacuccagcugauaccuccacacccgugacgaccuacucacaagccggcaguagcccuacuacagcagacgauaccucuaugccaacuuccaccuacucggaagggagcacaccccugacgucaguaccugugaguacuaugccaguuguguccucugaggccagcacccacucaacaaccccggucgacacuuccacacccgugaccacgucuacugaggcuagcaguuccccuacaaccgcagaaggaaccagcauuccaacaucucccccuucagagggcacuaccccacuugccaguaugcccgucuccacaacuccugugguuagcucugaagcggguacccugucgacgacaccgguagauaccucaacucccaugacaaccagcacugaggcuuccaguucuccaaccacagccgaagacaucguggucccuauuagcacggcauccgaggggucaaccuugcucacaaguauccccgugagcacaaccccaguugccucuccugaggcuuccacucugagcacaacccccguggauucaaacucuccagucgugacguccacagaaauaaguagcucggccacuuccgcagagggaaccucuaugccgaccucaacauauagcgaaggcaguacuccucuaagauccaugcccguaucuaccaaaccacuggcuagcucagaggccaguacgcuuuccacaacucccguggacaccagcauuccuguuacaaccucuacugaaacauccucaagcccaaccacggcgaaggauacaaguaugcccaucucuaccccuucggaggucuccacaagccucaccucaauccuggugucuacuaugccgguggccaguagcgaggcauccacauugucaaccacgcccgucgacacuaggacauuaguuaccacaagcaccgguacuuccucuaguccaaccacagcugaaggcagcuccaugccuacuucuacgcccggggagcguucaaccccacugacaaauauucucgugucgacuacccugcuugccaacagcgaagcaaguacacuguccaccacuccuguagacacgucuacacccgugaccacuagcgcugaggccucauccaguccaaccacagccgaaggaaccucuaugcggaucagcacuccguccgauggcucaacaccuuugacgagcauucuagucucuacccugcccguggcgaguuccgaggcuagcacaguuucgacuaccgcaguggacacaucuauaccagucaccacuucaacggaggccuccagcaguccuaccacagcugaagugacuucuaugcccaccuccacaccaagcgagacuucaaccccucucacaaguaugcccguaaaucacaccccgguugccuccagcgaagcagggacgcugucuacuacaccaguggauaccucaacucccgucaccacaagcacgaaggccuccaguucuccuaccacugcugagggaaucguggugccaauuucgacagcgagcgagggcuccacccuuuuaacaucaauccccgucucuacuaccccuguugccaguagcgaagcauccacacugucaaccacuccgguggacacgucuauucccguaaccacaagcacugaggguuccaguagcccaaccacagcugaagggacgucuaugccuaucuccacccccucagaggugagcacuccacucacaaguauauuggucucgaccgugccuguugccggaucugaagcauccacucugagcacaacccccguggauacucgaaccccagucacaacgucagccgaggcuaguuccucuccuaccacagccgagggcacuagcaugcccaucucaaccccgggcgaaagaaggacaccucucacuuccaugagcgugucuaccaugccaguagcgaguuccgaggcaagcacgcugucacgcacacccgccgacaccucuacuccuguuaccacaucgacugaagcuaguagcuccccaaccacagccgaggggacgggcauucccaucucuaccccgucagaagguagcacuccucuuacauccauucccgugaguaccacuccagucgcaauccccgaggcuucuacacugagcaccacgccuguggauuccaacucaccaguugugaccagcacugaggucaguucuucccccacuccugccgaaggcaccucgaugccaauaagcacauacucagagggguccacuccguugaccggagugcccguaucuacgacaccugugaccaguagcgcuauuuccacucuaucaacaaccccagucgacacuucuacccccguuacaacgagcacugaagcccauaguuccccuaccacaagcgagggcaccucuaugccaacuucaacacccuccgaagguaguaccccgcugacguauaugccugugagcacuaugcucgucgugucuucggaggauuccacauuaucagcaaccccaguagacaccagcacacccgugacuaccaguacagaggcgacuucuuccaccacggccgaagggacaagcaucccuaccucaacucccucugagggaaugacaccacugaccagcguuccuguguccaauacucccgucgcuaguucagaagccagcauccuuuccacgaccccaguggauucuaacacaccgcugacuaccaguacagaggcaagcuccucgcccccuaccgcugagggcacuucuaugccaacaucaacccccagcgaaggcuccacgccucucacaaguaugccaguuucuacaaccaccgucgccagcucagagacauccacuuugagcaccacgcccgcagacacaaguacuccugugaccacauacucucaggccuccucaagcccgccaauugcggacgggaccucuaugcccacuucgacauauuccgaaggaaguaccccucugacgaacaugagcuucucaacuaccccagugguaucuuccgaggcuagcacacucaguaccacucccgucgauacauccaccccugugacgacuagcacagaagccucucugucacccaccacagcagaggguacaaguauaccaaccuccagcccgucugagggcaccacaccucuugccucaaugcccguuucgacuacgccaguggucagcuccgaagugaauacccuaaguacaacuccuguugacucuaacacccuggugacaaccagcacugaggcuuccucaucucccacgaucgccgaagggacuuccuugccaaccaguacuaccuccgagggaucaacaccguuaagcauuaugccucugucuaccacucccguagcauccagugaagcuagcacacucucgacgaccccagucgauacuucaacacccgugaccacaucuuccccuaccaauagcaguccaacuacggccgaggugaccuccaugcccacaucuacugcgggcgaggguagcaccccucugacaaacaugccgguuucaacuaccccagucgcuuccagugaagccagcacacuuucuacgacccccguggacucaaauacuuuuguaacauccagcucucaggcaaguucguccccugccacccuacaggugacuaccaugcggaugagcacacccucagaggggucuagcucccucacgaccauguugcugaguucaacuuacgucacaucuagcgaggcuuccaccccaaguacaccuagcguggauagaucuacucccguuaccacguccacacaaucaaacagcaccccaacuccuccggaggugaucacccuacccaugucgacaccauccgaagucucuacuccucugaccauuaugcccgugaguacaacgagcguuaccaucucagaggcaggaacugccuccacacucccaguggacaccucuacuccuguaauaacaagcacccaggucaguuccucacccgugacgccggagggcacuaccaugccaaucuggacacccagcgaaggcucuaccccucuuacuacaaugccaguuaguaccacaagggugacuuccagcgaggggucaacccugucuacgcccuccgucgugacaagcaccccuguaacuaccucgacagaagcgauuaguucuucagccacuuuagauuccaccacaaugagcgugaguaugcccauggagaucucuacguugggaaccacuauucuggucagcacaaccccaguuacucgcuucccugaguccucaacaccgagcauccccuccguguauaccucuaugaguaugacgaccgcuucagaagguagcuccucuccaacuacacucgagggcaccacaacuaugccuaugucgaccacgagcgaacgaaguacacugcuuacuaccgugcugauaucccccauuucagucaugucuccaagcgaggcauccacacucaguaccccucccggggacacuagcaccccguugcugacaucuacgaaagccggaucauuuuccaucccagcugaagugacuaccauccggauuagcaucacaucugagcguaguaccccuuuaacuacacuacugguuuccaccacgcuccccacuucauucccaggcgccagcauagcaucgacaccuccccuugauaccucuaccacauuuacuccguccaccgacacagcuagcacuccuacgauucccguagccaccacaaucagugugucagucauuaccgaggguuccacuccagggacaaccaucuucauacccucuacuccugugacgagcaguaccgcggauguuuucccagccacaacuggagcagugucaacccccgucauuacauccaccgaacugaauacuccuagcacaucuucgagcuccaccacgacaaguuuuucuacaaccaaggaguucaccacaccagcuaugacuacggccgcacccuugaccuacgugacaaugucaacugccccgagcaccccuagaacaaccuccaggggcugcacuacaucugcuaguacccugagcgccacgucaacuccacacaccuccacaagcguaacuacccgccccgugacaccuucuuccgaaaguucacggccaagcaccaucacgucucauacuauacccccuacauuuccacccgcgcacuccucgaccccgccuacuacaagcgcuaguucaaccacggucaacccagaggcaguuaccacaaugacuaccagaacaaaacccuccacuaggaccacaucuuucccuaccgugacuacgacagccguccccaccaauacuaccauuaagagcaacccaacaaguaccccgacugugccccgaacaacgaccuguuuuggcgacgggugccagaauacugcuucccgcuguaaaaacggagguacaugggauggccucaagugccaguguccuaaucuguacuauggggaacuuugcgaggagguugugucaagcaucgacauuggaccacccgaaaccauaucugcccaaauggagcucacaguaacugugaccuccgucaaauucacggaagaacugaagaaccacagcucucaggaauuucaggaguucaagcagaccuuuacagagcaaaugaauaucguguacaguggcauuccugaauauguuggugucaacaucacuaaauugcggcuggggucaguggugguagagcaugacgucuuacuaagaaccaaguacacaccagaauauaaaacugugcuggauaacgcaaccgagguugugaaggagaaaaucacgaaggucacaacccagcagauuaugauaaaugacaucugcuccgauaugauguguuucaacacuacaggaacccaagugcagaauauuacuguuacccaguacgaccccgaagaggauugcaggaagauggccaaagaauauggcgacuacuuuguggucgaguaccgugaucagaagccuuauuguaucagcccaugcgaaccgggcuucucggugucuaaaaacuguaaucucgggaagugccaaaugagucuuagcggaccccagugucugugcguaacaacggagacccacugguacuccggugagacuuguaaccagggcacacagaaaucauugguguaugggcugguuggagcuggcgucgugcucaugcugauuauccuuguggcguuacugaugcucgucuuucgcucuaagcgggaaguuaagagacaaaaauacagguugagccagcuguauaaguggcaggaggaagacuccgguccugccccagggaccuuccagaauauaggcuucgauaucugccaagacgaugacaguauucaucuagagucaaucuacagcaacuuucagcccucucugcgacacauugauccugaaacaaaaauccggauacagcgcccacaagugaugacuaccuccuucuga

SEQ ID NO: 1010 - RNA, 1215 nt, Artificial Sequence
  Q9NNX6
augagcgacuccaaggagcccagacugcagcaacucggccuucuggaagaggaacaguugaggggguuaggauuccggcagacccgcgguuacaaaucucuggccggcugccuagggcacggaccucucgugcugcagcuucugucauuuacauugcucgcuggccugcugguccaaguuaguaaggugccaagcuccaucucucaggagcagucgcgacaggaugcaauuuaucaaaaccucacucaguuaaaagccgcgguaggugaacugucagaaaagagcaaacuucaggagauauaccaggaauugacgcaacugaaggcugccgugggggagcuaccggaaaagaguaaacuccaggagaucuaucaggagcugacccgucuuaaggcagccgucggagaacugcccgagaaauccaaguugcaagaaauuuaccaggagcucacauggcugaaagcugcagugggcgaauuaccugagaagucuaagaugcaggagaucuaucaggaacugacuagacucaaagccgcuguuggcgagcuuccagaaaagagcaaacaacaggagauuuaccaggaacugaccagguugaaggccgcggugggggagcuacccgagaaauccaagcagcaagaaaucuaucaggagcugacacggcucaaagcagccgucggagaacugccugagaagucaaagcagcaggaaauauaccaagagcuuacccagcugaaagcugccguggagcgcuugugucauccaugccccugggaauggacuuucuuucaggguaauuguuacuucaugaguaacagccagagaaauuggcacgacucuaucacagcaugcaaggagguaggcgcucaacucguugugauuaaauccgccgaggagcagaacuuucugcaguuacaaucaagcaggaguaaucgguucaccuggauggggcugucugaucuaaaccaggagggaacguggcagugggucgacggcuccccucuccugccgagcuuuaagcaguauuggaaucgcggugaaccaaacaaugugggggaggaagauugugcggaguucucgggaaacggcuggaaugacgauaaaugcaaccuugccaaguuuuggaucuguaagaaaucugcagcuuccugcucacgagacgaggaacaauucuugagucccgccccugcuacuccaaaucccccuccagccuga

SEQ ID NO: 1011 - RNA, 3126 nt, Artificial Sequence
  Q9NR97
auggagaacauguuccugcagagcuccauguugaccugcaucuuucuucugauuucuggcucaugugaauugugcgccgaggaaaauuucaguagaagcuaccccugugacgagaagaaacaaaacgauuccgugauagcugaaugcucuaauaggcgguuacaggaggucccucagacaguugggaaguaugugacugagcuggaccuaucggauaacuuuaucacgcacauuaccaaugaaucauuccagggacuccaaaaccugacaaaaaucaaucuuaaccauaauccaaacguacagcaccagaaugguaacccgggcauucagagcaaugggcugaacaucacugacggagcauuuuugaaucucaagaaccugcgcgagcugcucuuagaagauaaccaacugccccagauaccuaguggccuuccagaguccuugaccgagcugucucuaauccagaauaacauuuacaauaucacaaaagaagguauuagccgacucaucaaccugaagaaucuuuaucuggccuggaacuguuacuucaauaaggugugcgagaaaaccaacauagaagacggggucuuugagacuuugacaaaucucgaacuguuaucccugucauucaacagucucagccaugugcccccuaaacuuccaucuucccugcguaaguuguuucuaucaaauacccagauuaaguauaucagcgaggaggauuucaaaggacugauuaaccucacgcugcuugaccugaguggcaauugucccagaugcuuuaacgcgccuuucccauguguuccgugcgauggcggggcuucuaucaauaucgacagguuugccuuccaaaacuugacucagcuccgguaccugaacuuauccagcaccucgcugcgcaagauuaaugcagccugguucaagaacaugccccaccuaaaagugcucgaucuggaauuuaauuaucuugucggagagauagcuucuggugcauucuugacaaugcugccuagacucgaaauccuggaccuuuccuuuaacuacauuaagggcucauacccacagcauaucaauauaaguaggaacuucagcaaacuguugucccuccgggcccugcacuuacgcggguauguguuucaagagcugcgagaagaugacuuccagccccuaaugcagcucccuaaucugucuacuauuaaccuuggaaucaauuuuaucaagcagauugacuucaaauuguuucaaaacuucagcaaucuggagaucauuuaccucucagagaacagaauaaguccacugguaaaggauaccaggcaguccuaugcuaauucuucuucauuucagcggcacauccguaaacgcagaaguacagacuucgaauuugauccccauagcaacuucuaccacuucaccaggccguuaauuaagccucagugugccgcguauggcaaggcacuggaccuuuccuugaauagcaucuuuuucaucggucccaaccaauuugagaaccucccagauauugccugccugaaucuaucggcuaacagcaaugcccagguucuguccgggacggaauuuucagcaauaccucaugugaaauaccucgaccugacuaacaaucggcuugauuuugacaacgcuagugccuugacagagcugucugauuuagaaguccucgaccugagcuauaauucccacuacuuccgaaucgcgggagugacccaccaucuugaguuuauucagaacuucacuaaucugaagguguugaaccucucacacaauaacaucuacacacugaccgauaaauauaaucuagagagcaagucucuggucgaacucguuuucuccggcaaccgccuggacauucuuuggaaugacgaugacaacagauacaucaguauauucaaaggcuugaagaaccugacgagguuagaucucagccugaaucggcuuaagcauauccccaacgaggccuuucugaaucuaccagcaucucucaccgaacugcacauuaacgacaauauguugaaauucuuuaacuggacacuguuacagcaauucccccgccucgagcugcuugaucugagagggaauaagcuccucuuccugacugacucccuaucagauuuuaccaguagccugaggacacuucuccugucgcauaaccguaucucccacuugccuucuggauuccugagcgaggugucaaguuuaaaacaccucgaccuguccucuaaucuucugaagacuauuaacaaaagcgcuuuggaaaccaagacaaccacuaagcucuccaugcuggagcuacaugguaauccauuugaaugcacgugugauaucggcgacuuccggcgauggauggaugagcaccugaacguaaaaauaccgagacuuguggacgucauuugcgccucacccggggaucagaggggaaagagcaucgugagucucgaacugacaaccuguguuucugacgugacugcugucauuuuguuuuucuuuaccuucuuuaucacaaccauggugauguuagccgcacuggcccaucaccucuucuauugggacguaugguuuauauacaauguuugccuggcuaaagugaagggcuaucgcucccuuagcacuucgcagacauucuacgaugcguauaucucauacgacacgaaagaugcaucugucaccgacugggugauuaacgagcugcgguaccacuuggaggaaaguagagauaagaauguccuacugugucucgaggaaagggacugggauccuggucuggccaucauugacaaccuuaugcaguccaucaaucaaagcaagaaaacuguguucguuuuaacaaagaaauaugcuaagucuuggaacuuuaaaaccgccuucuaccuggcacuccagcgcuugauggaugagaacauggacgugauaauuuuuauccugcucgaaccaguacugcagcauagccaauaucuucgacugcggcagcguaucugcaaguccucaauuuugcaguggcccgauaauccuaaagccgaggggcuauucuggcagacacugagaaacgucgugcucacugagaaugacaguagguacaacaauauguauguugauagcaucaagcaauacuga

SEQ ID NO: 1012 - RNA, 66 nt, Artificial Sequence
  P16671_TM_1_8-29
ggccugaucgccggggcugugauuggagcaguccucgccguuuucgguggcauacuuaugcccgug

SEQ ID NO: 1013 - RNA, 81 nt, Artificial Sequence
  P32248_TM_1_60-86
uuccugcccaucauguacagcauuauaugcuuugugggccuccuugggaacggacuggucguuuugaccuauaucuacuuc

SEQ ID NO: 1014 - RNA, 66 nt, Artificial Sequence
  P16671_TM_2_440-461
cugcucggccuuaucgagaugauucuguugagcgugggggucguuauguucguggccuuuaugaua

SEQ ID NO: 1015 - RNA, 63 nt, Artificial Sequence
  P32248_TM_2_96-116
uaccugcucaaccuugccguggcugacauccuguucuuguuaacccugcccuuuugggcauau

SEQ ID NO: 1016 - RNA, 66 nt, Artificial Sequence
  P32248_TM_3_131-152
cugaucuucgccauuuacaagaugagcuuuuucuccggcaugcuccuucuguugugcauaucuauc

SEQ ID NO: 1017 - RNA, 63 nt, Artificial Sequence
  P32248_TM_4_171-191
gugcugcucaucagcaagcuguccugcgucggcauuuggauacuugccaccguuuugucuauc

SEQ ID NO: 1018 - RNA, 84 nt, Artificial Sequence
  P32248_TM_5_220-247
uucaucaccauucagguggcccaaauggucauaggcuuucugguuccccuccuugcuaugagcuucugcuaccuggugaucauu

SEQ ID NO: 1019 - RNA, 78 nt, Artificial Sequence
  P32248_TM_6_264-289
gugaucauugccgucguugugguauucauaguguuucagcugcccuacaacggcgucgugcucgcucaaaccguugca

SEQ ID NO: 1020 - RNA, 54 nt, Artificial Sequence
  P32248_TM_7_314-331
cuggccugcgugagauguugcgucaaccccuuccucuacgcuuuuaucggcguu

SEQ ID NO: 1021 - RNA, 69 nt, Artificial Sequence
  A0A5B9_TM_145-167
accauccuguacgagauucuccuuggcaaggccacacuguaugcuguguuggucagcgcauuaguucug

SEQ ID NO: 1022 - RNA, 69 nt, Artificial Sequence
  B7Z8K6_TM_130-152
cugggccucagaaugcuuuucgccaagaccguggcugucaacuuucuguugacagcaaaauuauucuuu

SEQ ID NO: 1023 - RNA, 63 nt, Artificial Sequence
  O00206_TM_632-652
accaucauuggcgugagcguccuguccguucucgugguaucuguggucgccgugcuuguuuac

SEQ ID NO: 1024 - RNA, 66 nt, Artificial Sequence
  P01730_TM_397-418
auggcccugaucgugcucggcggggucgcuggacuucuguuguucauugguuuaggcauauuuuuc

SEQ ID NO: 1025 - RNA, 63 nt, Artificial Sequence
  P01850_TM_151-171
auccugcucggcaaggccacccuuuacgcugugcuggucagcgcauugguuuuaauggccaug

SEQ ID NO: 1026 - RNA, 78 nt, Artificial Sequence
  P07766_TM_127-152
gugaugagcgucgccaccaucguuauuguggacauaugcaucacaggcgggcugcuccuucugguauacuauuggucc

SEQ ID NO: 1027 - RNA, 66 nt, Artificial Sequence
  P08575_TM_576-597
gcccugaucgcuuuccucgcauuucuuauuauagugaccagcaucgcccuguuggucguuuuauac

SEQ ID NO: 1028 - RNA, 63 nt, Artificial Sequence
  P08637_TM_209-229
gugagcuucugccuggucaugguucuccuuuuugccguggacaccggccuguacuucuccgua

SEQ ID NO: 1029 - RNA, 81 nt, Artificial Sequence
  P10747_TM_153-179
uucugggugcuggucguugugggcgggguacucgccugcuacagccuucuggugaccgucgcuuuuaucauuuucugggug

SEQ ID NO: 1030 - RNA, 66 nt, Artificial Sequence
  P11912_TM_144-165
aucauuaccgccgagggcauaauccuccuguucugcgcugugguccccgggacacuucuguuguuu

SEQ ID NO: 1031 - RNA, 66 nt, Artificial Sequence
  P15391_TM_292-313
gugagcgccgucacccuggcuuaccucaucuucugccuuuguucccugguuggcauuuugcacuua

SEQ ID NO: 1032 - RNA, 63 nt, Artificial Sequence
  P16410_TM_162-182
uuccugcucuggauccuugccgcugugucuuccggccuguuuuucuacagcuuuuuguuaacc

SEQ ID NO: 1033 - RNA, 63 nt, Artificial Sequence
  P26718_TM_52-72
cccuucuuuuucugcuguuuuaucgccguggcuaugggcauuagauucauaaucauggucgca

SEQ ID NO: 1034 - RNA, 63 nt, Artificial Sequence
  P30273_TM_24-44
cugugcuacauccucgacgccauucuuuuccuguauggcauaguguugaccuuacuguacugu

SEQ ID NO: 1035 - RNA, 63 nt, Artificial Sequence
  P40259_TM_160-180
ggcaucauuaugauacagacccugcucaucauucuuuucaucauugugcccaucuuucuguug

SEQ ID NO: 1036 - RNA, 63 nt, Artificial Sequence
  P42081_TM_248-268
uggaucaccgccgugcugcccacagucauuauaugcguuaugguguucugucucauccuuugg

SEQ ID NO: 1037 - RNA, 63 nt, Artificial Sequence
  Q15762_TM_255-275
ggcgggaccgugcugcuccuucuguucgucauuagcauuacaacuauaaucguuaucuuuuug

SEQ ID NO: 1038 - RNA, 63 nt, Artificial Sequence
  Q685J3_TM_4394-4414
cuggugggcgccggggucguucucaugcuuaucauucugguggcuuuguuaaugcugguauuc

SEQ ID NO: 1039 - RNA, 63 nt, Artificial Sequence
  Q9NNX6_TM_38-58
cugggccacgggccccucgugcuucagcuguugagcuucaccuuacuggccggacuacucguc

SEQ ID NO: 1040 - RNA, 63 nt, Artificial Sequence
  Q9NR97_TM_828-848
gccgugauccuguucuuuuucaccuuuuucauuacaacuauggucaugcucgcugcacuugcc

SEQ ID NO: 1041 - RNA, 48 nt, Artificial Sequence
  P14207_1-16
augguguggaaguggaugccccugcugcugcugcuggugugcguggcc

SEQ ID NO: 1042 - RNA, 48 nt, Artificial Sequence
  O75787_1-16
auggccguguucguggugcugcuggcccugguggccggcgugcugggc

SEQ ID NO: 1043 - RNA, 48 nt, Artificial Sequence
  P07359_1-16
augccccugcugcugcugcugcugcugcugcccagcccccugcacccc

SEQ ID NO: 1044 - RNA, 48 nt, Artificial Sequence
  P08637_1-16
auguggcagcugcugcugcccaccgcccugcugcugcuggugagcgcc

SEQ ID NO: 1045 - RNA, 51 nt, Artificial Sequence
  P07237_1-17
augcugagaagagcccugcugugccuggccguggccgcccuggugagagcc

SEQ ID NO: 1046 - RNA, 51 nt, Artificial Sequence
  O60911_1-17
augaaccugagccuggugcuggccgccuucugccugggcaucgccagcgcc

SEQ ID NO: 1047 - RNA, 51 nt, Artificial Sequence
  P20138_1-17
augccccugcugcugcugcugccccugcugugggccggcgcccuggccaug

SEQ ID NO: 1048 - RNA, 51 nt, Artificial Sequence
  P27797_1-17
augcugcugagcgugccccugcugcugggccugcugggccuggccguggcc

SEQ ID NO: 1049 - RNA, 54 nt, Artificial Sequence
  P10747_1-18
augcugagacugcugcuggcccugaaccuguuccccagcauccaggugaccggc

SEQ ID NO: 1050 - RNA, 54 nt, Artificial Sequence
  O75487_1-18
auggccagauucggccugcccgcccugcugugcacccuggccgugcugagcgcc

SEQ ID NO: 1051 - RNA, 54 nt, Artificial Sequence
  P07996_1-18
augggccuggccuggggccugggcgugcuguuccugaugcacgugugcggcacc

SEQ ID NO: 1052 - RNA, 54 nt, Artificial Sequence
  P22748_1-18
augagaaugcugcuggcccugcuggcccugagcgccgccagacccagcgccagc

SEQ ID NO: 1053 - RNA, 54 nt, Artificial Sequence
  Q15762_1-18
auggacuaccccacccugcugcuggcccugcugcacguguacagagcccugugc

SEQ ID NO: 1054 - RNA, 54 nt, Artificial Sequence
  P30273_1-18
augauccccgccguggugcugcugcugcugcugcugguggagcaggccgccgcc

SEQ ID NO: 1055 - RNA, 54 nt, Artificial Sequence
  P38570_1-18
auguggcuguuccacacccugcugugcaucgccagccuggcccugcuggccgcc

SEQ ID NO: 1056 - RNA, 54 nt, Artificial Sequence
  Q01638_1-18
augggcuucuggauccuggccauccugaccauccugauguacagcaccgccgcc

SEQ ID NO: 1057 - RNA, 54 nt, Artificial Sequence
  Q9NZQ7_1-18
augagaaucuucgccguguucaucuucaugaccuacuggcaccugcugaacgcc

SEQ ID NO: 1058 - RNA, 57 nt, Artificial Sequence
  P13591_1-19
augcugcagaccaaggaccugaucuggacccuguucuuccugggcaccgccgugagc

SEQ ID NO: 1059 - RNA, 57 nt, Artificial Sequence
  P26842_1-19
auggccagaccccaccccugguggcugugcgugcugggcacccuggugggccugagc

SEQ ID NO: 1060 - RNA, 57 nt, Artificial Sequence
  P15391_1-19
augcccccccccagacugcuguucuuccugcuguuccugacccccauggaggugaga

SEQ ID NO: 1061 - RNA, 57 nt, Artificial Sequence
  Q8NI17_1-19
augauguggaccugggcccuguggaugcugcccagccugugcaaguucagccuggcc

SEQ ID NO: 1062 - RNA, 57 nt, Artificial Sequence
  P08571_1-19
auggagagagccagcugccugcugcugcugcugcugccccuggugcacgugagcgcc

SEQ ID NO: 1063 - RNA, 57 nt, Artificial Sequence
  P05154_1-19
augcagcuguuccugcugcugugccuggugcugcugagcccccagggcgccagccug

SEQ ID NO: 1064 - RNA, 57 nt, Artificial Sequence
  P02787_1-19
augagacuggccgugggcgcccugcuggugugcgccgugcugggccugugccuggcc

SEQ ID NO: 1065 - RNA, 57 nt, Artificial Sequence
  P02671_1-19
auguucagcaugagaaucgugugccuggugcugagcguggugggcaccgccuggacc

SEQ ID NO: 1066 - RNA, 57 nt, Artificial Sequence
  P04216_1-19
augaaccuggccaucagcaucgcccugcugcugaccgugcugcaggugagcagaggc

SEQ ID NO: 1067 - RNA, 57 nt, Artificial Sequence
  P00747_1-19
auggagcacaaggagguggugcugcugcugcugcuguuccugaagagcggccagggc

SEQ ID NO: 1068 - RNA, 57 nt, Artificial Sequence
  P01764_1-19
auggaguucggccugagcuggcuguuccugguggccauccugaagggcgugcagugc

SEQ ID NO: 1069 - RNA, 57 nt, Artificial Sequence
  P16150_1-19
auggccacccugcugcugcugcugggcgugcugguggugagccccgacgcccugggc

SEQ ID NO: 1070 - RNA, 57 nt, Artificial Sequence
  Q6DN72_1-19
augcugcuguggaccgccgugcugcuguucgugcccugcgugggcaagaccgugugg

SEQ ID NO: 1071 - RNA, 57 nt, Artificial Sequence
  Q01151_1-19
augagcagaggccugcagcugcugcugcugagcugcgccuacagccuggcccccgcc

SEQ ID NO: 1072 - RNA, 57 nt, Artificial Sequence
  P07093_1-19
augaacuggcaccugccccuguuccugcuggccagcgugacccugcccagcaucugc

SEQ ID NO: 1073 - RNA, 57 nt, Artificial Sequence
  Q8WWQ8_1-19
augaugcugcagcaccuggugaucuucugccugggccugguggugcagaacuucugc

SEQ ID NO: 1074 - RNA, 60 nt, Artificial Sequence
  Q13291_1-20
auggaccccaagggccugcugagccugaccuucgugcuguuccugagccuggccuucggc

SEQ ID NO: 1075 - RNA, 60 nt, Artificial Sequence
  P35225_1-20
auggcccugcugcugaccaccgugaucgcccugaccugccugggcggcuucgccagcccc

SEQ ID NO: 1076 - RNA, 60 nt, Artificial Sequence
  P25942_1-20
auggugagacugccccugcagugcgugcuguggggcugccugcugaccgccgugcacccc

SEQ ID NO: 1077 - RNA, 60 nt, Artificial Sequence
  P52803_1-20
augcugcacguggagaugcugacccugguguuccuggugcuguggaugugcguguucagc

SEQ ID NO: 1078 - RNA, 60 nt, Artificial Sequence
  Q15116_1-20
augcagaucccccaggcccccuggcccguggugugggccgugcugcagcugggcuggaga

SEQ ID NO: 1079 - RNA, 60 nt, Artificial Sequence
  P05556_1-20
augaaccugcagcccaucuucuggaucggccugaucagcagcgugugcugcguguucgcc

SEQ ID NO: 1080 - RNA, 60 nt, Artificial Sequence
  Q12891_1-20
augagagccggccccggccccaccgugacccuggcccuggugcuggccguggccugggcc

SEQ ID NO: 1081 - RNA, 60 nt, Artificial Sequence
  Q8IV16_1-20
augaaggcccugggcgccgugcugcuggcccugcugcugugcggcagacccggcagaggc

SEQ ID NO: 1082 - RNA, 60 nt, Artificial Sequence
  Q03167_1-20
augaccagccacuacgugaucgccaucuucgcccugaugagcagcugccuggccaccgcc

SEQ ID NO: 1083 - RNA, 60 nt, Artificial Sequence
  Q14246_1-20
augagaggcuucaaccugcugcuguucuggggcugcugcgugaugcacagcugggagggc

SEQ ID NO: 1084 - RNA, 60 nt, Artificial Sequence
  P16871_1-20
augaccauccugggcaccaccuucggcaugguguucagccugcugcagguggugagcggc

SEQ ID NO: 1085 - RNA, 60 nt, Artificial Sequence
  P61769_1-20
augagcagaagcguggcccuggccgugcuggcccugcugagccugagcggccuggaggcc

SEQ ID NO: 1086 - RNA, 60 nt, Artificial Sequence
  Q9Y6W8_1-20
augaagagcggccugugguacuucuuccuguucugccugagaaucaaggugcugaccggc

SEQ ID NO: 1087 - RNA, 63 nt, Artificial Sequence
  P10966_1-21
augagacccagacuguggcugcugcuggccgcccagcugaccgugcugcacggcaacagcgug

SEQ ID NO: 1088 - RNA, 63 nt, Artificial Sequence
  Q9BZW8_1-21
augcugggccagguggugacccugauccugcugcugcugcugaagguguaccagggcaagggc

SEQ ID NO: 1089 - RNA, 63 nt, Artificial Sequence
  P02778_1-21
augaaccagaccgccauccugaucugcugccugaucuuccugacccugagcggcauccagggc

SEQ ID NO: 1090 - RNA, 63 nt, Artificial Sequence
  P18564_1-21
augggcaucgagcugcugugccuguucuuccuguuccugggcagaaacgaccacgugcagggc

SEQ ID NO: 1091 - RNA, 63 nt, Artificial Sequence
  O14525_1-21
auggcccuggccggccugugcgcccugcuggccugcugcuggggccccgccgccgugcuggcc

SEQ ID NO: 1092 - RNA, 63 nt, Artificial Sequence
  P01130_1-21
augggccccuggggcuggaagcugagauggaccguggcccugcugcuggccgccgccggcacc

SEQ ID NO: 1093 - RNA, 63 nt, Artificial Sequence
  P01732_1-21
auggcccugcccgugaccgcccugcugcugccccuggcccugcugcugcacgccgccagaccc

SEQ ID NO: 1094 - RNA, 63 nt, Artificial Sequence
  P48061_1-21
augaacgccaagguggugguggugcuggugcuggugcugaccgcccugugccugagcgacggc

SEQ ID NO: 1095 - RNA, 63 nt, Artificial Sequence
  P01589_1-21
auggacagcuaccugcugauguggggccugcugaccuucaucauggugcccggcugccaggcc

SEQ ID NO: 1096 - RNA, 63 nt, Artificial Sequence
  Q86T13_1-21
augagacccgccuucgcccugugccugcuguggcaggcccuguggcccggccccggcggcggc

SEQ ID NO: 1097 - RNA, 63 nt, Artificial Sequence
  Q5DID0_1-21
augcugagaaccagcggccuggcccugcuggcccuggugagcgccgugggccccagccaggcc

SEQ ID NO: 1098 - RNA, 66 nt, Artificial Sequence
  P40189_1-22
augcugacccugcagaccuggcuggugcaggcccuguucaucuuccugaccaccgagagcaccggc

SEQ ID NO: 1099 - RNA, 66 nt, Artificial Sequence
  Q86YL7_1-22
auguggaaggugagcgcccugcuguucgugcugggcagcgccagccugugggugcuggccgagggc

SEQ ID NO: 1100 - RNA, 66 nt, Artificial Sequence
  P55075_1-22
augggcagccccagaagcgcccugagcugccugcugcugcaccugcuggugcugugccugcaggcc

SEQ ID NO: 1101 - RNA, 66 nt, Artificial Sequence
  Q30201_1-22
augggccccagagccagacccgcccugcugcugcugaugcugcugcagaccgccgugcugcagggc

SEQ ID NO: 1102 - RNA, 66 nt, Artificial Sequence
  P07766_1-22
augcagagcggcacccacuggagagugcugggccugugccugcugagcgugggcguguggggccag

SEQ ID NO: 1103 - RNA, 66 nt, Artificial Sequence
  P18827_1-22
augagaagagccgcccuguggcuguggcugugcgcccuggcccugagccugcagcccgcccugccc

SEQ ID NO: 1104 - RNA, 66 nt, Artificial Sequence
  P55290_1-22
augcagcccagaaccccccuggugcugugcgugcugcugagccaggugcugcugcugaccagcgcc

SEQ ID NO: 1105 - RNA, 66 nt, Artificial Sequence
  P37173_1-22
augggcagaggccugcugagaggccuguggccccugcacaucgugcuguggaccagaaucgccagc

SEQ ID NO: 1106 - RNA, 66 nt, Artificial Sequence
  Q07325_1-22
augaagaagagcggcgugcuguuccugcugggcaucauccugcuggugcugaucggcgugcagggc

SEQ ID NO: 1107 - RNA, 66 nt, Artificial Sequence
  P04156_1-22
auggccaaccugggcugcuggaugcuggugcuguucguggccaccuggagcgaccugggccugugc

SEQ ID NO: 1108 - RNA, 66 nt, Artificial Sequence
  P31785_1-22
augcugaagcccagccugcccuucaccagccugcuguuccugcagcugccccugcugggcgugggc

SEQ ID NO: 1109 - RNA, 69 nt, Artificial Sequence
  P01579_1-23
augaaguacaccagcuacauccuggccuuccagcugugcaucgugcugggcagccugggcugcuacugc

SEQ ID NO: 1110 - RNA, 69 nt, Artificial Sequence
  P23229_1-23
auggccgccgccggccagcugugccugcuguaccugagcgccggccugcugagcagacugggcgccgcc

SEQ ID NO: 1111 - RNA, 69 nt, Artificial Sequence
  O60494_1-23
augaugaacaugagccugcccuuccuguggagccugcugacccugcugaucuucgccgaggugaacggc

SEQ ID NO: 1112 - RNA, 69 nt, Artificial Sequence
  P08575_1-23
auguaccuguggcugaagcugcuggccuucggcuucgccuuccuggacaccgagguguucgugaccggc

SEQ ID NO: 1113 - RNA, 69 nt, Artificial Sequence
  Q8IWY4_1-23
augggcgccgccgccgugagauggcaccugugcgugcugcuggcccugggcaccagaggcagacuggcc

SEQ ID NO: 1114 - RNA, 69 nt, Artificial Sequence
  Q08431_1-23
augcccagacccagacugcuggccgcccugugcggcgcccugcugugcgcccccagccugcugguggcc

SEQ ID NO: 1115 - RNA, 69 nt, Artificial Sequence
  Q99665_1-23
auggcccacaccuucagaggcugcagccuggccuucauguucaucaucaccuggcugcugaucaaggcc

SEQ ID NO: 1116 - RNA, 69 nt, Artificial Sequence
  Q6Q8B3_1-23
augagcgcccccagacugcugaucagcaucaucaucauggugagcgccagcagcagcagcugcaugggc

SEQ ID NO: 1117 - RNA, 69 nt, Artificial Sequence
  Q07011_1-23
augggcaacagcugcuacaacaucguggccacccugcugcuggugcugaacuucgagagaaccagaagc

SEQ ID NO: 1118 - RNA, 69 nt, Artificial Sequence
  Q8NHL6_1-23
augacccccauccugaccgugcugaucugccugggccugagccugggccccagaacccacgugcaggcc

SEQ ID NO: 1119 - RNA, 69 nt, Artificial Sequence
  P36894_1-23
augccccagcuguacaucuacaucagacugcugggcgccuaccuguucaucaucagcagagugcagggc

SEQ ID NO: 1120 - RNA, 69 nt, Artificial Sequence
  Q16552_1-23
augacccccggcaagaccagccuggugagccugcugcugcugcugagccuggaggccaucgugaaggcc

SEQ ID NO: 1121 - RNA, 69 nt, Artificial Sequence
  P42081_1-23
auggacccccagugcaccaugggccugagcaacauccuguucgugauggccuuccugcugagcggcgcc

SEQ ID NO: 1122 - RNA, 69 nt, Artificial Sequence
  P43121_1-23
augggccugcccagacuggugugcgccuuccugcuggccgccugcugcugcugccccagaguggccggc

SEQ ID NO: 1123 - RNA, 69 nt, Artificial Sequence
  O00206_1-23
augaugagcgccagcagacuggccggcacccugauccccgccauggccuuccugagcugcgugagaccc

SEQ ID NO: 1124 - RNA, 69 nt, Artificial Sequence
  P42701_1-23
auggagccccuggugaccuggguggugccccugcuguuccuguuccugcugagcagacagggcgccgcc

SEQ ID NO: 1125 - RNA, 72 nt, Artificial Sequence
  P06729_1-24
augagcuuccccugcaaguucguggccagcuuccugcugaucuucaacgugagcagcaagggcgccgugagc

SEQ ID NO: 1126 - RNA, 72 nt, Artificial Sequence
  P15328_1-24
auggcccagagaaugaccacccagcugcugcugcugcugguguggguggccguggugggcgaggcccagacc

SEQ ID NO: 1127 - RNA, 72 nt, Artificial Sequence
  P05112_1-24
augggccugaccagccagcugcugcccccccuguucuuccugcuggccugcgccggcaacuucgugcacggc

SEQ ID NO: 1128 - RNA, 72 nt, Artificial Sequence
  P06127_1-24
augcccaugggcagccugcagccccuggccacccuguaccugcugggcaugcugguggccagcugccugggc

SEQ ID NO: 1129 - RNA, 72 nt, Artificial Sequence
  P32248_1-24
auggaccugggcaagcccaugaagagcgugcuggugguggcccugcuggugaucuuccaggugugccugugc

SEQ ID NO: 1130 - RNA, 72 nt, Artificial Sequence
  Q7Z7D3_1-24
auggccagccugggccagauccuguucuggagcaucaucagcaucaucaucauccuggccggcgccaucgcc

SEQ ID NO: 1131 - RNA, 72 nt, Artificial Sequence
  P54756_1-24
augagaggcagcggccccagaggcgccggcagaagaagaccccccagcggcggcggcgacacccccaucacc

SEQ ID NO: 1132 - RNA, 72 nt, Artificial Sequence
  Q92823_1-24
augcagcugaagaucaugcccaagaagaagagacugagcgccggcagagugccccugauccuguuccugugc

SEQ ID NO: 1133 - RNA, 72 nt, Artificial Sequence
  P19320_1-24
augcccggcaagaugguggugauccugggcgccagcaacauccuguggaucauguucgccgccagccaggcc

SEQ ID NO: 1134 - RNA, 72 nt, Artificial Sequence
  Q86UN2_1-24
augcugagaaagggcugcugcguggagcugcugcugcugcugguggccgccgagcugccccugggcggcggc

SEQ ID NO: 1135 - RNA, 75 nt, Artificial Sequence
  P33151_1-25
augcagagacugaugaugcugcuggccaccagcggcgccugccugggccugcuggccguggccgccguggccgcc

SEQ ID NO: 1136 - RNA, 75 nt, Artificial Sequence
  P17813_1-25
auggacagaggcacccugccccuggccguggcccugcugcuggccagcugcagccugagccccaccagccuggcc

SEQ ID NO: 1137 - RNA, 75 nt, Artificial Sequence
  P25445_1-25
augcugggcaucuggacccugcugccccuggugcugaccagcguggccagacugagcagcaagagcgugaacgcc

SEQ ID NO: 1138 - RNA, 75 nt, Artificial Sequence
  P01730_1-25
augaacagaggcgugcccuucagacaccugcugcuggugcugcagcuggcccugcugcccgccgccacccagggc

SEQ ID NO: 1139 - RNA, 75 nt, Artificial Sequence
  Q685J3_1-25
augcccagacccggcaccauggcccugugccugcugacccuggugcugagccugcugcccccccaggccgccgcc

SEQ ID NO: 1140 - RNA, 75 nt, Artificial Sequence
  P17787_1-25
auggccagaagaugcggccccguggcccugcugcugggcuucggccugcugagacugugcagcggcguguggggc

SEQ ID NO: 1141 - RNA, 75 nt, Artificial Sequence
  Q6UQ28_1-25
auggccguguuccacgacaugcugcugcagccccugggcauguuccugugccugagccugcagcugagcagcgcc

SEQ ID NO: 1142 - RNA, 75 nt, Artificial Sequence
  P13987_1-25
augggcauccagggcggcagcgugcuguucggccugcugcuggugcuggccguguucugccacagcggccacagc

SEQ ID NO: 1143 - RNA, 75 nt, Artificial Sequence
  P10721_1-25
augagaggcgccagaggcgccugggacuuccugugcgugcugcugcugcugcugagagugcagaccggcagcagc

SEQ ID NO: 1144 - RNA, 75 nt, Artificial Sequence
  P12319_1-25
auggcccccgccauggagagccccacccugcugugcguggcccugcuguucuucgcccccgacggcgugcuggcc

SEQ ID NO: 1145 - RNA, 78 nt, Artificial Sequence
  Q9BZR6_1-26
augaagagagccagcgccggcggcagcagacugcuggccugggugcuguggcugcaggccuggcagguggccgccccc

SEQ ID NO: 1146 - RNA, 78 nt, Artificial Sequence
  P25063_1-26
augggcagagccaugguggccagacugggccugggccugcugcugcuggcccugcugcugcccacccagaucuacagc

SEQ ID NO: 1147 - RNA, 78 nt, Artificial Sequence
  Q9NR97_1-26
auggagaacauguuccugcagagcagcaugcugaccugcaucuuccugcugaucagcggcagcugcgagcugugcgcc

SEQ ID NO: 1148 - RNA, 78 nt, Artificial Sequence
  Q8N131_1-26
augggccugggcgccagaggcgccugggccgcccugcugcugggcacccugcaggugcuggcccugcugggcgccgcc

SEQ ID NO: 1149 - RNA, 78 nt, Artificial Sequence
  P49771_1-26
augaccgugcuggcccccgccuggagccccaccaccuaccugcugcugcugcugcugcugagcagcggccugagcggc

SEQ ID NO: 1150 - RNA, 78 nt, Artificial Sequence
  P02679_1-26
augagcuggagccugcaccccagaaaccugauccuguacuucuacgcccugcuguuccugagcagcaccugcguggcc

SEQ ID NO: 1151 - RNA, 78 nt, Artificial Sequence
  P14784_1-26
auggccgcccccgcccugagcuggagacugccccugcugauccugcugcugccccuggccaccagcugggccagcgcc

SEQ ID NO: 1152 - RNA, 81 nt, Artificial Sequence
  P05362_1-27
auggcccccagcagccccagacccgcccugcccgcccugcuggugcugcugggcgcccuguuccccggccccggcaacgcc

SEQ ID NO: 1153 - RNA, 81 nt, Artificial Sequence
  Q13740_1-27
auggagagcaagggcgccagcagcugcagacugcuguucugccugcugaucagcgccaccguguucagacccggccugggc

SEQ ID NO: 1154 - RNA, 84 nt, Artificial Sequence
  Q13443_1-28
augggcagcggcgccagauuccccagcggcacccugagagugagauggcugcugcugcugggccuggugggccccgugcugggc

SEQ ID NO: 1155 - RNA, 84 nt, Artificial Sequence
  P14151_1-28
augaucuuccccuggaagugccagagcacccagagagaccuguggaacaucuucaagcuguggggcuggaccaugcugugcugc

SEQ ID NO: 1156 - RNA, 84 nt, Artificial Sequence
  P56199_1-28
auggcccccagacccagagccagacccggcguggccguggccugcugcuggcugcugaccguggugcugagaugcugcgugagc

SEQ ID NO: 1157 - RNA, 84 nt, Artificial Sequence
  P11279_1-28
auggccgcccccggcagcgccagaagaccccugcugcugcugcugcugcugcugcugcugggccugaugcacugcgccagcgcc

SEQ ID NO: 1158 - RNA, 84 nt, Artificial Sequence
  P40259_1-28
auggccagacuggcccugagccccgugcccagccacuggaugguggcccugcugcugcugcugagcgccgagcccgugcccgcc

SEQ ID NO: 1159 - RNA, 84 nt, Artificial Sequence
  P43681_1-28
auggagcugggcggccccggcgcccccagacugcugcccccccugcugcugcugcugggcaccggccugcugagagccagcagc

SEQ ID NO: 1160 - RNA, 84 nt, Artificial Sequence
  P18627_1-28
augugggaggcccaguuccugggccugcuguuccugcagccccuguggguggcccccgugaagccccugcagcccggcgccgag

SEQ ID NO: 1161 - RNA, 84 nt, Artificial Sequence
  Q5ZPR3_1-28
augcugagaagaagaggcagccccggcaugggcgugcacgugggcgccgcccugggcgcccugugguucugccugaccggcgcc

SEQ ID NO: 1162 - RNA, 84 nt, Artificial Sequence
  P23415_1-28
auguacagcuucaacacccugagacuguaccugugggagaccaucguguucuucagccuggccgccagcaaggaggccgaggcc

SEQ ID NO: 1163 - RNA, 84 nt, Artificial Sequence
  Q8TD46_1-28
augcugugccccuggagaaccgccaaccugggccugcugcugauccugaccaucuuccugguggccgccagcagcagccugugc

SEQ ID NO: 1164 - RNA, 87 nt, Artificial Sequence
  P17301_1-29
augggccccgagagaaccggcgccgccccccugccccugcugcuggugcuggcccugagccagggcauccugaacugcugccuggcc

SEQ ID NO: 1165 - RNA, 87 nt, Artificial Sequence
  P12821_1-29
augggcgccgccagcggcagaagaggccccggccugcugcugccccugccccugcugcugcugcugcccccccagcccgcccuggcc

SEQ ID NO: 1166 - RNA, 87 nt, Artificial Sequence
  Q14118_1-29
augagaaugagcgugggccugagccugcugcugccccuguggggcagaaccuuccugcugcugcugagcguggugauggcccagagc

SEQ ID NO: 1167 - RNA, 87 nt, Artificial Sequence
  P05231_1-29
augaacagcuucagcaccagcgccuucggccccguggccuucagccugggccugcugcuggugcugcccgccgccuuccccgccccc

SEQ ID NO: 1168 - RNA, 87 nt, Artificial Sequence
  O00602_1-29
auggagcugagcggcgccaccauggccagaggccuggccgugcugcuggugcuguuccugcacaucaagaaccugcccgcccaggcc

SEQ ID NO: 1169 - RNA, 87 nt, Artificial Sequence
  Q9Y6Q6_1-29
auggcccccagagccagaagaagaagaccccuguucgcccugcugcugcugugcgcccugcuggccagacugcagguggcccugcag

SEQ ID NO: 1170 - RNA, 87 nt, Artificial Sequence
  Q9ULI3_1-29
auggccagccccagagccagcagauggccccccccccugcugcugcugcugcugccccugcugcugcugccccccgccgcccccggc

SEQ ID NO: 1171 - RNA, 90 nt, Artificial Sequence
  Q8NBP7_1-30
augggcaccgugagcagcagaagaagcugguggccccugccccugcugcugcugcugcugcugcugcugggccccgccggcgccagagcc

SEQ ID NO: 1172 - RNA, 90 nt, Artificial Sequence
  P02675_1-30
augaagagaauggugagcuggagcuuccacaagcugaagaccaugaagcaccugcugcugcugcugcugugcguguuccuggugaagagc

SEQ ID NO: 1173 - RNA, 90 nt, Artificial Sequence
  P06756_1-30
auggccuucccccccagaagaagacugagacugggccccagaggccugccccugcugcugagcggccugcugcugccccugugcagagcc

SEQ ID NO: 1174 - RNA, 93 nt, Artificial Sequence
  O60609_1-31
auggugagaccccugaaccccagaccccugccccccguggugcugaugcugcugcugcugcugccccccagcccccugccccuggccgccggc

SEQ ID NO: 1175 - RNA, 93 nt, Artificial Sequence
  P50895_1-31
auggagccccccgacgcccccgcccaggccagaggcgcccccagacugcugcugcuggccgugcugcuggccgcccaccccgacgcccaggcc

SEQ ID NO: 1176 - RNA, 93 nt, Artificial Sequence
  P28906_1-31
augcuggugagaagaggcgccagagccggccccagaaugcccagaggcuggaccgcccugugccugcugagccugcugcccagcggcuucaug

SEQ ID NO: 1177 - RNA, 93 nt, Artificial Sequence
  P08514_1-31
auggccagagcccugugcccccugcaggcccuguggcugcuggagugggugcugcugcugcugggccccugcgccgccccccccgccugggcc

SEQ ID NO: 1178 - RNA, 93 nt, Artificial Sequence
  P00742_1-31
augggcagaccccugcaccuggugcugcugagcgccagccuggccggccugcugcugcugggcgagagccuguucaucagaagagagcaggcc

SEQ ID NO: 1179 - RNA, 96 nt, Artificial Sequence
  P26006_1-32
augggccccggccccagcagagcccccagagcccccagacugaugcugugcgcccuggcccugaugguggccgccggcggcugcguggugagcgcc

SEQ ID NO: 1180 - RNA, 96 nt, Artificial Sequence
  P13726_1-32
auggagacccccgccuggcccagagugcccagacccgagaccgccguggccagaacccugcugcugggcuggguguucgcccagguggccggcgcc

SEQ ID NO: 1181 - RNA, 96 nt, Artificial Sequence
  P11912_1-32
augcccggcggccccggcgugcugcaggcccugcccgccaccaucuuccugcuguuccugcugagcgccguguaccugggccccggcugccaggcc

SEQ ID NO: 1182 - RNA, 96 nt, Artificial Sequence
  Q9H6X2_1-32
auggccaccgccgagagaagagcccugggcaucggcuuccaguggcugagccuggccacccuggugcugaucugcgccggccagggcggcagaaga

SEQ ID NO: 1183 - RNA, 99 nt, Artificial Sequence
  Q8IWK6_1-33
auggagccccccggcagaagaagaggcagagcccagcccccccugcugcugccccugagccugcuggcccugcuggcccugcugggcggcggcggcggc

SEQ ID NO: 1184 - RNA, 99 nt, Artificial Sequence
  P58335_1-33
augguggccgagagaagccccgccagaagccccggcagcuggcuguuccccggccuguggcugcuggugcugagcggccccggcggccugcugagagcc

SEQ ID NO: 1185 - RNA, 102 nt, Artificial Sequence
  P06731_1-34
auggagagccccagcgcccccccccacagauggugcauccccuggcagagacugcugcugaccgccagccugcugaccuucuggaacccccccaccaccgcc

SEQ ID NO: 1186 - RNA, 102 nt, Artificial Sequence
  P33681_1-34
augggccacaccagaagacagggcaccagccccagcaagugccccuaccugaacuucuuccagcugcuggugcuggccggccugagccacuucugcagcggc

SEQ ID NO: 1187 - RNA, 105 nt, Artificial Sequence
  P38567_1-35
augggcgugcugaaguucaagcacaucuucuucagaagcuucgugaagagcagcggcgugagccagaucguguucaccuuccugcugauccccugcugccugacc

SEQ ID NO: 1188 - RNA, 105 nt, Artificial Sequence
  P16410_1-35
auggccugccugggcuuccagagacacaaggcccagcugaaccuggccaccagaaccuggcccugcacccugcuguucuuccugcuguucauccccguguucugc

SEQ ID NO: 1189 - RNA, 111 nt, Artificial Sequence
  P15814_1-37
augagacccggcaccggccagggcggccuggaggcccccggcgagcccggccccaaccugagacagagauggccccugcugcugcugggccuggccguggugacccacggc

SEQ ID NO: 1190 - RNA, 114 nt, Artificial Sequence
  Q92956_1-38
auggagccccccggcgacuggggccccccccccuggagaagcacccccaagaccgacgugcugagacuggugcuguaccugaccuuccugggcgcccccugcuacgcccccgcc

SEQ ID NO: 1191 - RNA, 123 nt, Artificial Sequence
  Q86VB7_1-41
augagcaagcugagaauggugcugcuggaggacagcggcagcgccgacuucagaagacacuucgugaaccugagccccuucaccaucaccguggugcugcugcugagcgccugcuucgugacc

SEQ ID NO: 1192 - RNA, 123 nt, Artificial Sequence
  P08648_1-41
augggcagcagaacccccgagagcccccugcacgccgugcagcugagauggggccccagaagaagacccccccugcugccccugcugcugcugcugcugccccccccccccagagugggcggc

SEQ ID NO: 1193 - RNA, 123 nt, Artificial Sequence
  P16109_1-41
auggccaacugccagaucgccauccuguaccagagauuccagagagugguguucggcaucagccagcugcugugcuucagcgcccugaucagcgagcugaccaaccagaaggagguggccgcc

SEQ ID NO: 1194 - RNA, 132 nt, Artificial Sequence
  O75326_1-44
augaccccccccccccccggcagagccgcccccagcgcccccagagccagagugcccggcccccccgccagacugggccugccccugagacugagacugcugcugcugcugugggccgccgccgccagcgcc

SEQ ID NO: 1195 - RNA, 135 nt, Artificial Sequence
  Q8N2Q7_1-45
auggcccugcccagaugcaccuggcccaacuacguguggagagccgugauggccugccuggugcacagaggccugggcgccccccugacccugugcaugcugggcugccugcugcaggccggccacgugcugagc

SEQ ID NO: 1196 - RNA, 138 nt, Artificial Sequence
  Q86UN3_1-46
augcugcccggccugagaagacugcugcaggcccccgccagcgccugccugcugcugaugcugcuggcccugccccuggccgcccccagcugccccaugcugugcaccugcuacagcagcccccccaccgugagcugc

SEQ ID NO: 1197 - RNA, 540 nt, Artificial Sequence
  A0A5B9
auggaccugaagaacguguucccccccgagguggccguguucgagcccagcgaggccgagaucagccacacccagaaggccacccuggugugccuggccaccggcuucuaccccgaccacguggagcugagcuggugggugaacggcaaggaggugcacagcggcgugagcaccgacccccagccccugaaggagcagcccgcccugaacgacagcagauacugccugagcagcagacugagagugagcgccaccuucuggcagaaccccagaaaccacuucagaugccaggugcaguucuacggccugagcgagaacgacgaguggacccaggacagagccaagcccgugacccagaucgugagcgccgaggccuggggcagagccgacugcggcuucaccagcgagagcuaccagcagggcgugcugagcgccaccauccuguacgagauccugcugggcaaggccacccuguacgccgugcuggugagcgcccuggugcugauggccauggugaagagaaaggacagcagaggcuga

SEQ ID NO: 1198 - RNA, 465 nt, Artificial Sequence
  B7Z8K6
augagccagccccacaccaagcccagcguguucgugaugaagaacggcaccaacguggccugccuggugaaggaguucuaccccaaggacaucagaaucaaccuggugagcagcaagaagaucaccgaguucgaccccgccaucgugaucagccccagcggcaaguacaacgccgugaagcugggcaaguacgaggacagcaacagcgugaccugcagcgugcagcacgacaacaagaccgugcacagcaccgacuucgaggugaagaccgacagcaccgaccacgugaagcccaaggagaccgagaacaccaagcagcccagcaagagcugccacaagcccaaggccaucgugcacaccgagaaggugaacaugaugagccugaccgugcugggccugagaaugcuguucgccaagaccguggccgugaacuuccugcugaccgccaagcuguucuuccuguga

SEQ ID NO: 1199 - RNA, 645 nt, Artificial Sequence
  B9A064
augagacccaagaccggccaggugggcugcgagacccccgaggagcugggccccggccccagacagagauggccccugcugcugcugggccuggccaugguggcccacggccugcugagacccaugguggccccccagagcggcgaccccgaccccggcgccagcgugggcagcagcagaagcagccugagaagccuguggggcagacugcugcugcagcccagcccccagagagccgaccccagaugcuggcccagaggcuucuggagcgagccccagagccugugcuacguguucggcaccggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggcccccaccgagugcagcuga

SEQ ID NO: 1200 - RNA, 2520 nt, Artificial Sequence
  O00206
augaugagcgccagcagacuggccggcacccugauccccgccauggccuuccugagcugcgugagacccgagagcugggagcccugcguggagguggugcccaacaucaccuaccagugcauggagcugaacuucuacaagauccccgacaaccugcccuucagcaccaagaaccuggaccugagcuucaacccccugagacaccugggcagcuacagcuucuucagcuuccccgagcugcaggugcuggaccugagcagaugcgagauccagaccaucgaggacggcgccuaccagagccugagccaccugagcacccugauccugaccggcaaccccauccagagccuggcccugggcgccuucagcggccugagcagccugcagaagcugguggccguggagaccaaccuggccagccuggagaacuuccccaucggccaccugaagacccugaaggagcugaacguggcccacaaccugauccagagcuucaagcugcccgaguacuucagcaaccugaccaaccuggagcaccuggaccugagcagcaacaagauccagagcaucuacugcaccgaccugagagugcugcaccagaugccccugcugaaccugagccuggaccugagccugaaccccaugaacuucauccagcccggcgccuucaaggagaucagacugcacaagcugacccugagaaacaacuucgacagccugaacgugaugaagaccugcauccagggccuggccggccuggaggugcacagacuggugcugggcgaguucagaaacgagggcaaccuggagaaguucgacaagagcgcccuggagggccugugcaaccugaccaucgaggaguucagacuggccuaccuggacuacuaccuggacgacaucaucgaccuguucaacugccugaccaacgugagcagcuucagccuggugagcgugaccaucgagagagugaaggacuucagcuacaacuucggcuggcagcaccuggagcuggugaacugcaaguucggccaguuccccacccugaagcugaagagccugaagagacugaccuucaccagcaacaagggcggcaacgccuucagcgagguggaccugcccagccuggaguuccuggaccugagcagaaacggccugagcuucaagggcugcugcagccagagcgacuucggcaccaccagccugaaguaccuggaccugagcuucaacggcgugaucaccaugagcagcaacuuccugggccuggagcagcuggagcaccuggacuuccagcacagcaaccugaagcagaugagcgaguucagcguguuccugagccugagaaaccugaucuaccuggacaucagccacacccacaccagaguggccuucaacggcaucuucaacggccugagcagccuggaggugcugaagauggccggcaacagcuuccaggagaacuuccugcccgacaucuucaccgagcugagaaaccugaccuuccuggaccugagccagugccagcuggagcagcugagccccaccgccuucaacagccugagcagccugcaggugcugaacaugagccacaacaacuucuucagccuggacaccuuccccuacaagugccugaacagccugcaggugcuggacuacagccugaaccacaucaugaccagcaagaagcaggagcugcagcacuuccccagcagccuggccuuccugaaccugacccagaacgacuucgccugcaccugcgagcaccagagcuuccugcaguggaucaaggaccagagacagcugcugguggagguggagagaauggagugcgccacccccagcgacaagcagggcaugcccgugcugagccugaacaucaccugccagaugaacaagaccaucaucggcgugagcgugcugagcgugcugguggugagcgugguggccgugcugguguacaaguucuacuuccaccugaugcugcuggccggcugcaucaaguacggcagaggcgagaacaucuacgacgccuucgugaucuacagcagccaggacgaggacugggugagaaacgagcuggugaagaaccuggaggagggcgugccccccuuccagcugugccugcacuacagagacuucauccccggcguggccaucgccgccaacaucauccacgagggcuuccacaagagcagaaaggugaucgugguggugagccagcacuucauccagagcagauggugcaucuucgaguacgagaucgcccagaccuggcaguuccugagcagcagagccggcaucaucuucaucgugcugcagaagguggagaagacccugcugagacagcagguggagcuguacagacugcugagcagaaacaccuaccuggagugggaggacagcgugcugggcagacacaucuucuggagaagacugagaaaggcccugcuggacggcaagagcuggaaccccgagggcaccgugggcaccggcugcaacuggcaggaggccaccagcaucuga

SEQ ID NO: 1201 - RNA, 1377 nt, Artificial Sequence
  P01730
augaacagaggcgugcccuucagacaccugcugcuggugcugcagcuggcccugcugcccgccgccacccagggcaagaagguggugcugggcaagaagggcgacaccguggagcugaccugcaccgccagccagaagaagagcauccaguuccacuggaagaacagcaaccagaucaagauccugggcaaccagggcagcuuccugaccaagggccccagcaagcugaacgacagagccgacagcagaagaagccugugggaccagggcaacuucccccugaucaucaagaaccugaagaucgaggacagcgacaccuacaucugcgagguggaggaccagaaggaggaggugcagcugcugguguucggccugaccgccaacagcgacacccaccugcugcagggccagagccugacccugacccuggagagcccccccggcagcagccccagcgugcagugcagaagccccagaggcaagaacauccagggcggcaagacccugagcgugagccagcuggagcugcaggacagcggcaccuggaccugcaccgugcugcagaaccagaagaagguggaguucaagaucgacaucguggugcuggccuuccagaaggccagcagcaucguguacaagaaggagggcgagcagguggaguucagcuucccccuggccuucaccguggagaagcugaccggcagcggcgagcugugguggcaggccgagagagccagcagcagcaagagcuggaucaccuucgaccugaagaacaaggaggugagcgugaagagagugacccaggaccccaagcugcagaugggcaagaagcugccccugcaccugacccugccccaggcccugccccaguacgccggcagcggcaaccugacccuggcccuggaggccaagaccggcaagcugcaccaggaggugaaccugguggugaugagagccacccagcugcagaagaaccugaccugcgagguguggggccccaccagccccaagcugaugcugagccugaagcuggagaacaaggaggccaaggugagcaagagagagaaggccgugugggugcugaaccccgaggccggcauguggcagugccugcugagcgacagcggccaggugcugcuggagagcaacaucaaggugcugcccaccuggagcacccccgugcagcccauggcccugaucgugcugggcggcguggccggccugcugcuguucaucggccugggcaucuucuucugcgugagaugcagacacagaagaagacaggccgagagaaugagccagaucaagagacugcugagcgagaagaagaccugccagugcccccacagauuccagaagaccugcagccccaucuga

SEQ ID NO: 1202 - RNA, 537 nt, Artificial Sequence
  P01850
auggaggaccugaacaagguguucccccccgagguggccguguucgagcccagcgaggccgagaucagccacacccagaaggccacccuggugugccuggccaccggcuucuuccccgaccacguggagcugagcuggugggugaacggcaaggaggugcacagcggcgugagcaccgacccccagccccugaaggagcagcccgcccugaacgacagcagauacugccugagcagcagacugagagugagcgccaccuucuggcagaaccccagaaaccacuucagaugccaggugcaguucuacggccugagcgagaacgacgaguggacccaggacagagccaagcccgugacccagaucgugagcgccgaggccuggggcagagccgacugcggcuucaccagcgugagcuaccagcagggcgugcugagcgccaccauccuguacgagauccugcugggcaaggccacccuguacgccgugcuggugagcgcccuggugcugauggccauggugaagagaaaggacuucuga

SEQ ID NO: 1203 - RNA, 624 nt, Artificial Sequence
  P07766
augcagagcggcacccacuggagagugcugggccugugccugcugagcgugggcguguggggccaggacggcaacgaggagaugggcggcaucacccagacccccuacaaggugagcaucagcggcaccaccgugauccugaccugcccccaguaccccggcagcgagauccuguggcagcacaacgacaagaacaucggcggcgacgaggacgacaagaacaucggcagcgacgaggaccaccugagccugaaggaguucagcgagcuggagcagagcggcuacuacgugugcuaccccagaggcagcaagcccgaggacgccaacuucuaccuguaccugagagccagagugugcgagaacugcauggagauggacgugaugagcguggccaccaucgugaucguggacaucugcaucaccggcggccugcugcugcugguguacuacuggagcaagaacagaaaggccaaggccaagcccgugaccagaggcgccggcgccggcggcagacagagaggccagaacaaggagagacccccccccgugcccaaccccgacuacgagcccaucagaaagggccagagagaccuguacagcggccugaaccagagaagaaucuga

SEQ ID NO: 1204 - RNA, 3915 nt, Artificial Sequence
  P08575
auguaccuguggcugaagcugcuggccuucggcuucgccuuccuggacaccgagguguucgugaccggccagagccccacccccagccccaccggccugaccaccgccaagaugcccagcgugccccugagcagcgacccccugcccacccacaccaccgccuucagccccgccagcaccuucgagagagagaacgacuucagcgagaccaccaccagccugagccccgacaacaccagcacccaggugagccccgacagccuggacaacgccagcgccuucaacaccaccggcgugagcagcgugcagaccccccaccugcccacccacgccgacagccagacccccagcgccggcaccgacacccagaccuucagcggcagcgccgccaacgccaagcugaaccccacccccggcagcaacgccaucagcgacgugcccggcgagagaagcaccgccagcaccuuccccaccgaccccgugagcccccugaccaccacccugagccuggcccaccacagcagcgccgcccugcccgccagaaccagcaacaccaccaucaccgccaacaccagcgacgccuaccugaacgccagcgagaccaccacccugagccccagcggcagcgccgugaucagcaccaccaccaucgccaccacccccagcaagcccaccugcgacgagaaguacgccaacaucaccguggacuaccuguacaacaaggagaccaagcuguucaccgccaagcugaacgugaacgagaacguggagugcggcaacaacaccugcaccaacaacgaggugcacaaccugaccgagugcaagaacgccagcgugagcaucagccacaacagcugcaccgcccccgacaagacccugauccuggacgugccccccggcguggagaaguuccagcugcacgacugcacccagguggagaaggccgacaccaccaucugccugaaguggaagaacaucgagaccuucaccugcgacacccagaacaucaccuacagauuccagugcggcaacaugaucuucgacaacaaggagaucaagcuggagaaccuggagcccgagcacgaguacaagugcgacagcgagauccuguacaacaaccacaaguucaccaacgccagcaagaucaucaagaccgacuucggcagccccggcgagccccagaucaucuucugcagaagcgaggccgcccaccagggcgugaucaccuggaaccccccccagagaagcuuccacaacuucacccugugcuacaucaaggagaccgagaaggacugccugaaccuggacaagaaccugaucaaguacgaccugcagaaccugaagcccuacaccaaguacgugcugagccugcacgccuacaucaucgccaaggugcagagaaacggcagcgccgccaugugccacuucaccaccaagagcgccccccccagccagguguggaacaugaccgugagcaugaccagcgacaacagcaugcacgugaagugcagaccccccagagacagaaacggcccccacgagagauaccaccuggagguggaggccggcaacacccuggugagaaacgagagccacaagaacugcgacuucagagugaaggaccugcaguacagcaccgacuacaccuucaaggccuacuuccacaacggcgacuaccccggcgagcccuucauccugcaccacagcaccagcuacaacagcaaggcccugaucgccuuccuggccuuccugaucaucgugaccagcaucgcccugcugguggugcuguacaagaucuacgaccugcacaagaagagaagcugcaaccuggacgagcagcaggagcugguggagagagacgacgagaagcagcugaugaacguggagcccauccacgccgacauccugcuggagaccuacaagagaaagaucgccgacgagggcagacuguuccuggccgaguuccagagcauccccagaguguucagcaaguuccccaucaaggaggccagaaagcccuucaaccagaacaagaacagauacguggacauccugcccuacgacuacaacagaguggagcugagcgagaucaacggcgacgccggcagcaacuacaucaacgccagcuacaucgacggcuucaaggagcccagaaaguacaucgccgcccagggccccagagacgagaccguggacgacuucuggagaaugaucugggagcagaaggccaccgugaucgugauggugaccagaugcgaggagggcaacagaaacaagugcgccgaguacuggcccagcauggaggagggcaccagagccuucggcgacgugguggugaagaucaaccagcacaagagaugccccgacuacaucauccagaagcugaacaucgugaacaagaaggagaaggccaccggcagagaggugacccacauccaguucaccagcuggcccgaccacggcgugcccgaggacccccaccugcugcugaagcugagaagaagagugaacgccuucagcaacuucuucagcggccccaucguggugcacugcagcgccggcgugggcagaaccggcaccuacaucggcaucgacgccaugcuggagggccuggaggccgagaacaagguggacguguacggcuacguggugaagcugagaagacagagaugccugauggugcagguggaggcccaguacauccugauccaccaggcccugguggaguacaaccaguucggcgagaccgaggugaaccugagcgagcugcaccccuaccugcacaacaugaagaagagagacccccccagcgagcccagcccccuggaggccgaguuccagagacugcccagcuacagaagcuggagaacccagcacaucggcaaccaggaggagaacaagagcaagaacagaaacagcaacgugauccccuacgacuacaacagagugccccugaagcacgagcuggagaugagcaaggagagcgagcacgacagcgacgagagcagcgacgacgacagcgacagcgaggagcccagcaaguacaucaacgccagcuucaucaugagcuacuggaagcccgaggugaugaucgccgcccagggcccccugaaggagaccaucggcgacuucuggcagaugaucuuccagagaaaggugaaggugaucgugaugcugaccgagcugaagcacggcgaccaggagaucugcgcccaguacuggggcgagggcaagcagaccuacggcgacaucgagguggaccugaaggacaccgacaagagcagcaccuacacccugagaguguucgagcugagacacagcaagagaaaggacagcagaaccguguaccaguaccaguacaccaacuggagcguggagcagcugcccgccgagcccaaggagcugaucagcaugauccagguggugaagcagaagcugccccagaagaacagcagcgagggcaacaagcaccacaagagcaccccccugcugauccacugcagagacggcagccagcagaccggcaucuucugcgcccugcugaaccugcuggagagcgccgagaccgaggaggugguggacaucuuccagguggugaaggcccugagaaaggccagacccggcauggugagcaccuucgagcaguaccaguuccuguacgacgugaucgccagcaccuaccccgcccagaacggccaggugaagaagaacaaccaccaggaggacaagaucgaguucgacaacgagguggacaaggugaagcaggacgccaacugcgugaacccccugggcgcccccgagaagcugcccgaggccaaggagcaggccgagggcagcgagcccaccagcggcaccgagggccccgagcacagcgugaacggccccgccagccccgcccugaaccagggcagcuga

SEQ ID NO: 1205 - RNA, 765 nt, Artificial Sequence
  P08637
auguggcagcugcugcugcccaccgcccugcugcugcuggugagcgccggcaugagaaccgaggaccugcccaaggccgugguguuccuggagccccagugguacagagugcuggagaaggacagcgugacccugaagugccagggcgccuacagccccgaggacaacagcacccagugguuccacaacgagagccugaucagcagccaggccagcagcuacuucaucgacgccgccaccguggacgacagcggcgaguacagaugccagaccaaccugagcacccugagcgaccccgugcagcuggaggugcacaucggcuggcugcugcugcaggcccccagauggguguucaaggaggaggaccccauccaccugagaugccacagcuggaagaacaccgcccugcacaaggugaccuaccugcagaacggcaagggcagaaaguacuuccaccacaacagcgacuucuacauccccaaggccacccugaaggacagcggcagcuacuucugcagaggccuguucggcagcaagaacgugagcagcgagaccgugaacaucaccaucacccagggccuggccgugagcaccaucagcagcuucuucccccccggcuaccaggugagcuucugccuggugauggugcugcuguucgccguggacaccggccuguacuucagcgugaagaccaacaucagaagcagcaccagagacuggaaggaccacaaguucaaguggagaaaggacccccaggacaaguga

SEQ ID NO: 1206 - RNA, 663 nt, Artificial Sequence
  P10747
augcugagacugcugcuggcccugaaccuguuccccagcauccaggugaccggcaacaagauccuggugaagcagagccccaugcugguggccuacgacaacgccgugaaccugagcugcaaguacagcuacaaccuguucagcagagaguucagagccagccugcacaagggccuggacagcgccguggaggugugcgugguguacggcaacuacagccagcagcugcagguguacagcaagaccggcuucaacugcgacggcaagcugggcaacgagagcgugaccuucuaccugcagaaccuguacgugaaccagaccgacaucuacuucugcaagaucgaggugauguaccccccccccuaccuggacaacgagaagagcaacggcaccaucauccacgugaagggcaagcaccugugccccagcccccuguuccccggccccagcaagcccuucugggugcuggugguggugggcggcgugcuggccugcuacagccugcuggugaccguggccuucaucaucuucugggugagaagcaagagaagcagacugcugcacagcgacuacaugaacaugacccccagaagacccggccccaccagaaagcacuaccagcccuacgccccccccagagacuucgccgccuacagaagcuga

SEQ ID NO: 1207 - RNA, 681 nt, Artificial Sequence
  P11912
augcccggcggccccggcgugcugcaggcccugcccgccaccaucuuccugcuguuccugcugagcgccguguaccugggccccggcugccaggcccuguggaugcacaaggugcccgccagccugauggugagccugggcgaggacgcccacuuccagugcccccacaacagcagcaacaacgccaacgugaccugguggagagugcugcacggcaacuacaccuggccccccgaguuccugggccccggcgaggaccccaacggcacccugaucauccagaacgugaacaagagccacggcggcaucuacgugugcagagugcaggagggcaacgagagcuaccagcagagcugcggcaccuaccugagagugagacagcccccccccagacccuuccuggacaugggcgagggcaccaagaacagaaucaucaccgccgagggcaucauccugcuguucugcgccguggugcccggcacccugcugcuguucagaaagagauggcagaacgagaagcugggccuggacgccggcgacgaguacgaggacgagaaccuguacgagggccugaaccuggacgacugcagcauguacgaggacaucagcagaggccugcagggcaccuaccaggacgugggcagccugaacaucggcgacgugcagcuggagaagcccuga

SEQ ID NO: 1208 - RNA, 1671 nt, Artificial Sequence
  P15391
augcccccccccagacugcuguucuuccugcuguuccugacccccauggaggugagacccgaggagccccugguggugaagguggaggagggcgacaacgccgugcugcagugccugaagggcaccagcgacggccccacccagcagcugaccuggagcagagagagcccccugaagcccuuccugaagcugagccugggccugcccggccugggcauccacaugagaccccuggccaucuggcuguucaucuucaacgugagccagcagaugggcggcuucuaccugugccagcccggcccccccagcgagaaggccuggcagcccggcuggaccgugaacguggagggcagcggcgagcuguucagauggaacgugagcgaccugggcggccugggcugcggccugaagaacagaagcagcgagggccccagcagccccagcggcaagcugaugagccccaagcuguacgugugggccaaggacagacccgagaucugggagggcgagccccccugccugccccccagagacagccugaaccagagccugagccaggaccugaccauggcccccggcagcacccuguggcugagcugcggcgugccccccgacagcgugagcagaggcccccugagcuggacccacgugcaccccaagggccccaagagccugcugagccuggagcugaaggacgacagacccgccagagacaugugggugauggagaccggccugcugcugcccagagccaccgcccaggacgccggcaaguacuacugccacagaggcaaccugaccaugagcuuccaccuggagaucaccgccagacccgugcuguggcacuggcugcugagaaccggcggcuggaaggugagcgccgugacccuggccuaccugaucuucugccugugcagccuggugggcauccugcaccugcagagagcccuggugcugagaagaaagagaaagagaaugaccgaccccaccagaagauucuucaaggugacccccccccccggcagcggcccccagaaccaguacggcaacgugcugagccugcccacccccaccagcggccugggcagagcccagagaugggccgccggccugggcggcaccgcccccagcuacggcaaccccagcagcgacgugcaggccgacggcgcccugggcagcagaagcccccccggcgugggccccgaggaggaggagggcgagggcuacgaggagcccgacagcgaggaggacagcgaguucuacgagaacgacagcaaccugggccaggaccagcugagccaggacggcagcggcuacgagaaccccgaggacgagccccugggccccgaggacgaggacagcuucagcaacgccgagagcuacgagaacgaggacgaggagcugacccagcccguggccagaaccauggacuuccugagcccccacggcagcgccugggaccccagcagagaggccaccagccugggcagccagagcuacgaggacaugagaggcauccuguacgccgccccccagcugagaagcaucagaggccagcccggccccaaccacgaggaggacgccgacagcuacgagaacauggacaaccccgacggccccgaccccgccuggggcggcggcggcagaaugggcaccuggagcaccagauga

SEQ ID NO: 1209 - RNA, 672 nt, Artificial Sequence
  P16410
auggccugccugggcuuccagagacacaaggcccagcugaaccuggccaccagaaccuggcccugcacccugcuguucuuccugcuguucauccccguguucugcaaggccaugcacguggcccagcccgccguggugcuggccagcagcagaggcaucgccagcuucgugugcgaguacgccagccccggcaaggccaccgaggugagagugaccgugcugagacaggccgacagccaggugaccgaggugugcgccgccaccuacaugaugggcaacgagcugaccuuccuggacgacagcaucugcaccggcaccagcagcggcaaccaggugaaccugaccauccagggccugagagccauggacaccggccuguacaucugcaagguggagcugauguaccccccccccuacuaccugggcaucggcaacggcacccagaucuacgugaucgaccccgagcccugccccgacagcgacuuccugcuguggauccuggccgccgugagcagcggccuguucuucuacagcuuccugcugaccgccgugagccugagcaagaugcugaagaagagaagcccccugaccaccggcguguacgugaagaugccccccaccgagcccgagugcgagaagcaguuccagcccuacuucauccccaucaacuga

SEQ ID NO: 1210 - RNA, 1419 nt, Artificial Sequence
  P16671
augggcugcgacagaaacugcggccugaucgccggcgccgugaucggcgccgugcuggccguguucggcggcauccugaugcccgugggcgaccugcugauccagaagaccaucaagaagcagguggugcuggaggagggcaccaucgccuucaagaacugggugaagaccggcaccgagguguacagacaguucuggaucuucgacgugcagaacccccaggaggugaugaugaacagcagcaacauccaggugaagcagagaggccccuacaccuacagagugagauuccuggccaaggagaacgugacccaggacgccgaggacaacaccgugagcuuccugcagcccaacggcgccaucuucgagcccagccugagcgugggcaccgaggccgacaacuucaccgugcugaaccuggccguggccgccgccagccacaucuaccagaaccaguucgugcagaugauccugaacagccugaucaacaagagcaagagcagcauguuccaggugagaacccugagagagcugcuguggggcuacagagaccccuuccugagccuggugcccuaccccgugaccaccaccgugggccuguucuaccccuacaacaacaccgccgacggcguguacaagguguucaacggcaaggacaacaucagcaagguggccaucaucgacaccuacaagggcaagagaaaccugagcuacugggagagccacugcgacaugaucaacggcaccgacgccgccagcuucccccccuucguggagaagagccaggugcugcaguucuucagcagcgacaucugcagaagcaucuacgccguguucgagagcgacgugaaccugaagggcauccccguguacagauucgugcugcccagcaaggccuucgccagccccguggagaaccccgacaacuacugcuucugcaccgagaagaucaucagcaagaacugcaccagcuacggcgugcuggacaucagcaagugcaaggagggcagacccguguacaucagccugccccacuuccuguacgccagccccgacgugagcgagcccaucgacggccugaaccccaacgaggaggagcacagaaccuaccuggacaucgagcccaucaccggcuucacccugcaguucgccaagagacugcaggugaaccugcuggugaagcccagcgagaagauccaggugcugaagaaccugaagagaaacuacaucgugcccauccuguggcugaacgagaccggcaccaucggcgacgagaaggccaacauguucagaagccaggugaccggcaagaucaaccugcugggccugaucgagaugauccugcugagcgugggcguggugauguucguggccuucaugaucagcuacugcgccugcagaagcaagaccaucaaguga

SEQ ID NO: 1211 - RNA, 651 nt, Artificial Sequence
  P26718
augggcuggaucagaggcagaagaagcagacacagcugggagaugagcgaguuccacaacuacaaccuggaccugaagaagagcgacuucagcaccagauggcagaagcagagaugccccguggugaagagcaagugcagagagaacgccagccccuucuucuucugcugcuucaucgccguggccaugggcaucagauucaucaucaugguggccaucuggagcgccguguuccugaacagccuguucaaccaggaggugcagaucccccugaccgagagcuacugcggccccugccccaagaacuggaucugcuacaagaacaacugcuaccaguucuucgacgagagcaagaacugguacgagagccaggccagcugcaugagccagaacgccagccugcugaagguguacagcaaggaggaccaggaccugcugaagcuggugaagagcuaccacuggaugggccuggugcacauccccaccaacggcagcuggcagugggaggacggcagcauccugagccccaaccugcugaccaucaucgagaugcagaagggcgacugcgcccuguacgccagcagcuucaagggcuacaucgagaacugcagcacccccaacaccuacaucugcaugcagagaaccguguga

SEQ ID NO: 1212 - RNA, 261 nt, Artificial Sequence
  P30273
augauccccgccguggugcugcugcugcugcugcugguggagcaggccgccgcccugggcgagccccagcugugcuacauccuggacgccauccuguuccuguacggcaucgugcugacccugcuguacugcagacugaagauccaggugagaaaggccgccaucaccagcuacgagaagagcgacggcguguacaccggccugagcaccagaaaccaggagaccuacgagacccugaagcacgagaagcccccccaguag

SEQ ID NO: 1213 - RNA, 1137 nt, Artificial Sequence
  P32248
auggaccugggcaagcccaugaagagcgugcuggugguggcccugcuggugaucuuccaggugugccugugccaggacgaggugaccgacgacuacaucggcgacaacaccaccguggacuacacccuguucgagagccugugcagcaagaaggacgugagaaacuucaaggccugguuccugcccaucauguacagcaucaucugcuucgugggccugcugggcaacggccugguggugcugaccuacaucuacuucaagagacugaagaccaugaccgacaccuaccugcugaaccuggccguggccgacauccuguuccugcugacccugcccuucugggccuacagcgccgccaagagcuggguguucggcgugcacuucugcaagcugaucuucgccaucuacaagaugagcuucuucagcggcaugcugcugcugcugugcaucagcaucgacagauacguggccaucgugcaggccgugagcgcccacagacacagagccagagugcugcugaucagcaagcugagcugcgugggcaucuggauccuggccaccgugcugagcauccccgagcugcuguacagcgaccugcagagaagcagcagcgagcaggccaugagaugcagccugaucaccgagcacguggaggccuucaucaccauccagguggcccagauggugaucggcuuccuggugccccugcuggccaugagcuucugcuaccuggugaucaucagaacccugcugcaggccagaaacuucgagagaaacaaggccaucaaggugaucaucgccgugguggugguguucaucguguuccagcugcccuacaacggcguggugcuggcccagaccguggccaacuucaacaucaccagcagcaccugcgagcugagcaagcagcugaacaucgccuacgacgugaccuacagccuggccugcgugagaugcugcgugaaccccuuccuguacgccuucaucggcgugaaguucagaaacgaccuguucaagcuguucaaggaccugggcugccugagccaggagcagcugagacaguggagcagcugcagacacaucagaagaagcagcaugagcguggaggccgagaccaccaccaccuucagccccuga

SEQ ID NO: 1214 - RNA, 690 nt, Artificial Sequence
  P40259
auggccagacuggcccugagccccgugcccagccacuggaugguggcccugcugcugcugcugagcgccgagcccgugcccgccgccagaagcgaggacagauacagaaaccccaagggcagcgccugcagcagaaucuggcagagccccagauucaucgccagaaagagaggcuucaccgugaagaugcacugcuacaugaacagcgccagcggcaacgugagcuggcuguggaagcaggagauggacgagaacccccagcagcugaagcuggagaagggcagaauggaggagagccagaacgagagccuggccacccugaccauccagggcaucagauucgaggacaacggcaucuacuucugccagcagaagugcaacaacaccagcgagguguaccagggcugcggcaccgagcugagagugaugggcuucagcacccuggcccagcugaagcagagaaacacccugaaggacggcaucaucaugauccagacccugcugaucauccuguucaucaucgugcccaucuuccugcugcuggacaaggacgacagcaaggccggcauggaggaggaccacaccuacgagggccuggacaucgaccagaccgccaccuacgaggacaucgugacccugagaaccggcgaggugaaguggagcgugggcgagcaccccggccaggaguga

SEQ ID NO: 1215 - RNA, 990 nt, Artificial Sequence
  P42081
auggacccccagugcaccaugggccugagcaacauccuguucgugauggccuuccugcugagcggcgccgccccccugaagauccaggccuacuucaacgagaccgccgaccugcccugccaguucgccaacagccagaaccagagccugagcgagcuggugguguucuggcaggaccaggagaaccuggugcugaacgagguguaccugggcaaggagaaguucgacagcgugcacagcaaguacaugggcagaaccagcuucgacagcgacagcuggacccugagacugcacaaccugcagaucaaggacaagggccuguaccagugcaucauccaccacaagaagcccaccggcaugaucagaauccaccagaugaacagcgagcugagcgugcuggccaacuucagccagcccgagaucgugcccaucagcaacaucaccgagaacguguacaucaaccugaccugcagcagcauccacggcuaccccgagcccaagaagaugagcgugcugcugagaaccaagaacagcaccaucgaguacgacggcgugaugcagaagagccaggacaacgugaccgagcuguacgacgugagcaucagccugagcgugagcuuccccgacgugaccagcaacaugaccaucuucugcauccuggagaccgacaagaccagacugcugagcagccccuucagcaucgagcuggaggacccccagcccccccccgaccacauccccuggaucaccgccgugcugcccaccgugaucaucugcgugaugguguucugccugauccuguggaaguggaagaagaagaagagacccagaaacagcuacaagugcggcaccaacaccauggagagagaggagagcgagcagaccaagaagagagagaagauccacauccccgagagaagcgacgaggcccagagaguguucaagagcagcaagaccagcagcugcgacaagagcgacaccugcuucuga

SEQ ID NO: 1216 - RNA, 1011 nt, Artificial Sequence
  Q15762
auggacuaccccacccugcugcuggcccugcugcacguguacagagcccugugcgaggaggugcuguggcacaccagcgugcccuucgccgagaacaugagccuggagugcguguaccccagcaugggcauccugacccagguggagugguucaagaucggcacccagcaggacagcaucgccaucuucagccccacccacggcauggugaucagaaagcccuacgccgagagaguguacuuccugaacagcaccauggccagcaacaacaugacccuguucuucagaaacgccagcgaggacgacgugggcuacuacagcugcagccuguacaccuacccccagggcaccuggcagaaggugauccagguggugcagagcgacagcuucgaggccgccgugcccagcaacagccacaucgugagcgagcccggcaagaacgugacccugaccugccagccccagaugaccuggcccgugcaggccgugagaugggagaagauccagcccagacagaucgaccugcugaccuacugcaaccuggugcacggcagaaacuucaccagcaaguuccccagacagaucgugagcaacugcagccacggcagauggagcgugaucgugauccccgacgugaccgugagcgacagcggccuguacagaugcuaccugcaggccagcgccggcgagaacgagaccuucgugaugagacugaccguggccgagggcaagaccgacaaccaguacacccuguucguggccggcggcaccgugcugcugcugcuguucgugaucagcaucaccaccaucaucgugaucuuccugaacagaagaagaagaagagagagaagagaccuguucaccgagagcugggacacccagaaggcccccaacaacuacagaagccccaucagcaccagccagcccaccaaccagagcauggacgacaccagagaggacaucuacgugaacuaccccaccuucagcagaagacccaagaccagaguguga

SEQ ID NO: 1217 - RNA, 13482 nt, Artificial Sequence
  Q685J3
augcccagacccggcaccauggcccugugccugcugacccuggugcugagccugcugcccccccaggccgccgccgagcaggaccugagcgugaacagagccgugugggacggcggcggcugcaucagccagggcgacgugcugaacagacagugccagcagcugagccagcacgugagaaccggcagcgccgccaacaccgccaccggcaccaccagcaccaacgugguggagcccagaauguaccugagcugcagcaccaaccccgagaugaccagcaucgagagcagcgugaccagcgacacccccggcgugagcagcaccagaaugacccccaccgagagcagaaccaccagcgagagcaccagcgacagcaccacccuguuccccagcagcaccgaggacaccagcagccccaccacccccgagggcaccgacgugcccaugagcacccccagcgaggagagcaucagcagcaccauggccuucgugagcaccgccccccugcccagcuucgaggccuacaccagccugaccuacaagguggacaugagcaccccccugaccaccagcacccaggccagcagcagccccaccacccccgagagcaccaccauccccaagagcaccaacagcgagggcagcaccccccugaccagcaugcccgccagcaccaugaagguggccagcagcgaggccaucacccugcugaccacccccguggagaucagcacccccgugaccaucagcgcccaggccagcagcagccccaccaccgccgagggccccagccugagcaacagcgcccccagcggcggcagcaccccccugaccagaaugccccugagcgugaugcugguggugagcagcgaggccagcacccugagcaccacccccgccgccaccaacauccccgugaucaccagcaccgaggccagcagcagccccaccaccgccgagggcaccagcauccccaccagcaccuacaccgagggcagcaccccccugaccagcacccccgccagcaccaugcccguggccaccagcgagaugagcacccugagcaucacccccguggacaccagcacccuggugaccaccagcaccgagcccagcagccugcccaccaccgccgaggccaccagcaugcugaccagcacccugagcgagggcagcaccccccugaccaacaugcccgugagcaccauccugguggccagcagcgaggccagcaccaccagcaccauccccguggacagcaagaccuucgugaccaccgccagcgaggccagcagcagccccaccaccgccgaggacaccagcaucgccaccagcacccccagcgagggcagcaccccccugaccagcaugcccgugagcaccacccccguggccagcagcgaggccagcaaccugagcaccacccccguggacagcaagacccaggugaccaccagcaccgaggccagcagcagcccccccaccgccgaggugaacagcaugcccaccagcacccccagcgagggcagcaccccccugaccagcaugagcgugagcaccaugcccguggccagcagcgaggccagcacccugagcaccacccccguggacaccagcacccccgugaccaccagcagcgaggccagcagcagcagcaccacccccgagggcaccagcauccccaccagcacccccagcgagggcagcaccccccugaccaacaugcccgugagcaccagacugguggugagcagcgaggccagcaccaccagcaccacccccgccgacagcaacaccuucgugaccaccagcagcgaggccagcagcagcagcaccaccgccgagggcaccagcaugcccaccagcaccuacagcgagagaggcaccaccaucaccagcaugagcgugagcaccacccugguggccagcagcgaggccagcacccugagcaccacccccguggacagcaacacccccgugaccaccagcaccgaggccaccagcagcagcaccaccgccgagggcaccagcaugcccaccagcaccuacaccgagggcagcaccccccugaccagcaugcccgugaacaccacccugguggccagcagcgaggccagcacccugagcaccacccccguggacaccagcacccccgugaccaccagcaccgaggccagcagcagccccaccaccgccgacggcgccagcaugcccaccagcacccccagcgagggcagcaccccccugaccagcaugcccgugagcaagacccugcugaccagcagcgaggccagcacccugagcaccaccccccuggacaccagcacccacaucaccaccagcaccgaggccagcugcagccccaccaccaccgagggcaccagcaugcccaucagcacccccagcgagggcagcccccugcugaccagcauccccgugagcaucacccccgugaccagccccgaggccagcacccugagcaccacccccguggacagcaacagccccgugaccaccagcaccgaggugagcagcagccccacccccgccgagggcaccagcaugcccaccagcaccuacagcgagggcagaaccccccugaccagcaugcccgugagcaccacccugguggccaccagcgccaucagcacccugagcaccacccccguggacaccagcacccccgugaccaacagcaccgaggccagaagcagccccaccaccagcgagggcaccagcaugcccaccagcacccccggcgagggcagcaccccccugaccagcaugcccgacagcaccacccccguggugagcagcgaggccagaacccugagcgccacccccguggacaccagcacccccgugaccaccagcaccgaggccaccagcagccccaccaccgccgagggcaccagcauccccaccagcacccccagcgagggcaccaccccccugaccagcacccccgugagccacacccugguggccaacagcgaggccagcacccugagcaccacccccguggacagcaacaccccccugaccaccagcaccgaggccagcagccccccccccaccgccgagggcaccagcaugcccaccagcacccccagcgagggcagcaccccccugaccagaaugcccgugagcaccaccaugguggccagcagcgagaccagcacccugagcaccacccccgccgacaccagcacccccgugaccaccuacagccaggccagcagcagcagcaccaccgccgacggcaccagcaugcccaccagcaccuacagcgagggcagcaccccccugaccagcgugcccgugagcaccagacugguggugagcagcgaggccagcacccugagcaccacccccguggacaccagcauccccgugaccaccagcaccgaggccagcagcagccccaccaccgccgagggcaccagcauccccaccagcccccccagcgagggcaccaccccccuggccagcaugcccgugagcaccacccugguggugagcagcgaggccaacacccugagcaccacccccguggacagcaagacccagguggccaccagcaccgaggccagcagccccccccccaccgccgaggugaccagcaugcccaccagcacccccggcgagagaagcaccccccugaccagcaugcccgugagacacacccccguggccagcagcgaggccagcacccugagcaccagccccguggacaccagcacccccgugaccaccagcgccgagaccagcagcagccccaccaccgccgagggcaccagccugcccaccagcaccaccagcgagggcagcacccugcugaccagcauccccgugagcaccacccuggugaccagccccgaggccagcacccugcugaccacccccguggacaccaagggccccguggugaccagcaacgaggugagcagcagccccacccccgccgagggcaccagcaugcccaccagcaccuacagcgagggcagaaccccccugaccagcauccccgugaacaccacccugguggccagcagcgccaucagcauccugagcaccacccccguggacaacagcacccccgugaccaccagcaccgaggccugcagcagccccaccaccagcgagggcaccagcaugcccaacagcaaccccagcgagggcaccaccccccugaccagcauccccgugagcaccacccccguggugagcagcgaggccagcacccugagcgccacccccguggacaccagcacccccggcaccaccagcgccgaggccaccagcagccccaccaccgccgagggcaucagcauccccaccagcacccccagcgagggcaagaccccccugaagagcauccccgugagcaacacccccguggccaacagcgaggccagcacccugagcaccacccccguggacagcaacagccccguggugaccagcaccgccgugagcagcagccccacccccgccgagggcaccagcaucgccaucagcacccccagcgagggcagcaccgcccugaccagcauccccgugagcaccaccaccguggccagcagcgagaucaacagccugagcaccacccccgccgugaccagcacccccgugaccaccuacagccaggccagcagcagccccaccaccgccgacggcaccagcaugcagaccagcaccuacagcgagggcagcaccccccugaccagccugcccgugagcaccaugcugguggugagcagcgaggccaacacccugagcaccacccccaucgacagcaagacccaggugaccgccagcaccgaggccagcagcagcaccaccgccgagggcagcagcaugaccaucagcacccccagcgagggcagcccccugcugaccagcauccccgugagcaccacccccguggccagccccgaggccagcacccugagcaccacccccguggacagcaacagccccgugaucaccagcaccgaggugagcagcagccccacccccgccgagggcaccagcaugcccaccagcaccuacaccgagggcagaaccccccugaccagcaucaccgugagaaccacccccguggccagcagcgccaucagcacccugagcaccacccccguggacaacagcacccccgugaccaccagcaccgaggccagaagcagccccaccaccagcgagggcaccagcaugcccaacagcacccccagcgagggcaccaccccccugaccagcauccccgugagcaccacccccgugcugagcagcgaggccagcacccugagcgccacccccaucgacaccagcacccccgugaccaccagcaccgaggccaccagcagccccaccaccgccgagggcaccagcauccccaccagcacccugagcgagggcaugaccccccugaccagcacccccgugagccacacccugguggccaacagcgaggccagcacccugagcaccacccccguggacagcaacagccccguggugaccagcaccgccgugagcagcagccccacccccgccgagggcaccagcaucgccaccagcacccccagcgagggcagcaccgcccugaccagcauccccgugagcaccaccaccguggccagcagcgagaccaacacccugagcaccacccccgccgugaccagcacccccgugaccaccuacgcccaggugagcagcagccccaccaccgccgacggcagcagcaugcccaccagcacccccagagagggcagacccccccugaccagcauccccgugagcaccaccaccguggccagcagcgagaucaacacccugagcaccacccuggccgacaccagaacccccgugaccaccuacagccaggccagcagcagccccaccaccgccgacggcaccagcaugcccacccccgccuacagcgagggcagcaccccccugaccagcaugccccugagcaccacccugguggugagcagcgaggccagcacccugagcaccacccccguggacaccagcacccccgccaccaccagcaccgagggcagcagcagccccaccaccgccggcggcaccagcauccagaccagcacccccagcgagagaaccaccccccuggccggcaugcccgugagcaccacccugguggugagcagcgagggcaacacccugagcaccacccccguggacagcaagacccaggugaccaacagcaccgaggccagcagcagcgccaccgccgagggcagcagcaugaccaucagcgcccccagcgagggcagcccccugcugaccagcaucccccugagcaccacccccguggccagccccgaggccagcacccugagcaccacccccguggacagcaacagccccgugaucaccagcaccgaggugagcagcagccccauccccaccgagggcaccagcaugcagaccagcaccuacagcgacagaagaaccccccugaccagcaugcccgugagcaccaccgugguggccagcagcgccaucagcacccugagcaccacccccguggacaccagcacccccgugaccaacagcaccgaggccagaagcagccccaccaccagcgagggcaccagcaugcccaccagcacccccagcgagggcagcacccccuucaccagcaugcccgugagcaccaugcccguggugaccagcgaggccagcacccugagcgccacccccguggacaccagcacccccgugaccaccagcaccgaggccaccagcagccccaccaccgccgagggcaccagcauccccaccagcacccugagcgagggcaccaccccccugaccagcauccccgugagccacacccugguggccaacagcgaggugagcacccugagcaccacccccguggacagcaacacccccuucaccaccagcaccgaggccagcagccccccccccaccgccgagggcaccagcaugcccaccagcaccagcagcgagggcaacaccccccugaccagaaugcccgugagcaccaccaugguggccagcuucgagaccagcacccugagcaccacccccgccgacaccagcacccccgugaccaccuacagccaggccggcagcagccccaccaccgccgacgacaccagcaugcccaccagcaccuacagcgagggcagcaccccccugaccagcgugcccgugagcaccaugcccguggugagcagcgaggccagcacccacagcaccacccccguggacaccagcacccccgugaccaccagcaccgaggccagcagcagccccaccaccgccgagggcaccagcauccccaccagcccccccagcgagggcaccaccccccuggccagcaugcccgugagcaccacccccguggugagcagcgaggccggcacccugagcaccacccccguggacaccagcacccccaugaccaccagcaccgaggccagcagcagccccaccaccgccgaggacaucguggugcccaucagcaccgccagcgagggcagcacccugcugaccagcauccccgugagcaccacccccguggccagccccgaggccagcacccugagcaccacccccguggacagcaacagccccguggugaccagcaccgagaucagcagcagcgccaccagcgccgagggcaccagcaugcccaccagcaccuacagcgagggcagcaccccccugagaagcaugcccgugagcaccaagccccuggccagcagcgaggccagcacccugagcaccacccccguggacaccagcauccccgugaccaccagcaccgagaccagcagcagccccaccaccgccaaggacaccagcaugcccaucagcacccccagcgaggugagcaccagccugaccagcauccuggugagcaccaugcccguggccagcagcgaggccagcacccugagcaccacccccguggacaccagaacccuggugaccaccagcaccggcaccagcagcagccccaccaccgccgagggcagcagcaugcccaccagcacccccggcgagagaagcaccccccugaccaacauccuggugagcaccacccugcuggccaacagcgaggccagcacccugagcaccacccccguggacaccagcacccccgugaccaccagcgccgaggccagcagcagccccaccaccgccgagggcaccagcaugagaaucagcacccccagcgacggcagcaccccccugaccagcauccuggugagcacccugcccguggccagcagcgaggccagcaccgugagcaccaccgccguggacaccagcauccccgugaccaccagcaccgaggccagcagcagccccaccaccgccgaggugaccagcaugcccaccagcacccccagcgagaccagcaccccccugaccagcaugcccgugaaccacacccccguggccagcagcgaggccggcacccugagcaccacccccguggacaccagcacccccgugaccaccagcaccaaggccagcagcagccccaccaccgccgagggcaucguggugcccaucagcaccgccagcgagggcagcacccugcugaccagcauccccgugagcaccacccccguggccagcagcgaggccagcacccugagcaccacccccguggacaccagcauccccgugaccaccagcaccgagggcagcagcagccccaccaccgccgagggcaccagcaugcccaucagcacccccagcgaggugagcaccccccugaccagcauccuggugagcaccgugcccguggccggcagcgaggccagcacccugagcaccacccccguggacaccagaacccccgugaccaccagcgccgaggccagcagcagccccaccaccgccgagggcaccagcaugcccaucagcacccccggcgagagaagaaccccccugaccagcaugagcgugagcaccaugcccguggccagcagcgaggccagcacccugagcagaacccccgccgacaccagcacccccgugaccaccagcaccgaggccagcagcagccccaccaccgccgagggcaccggcauccccaucagcacccccagcgagggcagcaccccccugaccagcauccccgugagcaccacccccguggccauccccgaggccagcacccugagcaccacccccguggacagcaacagccccguggugaccagcaccgaggugagcagcagccccacccccgccgagggcaccagcaugcccaucagcaccuacagcgagggcagcaccccccugaccggcgugcccgugagcaccacccccgugaccagcagcgccaucagcacccugagcaccacccccguggacaccagcacccccgugaccaccagcaccgaggcccacagcagccccaccaccagcgagggcaccagcaugcccaccagcacccccagcgagggcagcaccccccugaccuacaugcccgugagcaccaugcugguggugagcagcgaggacagcacccugagcgccacccccguggacaccagcacccccgugaccaccagcaccgaggccaccagcagcaccaccgccgagggcaccagcauccccaccagcacccccagcgagggcaugaccccccugaccagcgugcccgugagcaacacccccguggccagcagcgaggccagcauccugagcaccacccccguggacagcaacaccccccugaccaccagcaccgaggccagcagcagcccccccaccgccgagggcaccagcaugcccaccagcacccccagcgagggcagcaccccccugaccagcaugcccgugagcaccaccaccguggccagcagcgagaccagcacccugagcaccacccccgccgacaccagcacccccgugaccaccuacagccaggccagcagcagcccccccaucgccgacggcaccagcaugcccaccagcaccuacagcgagggcagcaccccccugaccaacaugagcuucagcaccacccccguggugagcagcgaggccagcacccugagcaccacccccguggacaccagcacccccgugaccaccagcaccgaggccagccugagccccaccaccgccgagggcaccagcauccccaccagcagccccagcgagggcaccaccccccuggccagcaugcccgugagcaccacccccguggugagcagcgaggugaacacccugagcaccacccccguggacagcaacacccuggugaccaccagcaccgaggccagcagcagccccaccaucgccgagggcaccagccugcccaccagcaccaccagcgagggcagcaccccccugagcaucaugccccugagcaccacccccguggccagcagcgaggccagcacccugagcaccacccccguggacaccagcacccccgugaccaccagcagccccaccaacagcagccccaccaccgccgaggugaccagcaugcccaccagcaccgccggcgagggcagcaccccccugaccaacaugcccgugagcaccacccccguggccagcagcgaggccagcacccugagcaccacccccguggacagcaacaccuucgugaccagcagcagccaggccagcagcagccccgccacccugcaggugaccaccaugagaaugagcacccccagcgagggcagcagcagccugaccaccaugcugcugagcagcaccuacgugaccagcagcgaggccagcacccccagcacccccagcguggacagaagcacccccgugaccaccagcacccagagcaacagcacccccaccccccccgaggugaucacccugcccaugagcacccccagcgaggugagcaccccccugaccaucaugcccgugagcaccaccagcgugaccaucagcgaggccggcaccgccagcacccugcccguggacaccagcacccccgugaucaccagcacccaggugagcagcagccccgugacccccgagggcaccaccaugcccaucuggacccccagcgagggcagcaccccccugaccaccaugcccgugagcaccaccagagugaccagcagcgagggcagcacccugagcacccccagcguggugaccagcacccccgugaccaccagcaccgaggccaucagcagcagcgccacccuggacagcaccaccaugagcgugagcaugcccauggagaucagcacccugggcaccaccauccuggugagcaccacccccgugaccagauuccccgagagcagcacccccagcauccccagcguguacaccagcaugagcaugaccaccgccagcgagggcagcagcagccccaccacccuggagggcaccaccaccaugcccaugagcaccaccagcgagagaagcacccugcugaccaccgugcugaucagccccaucagcgugaugagccccagcgaggccagcacccugagcaccccccccggcgacaccagcaccccccugcugaccagcaccaaggccggcagcuucagcauccccgccgaggugaccaccaucagaaucagcaucaccagcgagagaagcaccccccugaccacccugcuggugagcaccacccugcccaccagcuuccccggcgccagcaucgccagcacccccccccuggacaccagcaccaccuucacccccagcaccgacaccgccagcacccccaccauccccguggccaccaccaucagcgugagcgugaucaccgagggcagcacccccggcaccaccaucuucauccccagcacccccgugaccagcagcaccgccgacguguuccccgccaccaccggcgccgugagcacccccgugaucaccagcaccgagcugaacacccccagcaccagcagcagcagcaccaccaccagcuucagcaccaccaaggaguucaccacccccgccaugaccaccgccgccccccugaccuacgugaccaugagcaccgcccccagcacccccagaaccaccagcagaggcugcaccaccagcgccagcacccugagcgccaccagcaccccccacaccagcaccagcgugaccaccagacccgugacccccagcagcgagagcagcagacccagcaccaucaccagccacaccaucccccccaccuucccccccgcccacagcagcaccccccccaccaccagcgccagcagcaccaccgugaaccccgaggccgugaccaccaugaccaccagaaccaagcccagcaccagaaccaccagcuuccccaccgugaccaccaccgccgugcccaccaacaccaccaucaagagcaaccccaccagcacccccaccgugcccagaaccaccaccugcuucggcgacggcugccagaacaccgccagcagaugcaagaacggcggcaccugggacggccugaagugccagugccccaaccuguacuacggcgagcugugcgaggagguggugagcagcaucgacaucggcccccccgagaccaucagcgcccagauggagcugaccgugaccgugaccagcgugaaguucaccgaggagcugaagaaccacagcagccaggaguuccaggaguucaagcagaccuucaccgagcagaugaacaucguguacagcggcauccccgaguacgugggcgugaacaucaccaagcugagacugggcagcguggugguggagcacgacgugcugcugagaaccaaguacacccccgaguacaagaccgugcuggacaacgccaccgagguggugaaggagaagaucaccaaggugaccacccagcagaucaugaucaacgacaucugcagcgacaugaugugcuucaacaccaccggcacccaggugcagaacaucaccgugacccaguacgaccccgaggaggacugcagaaagauggccaaggaguacggcgacuacuucgugguggaguacagagaccagaagcccuacugcaucagccccugcgagcccggcuucagcgugagcaagaacugcaaccugggcaagugccagaugagccugagcggcccccagugccugugcgugaccaccgagacccacugguacagcggcgagaccugcaaccagggcacccagaagagccugguguacggccuggugggcgccggcguggugcugaugcugaucauccugguggcccugcugaugcugguguucagaagcaagagagaggugaagagacagaaguacagacugagccagcuguacaaguggcaggaggaggacagcggccccgcccccggcaccuuccagaacaucggcuucgacaucugccaggacgacgacagcauccaccuggagagcaucuacagcaacuuccagcccagccugagacacaucgaccccgagaccaagaucagaauccagagaccccaggugaugaccaccagcuucuga

SEQ ID NO: 1218 - RNA, 1215 nt, Artificial Sequence
  Q9NNX6
augagcgacagcaaggagcccagacugcagcagcugggccugcuggaggaggagcagcugagaggccugggcuucagacagaccagaggcuacaagagccuggccggcugccugggccacggcccccuggugcugcagcugcugagcuucacccugcuggccggccugcuggugcaggugagcaaggugcccagcagcaucagccaggagcagagcagacaggacgccaucuaccagaaccugacccagcugaaggccgccgugggcgagcugagcgagaagagcaagcugcaggagaucuaccaggagcugacccagcugaaggccgccgugggcgagcugcccgagaagagcaagcugcaggagaucuaccaggagcugaccagacugaaggccgccgugggcgagcugcccgagaagagcaagcugcaggagaucuaccaggagcugaccuggcugaaggccgccgugggcgagcugcccgagaagagcaagaugcaggagaucuaccaggagcugaccagacugaaggccgccgugggcgagcugcccgagaagagcaagcagcaggagaucuaccaggagcugaccagacugaaggccgccgugggcgagcugcccgagaagagcaagcagcaggagaucuaccaggagcugaccagacugaaggccgccgugggcgagcugcccgagaagagcaagcagcaggagaucuaccaggagcugacccagcugaaggccgccguggagagacugugccaccccugccccugggaguggaccuucuuccagggcaacugcuacuucaugagcaacagccagagaaacuggcacgacagcaucaccgccugcaaggaggugggcgcccagcugguggugaucaagagcgccgaggagcagaacuuccugcagcugcagagcagcagaagcaacagauucaccuggaugggccugagcgaccugaaccaggagggcaccuggcaguggguggacggcagcccccugcugcccagcuucaagcaguacuggaacagaggcgagcccaacaacgugggcgaggaggacugcgccgaguucagcggcaacggcuggaacgacgacaagugcaaccuggccaaguucuggaucugcaagaagagcgccgccagcugcagcagagacgaggagcaguuccugagccccgcccccgccacccccaaccccccccccgccuga

SEQ ID NO: 1219 - RNA, 3126 nt, Artificial Sequence
  Q9NR97
auggagaacauguuccugcagagcagcaugcugaccugcaucuuccugcugaucagcggcagcugcgagcugugcgccgaggagaacuucagcagaagcuaccccugcgacgagaagaagcagaacgacagcgugaucgccgagugcagcaacagaagacugcaggaggugccccagaccgugggcaaguacgugaccgagcuggaccugagcgacaacuucaucacccacaucaccaacgagagcuuccagggccugcagaaccugaccaagaucaaccugaaccacaaccccaacgugcagcaccagaacggcaaccccggcauccagagcaacggccugaacaucaccgacggcgccuuccugaaccugaagaaccugagagagcugcugcuggaggacaaccagcugccccagauccccagcggccugcccgagagccugaccgagcugagccugauccagaacaacaucuacaacaucaccaaggagggcaucagcagacugaucaaccugaagaaccuguaccuggccuggaacugcuacuucaacaaggugugcgagaagaccaacaucgaggacggcguguucgagacccugaccaaccuggagcugcugagccugagcuucaacagccugagccacgugccccccaagcugcccagcagccugagaaagcuguuccugagcaacacccagaucaaguacaucagcgaggaggacuucaagggccugaucaaccugacccugcuggaccugagcggcaacugccccagaugcuucaacgcccccuuccccugcgugcccugcgacggcggcgccagcaucaacaucgacagauucgccuuccagaaccugacccagcugagauaccugaaccugagcagcaccagccugagaaagaucaacgccgccugguucaagaacaugccccaccugaaggugcuggaccuggaguucaacuaccuggugggcgagaucgccagcggcgccuuccugaccaugcugcccagacuggagauccuggaccugagcuucaacuacaucaagggcagcuacccccagcacaucaacaucagcagaaacuucagcaagcugcugagccugagagcccugcaccugagaggcuacguguuccaggagcugagagaggacgacuuccagccccugaugcagcugcccaaccugagcaccaucaaccugggcaucaacuucaucaagcagaucgacuucaagcuguuccagaacuucagcaaccuggagaucaucuaccugagcgagaacagaaucagcccccuggugaaggacaccagacagagcuacgccaacagcagcagcuuccagagacacaucagaaagagaagaagcaccgacuucgaguucgacccccacagcaacuucuaccacuucaccagaccccugaucaagccccagugcgccgccuacggcaaggcccuggaccugagccugaacagcaucuucuucaucggccccaaccaguucgagaaccugcccgacaucgccugccugaaccugagcgccaacagcaacgcccaggugcugagcggcaccgaguucagcgccaucccccacgugaaguaccuggaccugaccaacaacagacuggacuucgacaacgccagcgcccugaccgagcugagcgaccuggaggugcuggaccugagcuacaacagccacuacuucagaaucgccggcgugacccaccaccuggaguucauccagaacuucaccaaccugaaggugcugaaccugagccacaacaacaucuacacccugaccgacaaguacaaccuggagagcaagagccugguggagcugguguucagcggcaacagacuggacauccuguggaacgacgacgacaacagauacaucagcaucuucaagggccugaagaaccugaccagacuggaccugagccugaacagacugaagcacauccccaacgaggccuuccugaaccugcccgccagccugaccgagcugcacaucaacgacaacaugcugaaguucuucaacuggacccugcugcagcaguuccccagacuggagcugcuggaccugagaggcaacaagcugcuguuccugaccgacagccugagcgacuucaccagcagccugagaacccugcugcugagccacaacagaaucagccaccugcccagcggcuuccugagcgaggugagcagccugaagcaccuggaccugagcagcaaccugcugaagaccaucaacaagagcgcccuggagaccaagaccaccaccaagcugagcaugcuggagcugcacggcaaccccuucgagugcaccugcgacaucggcgacuucagaagauggauggacgagcaccugaacgugaagauccccagacugguggacgugaucugcgccagccccggcgaccagagaggcaagagcaucgugagccuggagcugaccaccugcgugagcgacgugaccgccgugauccuguucuucuucaccuucuucaucaccaccauggugaugcuggccgcccuggcccaccaccuguucuacugggacgugugguucaucuacaacgugugccuggccaaggugaagggcuacagaagccugagcaccagccagaccuucuacgacgccuacaucagcuacgacaccaaggacgccagcgugaccgacugggugaucaacgagcugagauaccaccuggaggagagcagagacaagaacgugcugcugugccuggaggagagagacugggaccccggccuggccaucaucgacaaccugaugcagagcaucaaccagagcaagaagaccguguucgugcugaccaagaaguacgccaagagcuggaacuucaagaccgccuucuaccuggcccugcagagacugauggacgagaacauggacgugaucaucuucauccugcuggagcccgugcugcagcacagccaguaccugagacugagacagagaaucugcaagagcagcauccugcaguggcccgacaaccccaaggccgagggccuguucuggcagacccugagaaacguggugcugaccgagaacgacagcagauacaacaacauguacguggacagcaucaagcaguacuga

SEQ ID NO: 1220 - RNA, 66 nt, Artificial Sequence
  P16671_TM_1_8-29
ggccugaucgccggcgccgugaucggcgccgugcuggccguguucggcggcauccugaugcccgug

SEQ ID NO: 1221 - RNA, 81 nt, Artificial Sequence
  P32248_TM_1_60-86
uuccugcccaucauguacagcaucaucugcuucgugggccugcugggcaacggccugguggugcugaccuacaucuacuuc

SEQ ID NO: 1222 - RNA, 66 nt, Artificial Sequence
  P16671_TM_2_440-461
cugcugggccugaucgagaugauccugcugagcgugggcguggugauguucguggccuucaugauc

SEQ ID NO: 1223 - RNA, 63 nt, Artificial Sequence
  P32248_TM_2_96-116
uaccugcugaaccuggccguggccgacauccuguuccugcugacccugcccuucugggccuac

SEQ ID NO: 1224 - RNA, 66 nt, Artificial Sequence
  P32248_TM_3_131-152
cugaucuucgccaucuacaagaugagcuucuucagcggcaugcugcugcugcugugcaucagcauc

SEQ ID NO: 1225 - RNA, 63 nt, Artificial Sequence
  P32248_TM_4_171-191
gugcugcugaucagcaagcugagcugcgugggcaucuggauccuggccaccgugcugagcauc

SEQ ID NO: 1226 - RNA, 84 nt, Artificial Sequence
  P32248_TM_5_220-247
uucaucaccauccagguggcccagauggugaucggcuuccuggugccccugcuggccaugagcuucugcuaccuggugaucauc

SEQ ID NO: 1227 - RNA, 78 nt, Artificial Sequence
  P32248_TM_6_264-289
gugaucaucgccgugguggugguguucaucguguuccagcugcccuacaacggcguggugcuggcccagaccguggcc

SEQ ID NO: 1228 - RNA, 54 nt, Artificial Sequence
  P32248_TM_7_314-331
cuggccugcgugagaugcugcgugaaccccuuccuguacgccuucaucggcgug

SEQ ID NO: 1229 - RNA, 69 nt, Artificial Sequence
  A0A5B9_TM_145-167
accauccuguacgagauccugcugggcaaggccacccuguacgccgugcuggugagcgcccuggugcug

SEQ ID NO: 1230 - RNA, 69 nt, Artificial Sequence
  B7Z8K6_TM_130-152
cugggccugagaaugcuguucgccaagaccguggccgugaacuuccugcugaccgccaagcuguucuuc

SEQ ID NO: 1231 - RNA, 63 nt, Artificial Sequence
  O00206_TM_632-652
accaucaucggcgugagcgugcugagcgugcugguggugagcgugguggccgugcugguguac

SEQ ID NO: 1232 - RNA, 66 nt, Artificial Sequence
  P01730_TM_397-418
auggcccugaucgugcugggcggcguggccggccugcugcuguucaucggccugggcaucuucuuc

SEQ ID NO: 1233 - RNA, 63 nt, Artificial Sequence
  P01850_TM_151-171
auccugcugggcaaggccacccuguacgccgugcuggugagcgcccuggugcugauggccaug

SEQ ID NO: 1234 - RNA, 78 nt, Artificial Sequence
  P07766_TM_127-152
gugaugagcguggccaccaucgugaucguggacaucugcaucaccggcggccugcugcugcugguguacuacuggagc

SEQ ID NO: 1235 - RNA, 66 nt, Artificial Sequence
  P08575_TM_576-597
gcccugaucgccuuccuggccuuccugaucaucgugaccagcaucgcccugcugguggugcuguac

SEQ ID NO: 1236 - RNA, 63 nt, Artificial Sequence
  P08637_TM_209-229
gugagcuucugccuggugauggugcugcuguucgccguggacaccggccuguacuucagcgug

SEQ ID NO: 1237 - RNA, 81 nt, Artificial Sequence
  P10747_TM_153-179
uucugggugcuggugguggugggcggcgugcuggccugcuacagccugcuggugaccguggccuucaucaucuucugggug

SEQ ID NO: 1238 - RNA, 66 nt, Artificial Sequence
  P11912_TM_144-165
aucaucaccgccgagggcaucauccugcuguucugcgccguggugcccggcacccugcugcuguuc

SEQ ID NO: 1239 - RNA, 66 nt, Artificial Sequence
  P15391_TM_292-313
gugagcgccgugacccuggccuaccugaucuucugccugugcagccuggugggcauccugcaccug

SEQ ID NO: 1240 - RNA, 63 nt, Artificial Sequence
  P16410_TM_162-182
uuccugcuguggauccuggccgccgugagcagcggccuguucuucuacagcuuccugcugacc

SEQ ID NO: 1241 - RNA, 63 nt, Artificial Sequence
  P26718_TM_52-72
cccuucuucuucugcugcuucaucgccguggccaugggcaucagauucaucaucaugguggcc

SEQ ID NO: 1242 - RNA, 63 nt, Artificial Sequence
  P30273_TM_24-44
cugugcuacauccuggacgccauccuguuccuguacggcaucgugcugacccugcuguacugc

SEQ ID NO: 1243 - RNA, 63 nt, Artificial Sequence
  P40259_TM_160-180
ggcaucaucaugauccagacccugcugaucauccuguucaucaucgugcccaucuuccugcug

SEQ ID NO: 1244 - RNA, 63 nt, Artificial Sequence
  P42081_TM_248-268
uggaucaccgccgugcugcccaccgugaucaucugcgugaugguguucugccugauccugugg

SEQ ID NO: 1245 - RNA, 63 nt, Artificial Sequence
  Q15762_TM_255-275
ggcggcaccgugcugcugcugcuguucgugaucagcaucaccaccaucaucgugaucuuccug

SEQ ID NO: 1246 - RNA, 63 nt, Artificial Sequence
  Q685J3_TM_4394-4414
cuggugggcgccggcguggugcugaugcugaucauccugguggcccugcugaugcugguguuc

SEQ ID NO: 1247 - RNA, 63 nt, Artificial Sequence
  Q9NNX6_TM_38-58
cugggccacggcccccuggugcugcagcugcugagcuucacccugcuggccggccugcuggug

SEQ ID NO: 1248 - RNA, 63 nt, Artificial Sequence
  Q9NR97_TM_828-848
gccgugauccuguucuucuucaccuucuucaucaccaccauggugaugcuggccgcccuggcc

SEQ ID NO: 1249 - RNA, 48 nt, Artificial Sequence
  P14207_1-16
augguguggaaguggaugccccugcuccugcuucuggucugcguugcc

SEQ ID NO: 1250 - RNA, 48 nt, Artificial Sequence
  O75787_1-16
auggccguguucgucguucugcucgcucugguggccggcgugcuuggg

SEQ ID NO: 1251 - RNA, 48 nt, Artificial Sequence
  P07359_1-16
augccccugcuccugcuucugcuccugcuuccuagcccgcugcacccc

SEQ ID NO: 1252 - RNA, 48 nt, Artificial Sequence
  P08637_1-16
auguggcagcugcuccugcccaccgcccuucugcuccuggugagcgcu

SEQ ID NO: 1253 - RNA, 51 nt, Artificial Sequence
  P07237_1-17
augcugagacgggcccuccugugccuugcuguggccgcgcugguccgcgcu

SEQ ID NO: 1254 - RNA, 51 nt, Artificial Sequence
  O60911_1-17
augaaccugagccucgugcuggccgcuuucugccuuggcaucgccuccgcg

SEQ ID NO: 1255 - RNA, 51 nt, Artificial Sequence
  P20138_1-17
augccccugcuccugcuucugccucuccugugggccggcgcucuugccaug

SEQ ID NO: 1256 - RNA, 51 nt, Artificial Sequence
  P27797_1-17
augcugcucagcgugccccugcuucugggccuccuggggcuugccgucgcu

SEQ ID NO: 1257 - RNA, 54 nt, Artificial Sequence
  P10747_1-18
augcugagacuccugcuugcccugaaccucuuccccagcauccaggugaccggc

SEQ ID NO: 1258 - RNA, 54 nt, Artificial Sequence
  O75487_1-18
auggccagauucggccugcccgcucuccugugcacccuugccgugcugagcgcg

SEQ ID NO: 1259 - RNA, 54 nt, Artificial Sequence
  P07996_1-18
augggccuggccugggggcucggagugcuguuccuuaugcacgucugcggcacc

SEQ ID NO: 1260 - RNA, 54 nt, Artificial Sequence
  P22748_1-18
augagaaugcugcucgcccugcuugcucugagcgccgcgcggcccuccgcuucu

SEQ ID NO: 1261 - RNA, 54 nt, Artificial Sequence
  Q15762_1-18
auggacuaccccacccugcuccuggcccuucugcacguguauagagcucucugc

SEQ ID NO: 1262 - RNA, 54 nt, Artificial Sequence
  P30273_1-18
augauccccgccgugguccugcuccugcuucugcucguugagcaggcugccgcg

SEQ ID NO: 1263 - RNA, 54 nt, Artificial Sequence
  P38570_1-18
auguggcuguuccacacccuccugugcaucgccagccuugcucugcucgccgcg

SEQ ID NO: 1264 - RNA, 54 nt, Artificial Sequence
  Q01638_1-18
augggcuucuggauccuggccauucucaccauccugauguacagcacagcugcc

SEQ ID NO: 1265 - RNA, 54 nt, Artificial Sequence; identical to SEQ ID NO: 849
  Q9NZQ7_1-18

SEQ ID NO: 1266 - RNA, 57 nt, Artificial Sequence
  P13591_1-19
augcugcagaccaaggaccucaucuggacacuguucuuucuuggcacggccgugagc

SEQ ID NO: 1267 - RNA, 57 nt, Artificial Sequence
  P26842_1-19
auggccagaccccacccuugguggcugugcgugcucggcacccuggucgggcuuagc

SEQ ID NO: 1268 - RNA, 57 nt, Artificial Sequence
  P15391_1-19
augcccccuccgagacuccuguucuuucugcuuuuccugacccccauggaggugcgg

SEQ ID NO: 1269 - RNA, 57 nt, Artificial Sequence
  Q8NI17_1-19
augauguggaccugggcccuguggaugcuccccagccugugcaaguucucccuugcu

SEQ ID NO: 1270 - RNA, 57 nt, Artificial Sequence
  P08571_1-19
auggagagagccagcugccugcuccugcuucugcucccccuggugcacgucuccgcu

SEQ ID NO: 1271 - RNA, 57 nt, Artificial Sequence
  P05154_1-19
augcagcuguuccuccugcuuugccuggugcuccugagcccccaaggcgccucccuu

SEQ ID NO: 1272 - RNA, 57 nt, Artificial Sequence
  P02787_1-19
augagacuggccgugggcgcucuccuggucugcgccguucuugggcugugucucgcg

SEQ ID NO: 1273 - RNA, 57 nt, Artificial Sequence; identical to SEQ ID NO: 857
  P02671_1-19

SEQ ID NO: 1274 - RNA, 57 nt, Artificial Sequence
  P04216_1-19
augaaccuggccaucagcauugcucuccugcuuaccgugcugcaggucuccagaggc

SEQ ID NO: 1275 - RNA, 57 nt, Artificial Sequence
  P00747_1-19
auggagcacaaggaagugguccugcuccugcuucuguuccucaaaagcggccagggg

SEQ ID NO: 1276 - RNA, 57 nt, Artificial Sequence
  P01764_1-19
auggaguucggccugagcuggcucuuucugguggccauccuuaaggggguccagugc

SEQ ID NO: 1277 - RNA, 57 nt, Artificial Sequence
  P16150_1-19
auggccacccugcuccugcuucugggcgugcucgucguuagccccgacgcucugggg

SEQ ID NO: 1278 - RNA, 57 nt, Artificial Sequence
  Q6DN72_1-19
augcugcucuggaccgccgugcugcuuuucguccccugcguuggcaagacagugugg

SEQ ID NO: 1279 - RNA, 57 nt, Artificial Sequence
  Q01151_1-19
augagcagaggccugcagcuccugcuucuguccugcgccuacucucucgcucccgcc

SEQ ID NO: 1280 - RNA, 57 nt, Artificial Sequence
  P07093_1-19
augaacuggcaccucccccuguuccugcuugccagcgugacccugccuuccaucugc

SEQ ID NO: 1281 - RNA, 57 nt, Artificial Sequence
  Q8WWQ8_1-19
augaugcugcagcaccucgugaucuucugccugggccuugucguucaaaacuuuugu

SEQ ID NO: 1282 - RNA, 60 nt, Artificial Sequence
  Q13291_1-20
auggaccccaagggccugcucagccugaccuucgugcuuuuucugucccucgccuucggg

SEQ ID NO: 1283 - RNA, 60 nt, Artificial Sequence
  P35225_1-20
auggcccugcuccugaccacagugaucgcucuuacgugccugggcggguucgccagcccc

SEQ ID NO: 1284 - RNA, 60 nt, Artificial Sequence
  P25942_1-20
auggugagacugccccuccagugcguccuguggggcugucuucugaccgccguucacccu

SEQ ID NO: 1285 - RNA, 60 nt, Artificial Sequence
  P52803_1-20
augcugcacguggagaugcucacccuggucuuccuuguucuguggaugugcguguuuagc

SEQ ID NO: 1286 - RNA, 60 nt, Artificial Sequence
  Q15116_1-20
augcagaucccccaagccccuuggccgguggucugggcuguucugcagcucggcuggaga

SEQ ID NO: 1287 - RNA, 60 nt, Artificial Sequence
  P05556_1-20
augaaccugcagcccaucuucuggauuggccucaucagcuccgugugcugugucuuugcc

SEQ ID NO: 1288 - RNA, 60 nt, Artificial Sequence
  Q12891_1-20
augagagccggccccgggccuaccgugacacuggcucucguccuggccguugcgugggcu

SEQ ID NO: 1289 - RNA, 60 nt, Artificial Sequence
  Q8IV16_1-20
augaaggcccugggcgcugugcuccuggcccuucugcucugcgggagacccggacggggc

SEQ ID NO: 1290 - RNA, 60 nt, Artificial Sequence
  Q03167_1-20
augaccagccacuacgugaucgccauuuucgcucugauguccucuugccucgccacagcg

SEQ ID NO: 1291 - RNA, 60 nt, Artificial Sequence
  Q14246_1-20
augagaggcuucaaccugcuccuguuuugggggugcugugugaugcacagcugggaggga

SEQ ID NO: 1292 - RNA, 60 nt, Artificial Sequence
  P16871_1-20
augaccauccugggcacaacguucgggaugguguuuagccuccugcaggucguuuccgga

SEQ ID NO: 1293 - RNA, 60 nt, Artificial Sequence
  P61769_1-20
augagcagauccguggcccuggcuguccucgcccugcuuucucugagcggccucgaggcg

SEQ ID NO: 1294 - RNA, 60 nt, Artificial Sequence
  Q9Y6W8_1-20
augaaaagcggccugugguacuucuuucucuucugccugagaaucaaggugcuuaccggg

SEQ ID NO: 1295 - RNA, 63 nt, Artificial Sequence
  P10966_1-21
augagaccccggcuguggcuccugcuugccgcucagcugaccgugcuccacggcaacagcguc

SEQ ID NO: 1296 - RNA, 63 nt, Artificial Sequence
  Q9BZW8_1-21
augcugggccagguggucacccucauccugcuucugcuccugaagguuuaccaagggaaagga

SEQ ID NO: 1297 - RNA, 63 nt, Artificial Sequence
  P02778_1-21
augaaccagaccgccauccugauuugcugucucaucuuccugacacuuagcggcauucaaggg

SEQ ID NO: 1298 - RNA, 63 nt, Artificial Sequence
  P18564_1-21
augggcaucgagcugcucugccuguucuuucuuuuccuggggagaaacgaccacgugcaggga

SEQ ID NO: 1299 - RNA, 63 nt, Artificial Sequence
  O14525_1-21
auggcccuggcuggccucugcgcccugcuugcguguugcugggggcccgcugccgugcuggcc

SEQ ID NO: 1300 - RNA, 63 nt, Artificial Sequence
  P01130_1-21
augggccccuggggguggaagcugagauggaccguggcccuccugcuugcugccgcgggaaca

SEQ ID NO: 1301 - RNA, 63 nt, Artificial Sequence
  P01732_1-21
auggcccugcccgugaccgcucuccugcuuccucuggcccuccugcuucacgcggcuagaccg

SEQ ID NO: 1302 - RNA, 63 nt, Artificial Sequence
  P48061_1-21
augaacgccaagguggucguugugcuggugcucguccugaccgcucuuugccugagcgacggc

SEQ ID NO: 1303 - RNA, 63 nt, Artificial Sequence
  P01589_1-21
auggacagcuaccugcucauguggggccugcuuaccuucaucauggugcccgggugccaggcc

SEQ ID NO: 1304 - RNA, 63 nt, Artificial Sequence
  Q86T13_1-21
augagaccggccuucgcucugugccuccuguggcaggcccuuuggccuggccccgggggaggc

SEQ ID NO: 1305 - RNA, 63 nt, Artificial Sequence
  Q5DID0_1-21
augcugagaaccagcggccucgcccugcuugcucugguguccgccgucgggcccucucaggcg

SEQ ID NO: 1306 - RNA, 66 nt, Artificial Sequence
  P40189_1-22
augcugacccuccagacauggcuggugcaagcccuuuucaucuuucugacgaccgagagcacaggc

SEQ ID NO: 1307 - RNA, 66 nt, Artificial Sequence
  Q86YL7_1-22
auguggaaggugagcgcccuccuguucguccugggcuccgcuucucuuuggguucuggccgagggg

SEQ ID NO: 1308 - RNA, 66 nt, Artificial Sequence
  P55075_1-22
augggcagccccagauccgcccugucuugccuccugcuucaccuccuggugcugugucuucaggcu

SEQ ID NO: 1309 - RNA, 66 nt, Artificial Sequence
  Q30201_1-22
augggccccagagcccggccugcucugcuccugcuuaugcugcuccagaccgccgugcugcaaggg

SEQ ID NO: 1310 - RNA, 66 nt, Artificial Sequence
  P07766_1-22
augcagagcggcacccacuggagagugcuggggcucugccugcuuuccgucggaguuuggggccaa

SEQ ID NO: 1311 - RNA, 66 nt, Artificial Sequence
  P18827_1-22
augagacgggccgcucuguggcucuggcugugcgcccuugcgcugagccuccagcccgcucugccu

SEQ ID NO: 1312 - RNA, 66 nt, Artificial Sequence
  P55290_1-22
augcagcccagaaccccucuggugcucugcguccugcuuagccaaguucugcuccugacauccgcc

SEQ ID NO: 1313 - RNA, 66 nt, Artificial Sequence
  P37173_1-22
augggcagagggcugcuccggggacuguggccccuucacaucgugcuguggacccgcauugccagc

SEQ ID NO: 1314 - RNA, 66 nt, Artificial Sequence
  Q07325_1-22
augaagaaaagcggcgugcuguuccuccuggggaucauucuucugguccucaucggaguucagggc

SEQ ID NO: 1315 - RNA, 66 nt, Artificial Sequence
  P04156_1-22
auggccaaccugggcugcuggaugcucgugcuguucgucgcuaccuggagcgaccuugggcugugu

SEQ ID NO: 1316 - RNA, 66 nt, Artificial Sequence
  P31785_1-22
augcugaagcccagccucccuuucaccucccugcuuuuucugcagcucccgcugcuuggcgugggg

SEQ ID NO: 1317 - RNA, 69 nt, Artificial Sequence
  P01579_1-23
augaaguacaccagcuauauccuggccuuccagcucugcauugugcugggcucccuuggguguuacugc

SEQ ID NO: 1318 - RNA, 69 nt, Artificial Sequence
  P23229_1-23
auggccgcugccggccagcugugccuccuguaccuuagcgcggggcugcucuccagacugggagcugcc

SEQ ID NO: 1319 - RNA, 69 nt, Artificial Sequence
  O60494_1-23
augaugaacaugagccugcccuuccucuggucccugcuuacccugcucaucuuugccgaggugaauggc

SEQ ID NO: 1320 - RNA, 69 nt, Artificial Sequence
  P08575_1-23
auguaccuguggcucaagcugcuugccuucggcuuugcuuuccuggacaccgagguguuugucacaggg

SEQ ID NO: 1321 - RNA, 69 nt, Artificial Sequence
  Q8IWY4_1-23
augggcgccgcugccgugagauggcaccugugcguccuccuggcgcuugggacccggggacgccuggcu

SEQ ID NO: 1322 - RNA, 69 nt, Artificial Sequence
  Q08431_1-23
augcccagaccucggcugcucgccgcucugugcggcgcccuucugugugcgccgagccuccugguggcu

SEQ ID NO: 1323 - RNA, 69 nt, Artificial Sequence
  Q99665_1-23
auggcccacaccuucagaggcugcagccuggcuuuuauguucaucauuacauggcuccugaucaaggcc

SEQ ID NO: 1324 - RNA, 69 nt, Artificial Sequence
  Q6Q8B3_1-23
augagcgcccccagacugcucaucuccauuaucauuauggugucugcuagcuccucuagcugcaugggc

SEQ ID NO: 1325 - RNA, 69 nt, Artificial Sequence
  Q07011_1-23
augggcaacagcugcuacaauaucguggccacccugcuccugguccuuaacuucgagagaacacggucc

SEQ ID NO: 1326 - RNA, 69 nt, Artificial Sequence
  Q8NHL6_1-23
augacccccauccugacagugcucauuugccugggccuuagccuggggccuagaacgcacguccaggcc

SEQ ID NO: 1327 - RNA, 69 nt, Artificial Sequence
  P36894_1-23
augccccagcuguacaucuauauuagacuccugggcgccuaccuuuucaucauuagccgggugcaaggg

SEQ ID NO: 1328 - RNA, 69 nt, Artificial Sequence
  Q16552_1-23
augacccccggcaagacaagccuggugucccuccugcuucugcucucucuggaggccaucgucaaagcu

SEQ ID NO: 1329 - RNA, 69 nt, Artificial Sequence
  P42081_1-23
auggacccccagugcaccaugggccugagcaacauccucuucgugauggccuuucugcuuuccggggcu

SEQ ID NO: 1330 - RNA, 69 nt, Artificial Sequence
  P43121_1-23
augggccugcccagacucgugugcgccuuccugcuugcugccuguugcuguugcccucgggucgcgggg

SEQ ID NO: 1331 - RNA, 69 nt, Artificial Sequence
  O00206_1-23
augaugagcgccuccagacuggcuggcacccucauccccgccauggcguuccugucuugcgugcggccu

SEQ ID NO: 1332 - RNA, 69 nt, Artificial Sequence
  P42701_1-23
auggagccccuggugaccugggucguuccucuccuguuccuuuuucugcucagcagacagggcgccgcu

SEQ ID NO: 1333 - RNA, 72 nt, Artificial Sequence
  P06729_1-24
augagcuuccccugcaaguuuguggccuccuuccugcucaucuuuaacgucucuagcaaaggcgcuguuucc

SEQ ID NO: 1334 - RNA, 72 nt, Artificial Sequence
  P15328_1-24
auggcccagagaaugaccacacaacugcuccugcuucuggugugggucgcuguugugggcgaggcccagacg

SEQ ID NO: 1335 - RNA, 72 nt, Artificial Sequence
  P05112_1-24
augggccugaccagccagcuccugcccccucuuuucuuucugcucgccugcgcugggaacuucgugcacgga

SEQ ID NO: 1336 - RNA, 72 nt, Artificial Sequence
  P06127_1-24
augcccaugggcagccugcagccucucgccacccuguaccuucuggggaugcucguggcuuccugccuggga

SEQ ID NO: 1337 - RNA, 72 nt, Artificial Sequence
  P32248_1-24
auggaccugggcaagcccaugaaaagcgugcucgucguugcccugcuugugaucuuccaggugugccugugu

SEQ ID NO: 1338 - RNA, 72 nt, Artificial Sequence
  Q7Z7D3_1-24
auggccagccugggccagauccucuucugguccauuaucucuauuaucauuauccuggcuggggccaucgcg

SEQ ID NO: 1339 - RNA, 72 nt, Artificial Sequence
  P54756_1-24
augagaggcagcgggccccggggagccggccgcagacggccuccguccgggggaggcgacacccccaucaca

SEQ ID NO: 1340 - RNA, 72 nt, Artificial Sequence
  Q92823_1-24
augcagcugaagaucaugcccaaaaagaaaagacucagcgccggccgggugccucugauucuuuuccugugc

SEQ ID NO: 1341 - RNA, 72 nt, Artificial Sequence
  P19320_1-24
augcccggcaagaugguggucauccugggggccagcaacauucucuggaucauguucgcugccucccaggcg

SEQ ID NO: 1342 - RNA, 72 nt, Artificial Sequence
  Q86UN2_1-24
augcugagaaagggcugcuguguggagcuccugcuucugcucgucgccgcugaacugccccuugggggaggc

SEQ ID NO: 1343 - RNA, 75 nt, Artificial Sequence
  P33151_1-25
augcagagacugaugaugcuccuggccaccagcggcgcuugccuugggcugcucgccguggcggcugucgccgcc

SEQ ID NO: 1344 - RNA, 75 nt, Artificial Sequence
  P17813_1-25
auggacagaggcacccugccccucgccguggcucugcuucuggccagcugcucccucucuccuacaagccuggcg

SEQ ID NO: 1345 - RNA, 75 nt, Artificial Sequence
  P25445_1-25
augcugggcaucuggacccuccugccccuugugcugacaagcgucgccagacucuccucuaagagcguuaacgcu

SEQ ID NO: 1346 - RNA, 75 nt, Artificial Sequence
  P01730_1-25
augaacagaggcgugcccuuccggcaccuccugcugguccuucagcuggcccuccugccugcugccacccaaggg

SEQ ID NO: 1347 - RNA, 75 nt, Artificial Sequence
  Q685J3_1-25
augcccagaccuggcaccauggcccugugccuccugacacuugugcugagccuccugccgccccaggcugccgcg

SEQ ID NO: 1348 - RNA, 75 nt, Artificial Sequence
  P17787_1-25
auggccagacggugcggccccguggcucugcuccugggguucggacuucugcgccucuguagcggcgucuggggg

SEQ ID NO: 1349 - RNA, 75 nt, Artificial Sequence
  Q6UQ28_1-25
auggccguguuccacgacaugcugcuccagccccugggcauguuucuuugccugagccuccaacuguccucugcu

SEQ ID NO: 1350 - RNA, 75 nt, Artificial Sequence
  P13987_1-25
augggcauccagggagggagcguucuguucggccuccugcuuguccuggccguguuuugccacuccgggcauucu

SEQ ID NO: 1351 - RNA, 75 nt, Artificial Sequence
  P10721_1-25
augagaggcgcccgcggggcuugggacuuccugugcgugcuccugcuucugcuccggguccagaccggaagcucc

SEQ ID NO: 1352 - RNA, 75 nt, Artificial Sequence
  P12319_1-25
auggcccccgcuauggagagcccuacccugcucugcguggcccugcuuuucuuugcgccggacggcguccuggcu

SEQ ID NO: 1353 - RNA, 78 nt, Artificial Sequence
  Q9BZR6_1-26
augaagagagccagcgcuggcgggucccggcugcucgccugggugcuguggcuucaggcguggcaagucgcugccccc

SEQ ID NO: 1354 - RNA, 78 nt, Artificial Sequence
  P25063_1-26
augggcagagccaugguggcucggcuggggcucggacugcuucugcucgcccugcuucugcccacccagaucuacagc

SEQ ID NO: 1355 - RNA, 78 nt, Artificial Sequence
  Q9NR97_1-26
auggagaacauguuccugcagagcuccaugcugaccugcaucuuucuccuuauuucuggcagcugugaacugugcgcc

SEQ ID NO: 1356 - RNA, 78 nt, Artificial Sequence
  Q8N131_1-26
augggccugggggccagaggagcuugggccgcgcuccugcuuggcacccuccaggugcuggcucugcuuggggccgcc

SEQ ID NO: 1357 - RNA, 78 nt, Artificial Sequence
  P49771_1-26
augaccgugcuggcccccgcuuggagcccuacaacguaccuccugcuucugcuccugcuuuccucuggccugagcggg

SEQ ID NO: 1358 - RNA, 78 nt, Artificial Sequence
  P02679_1-26
augagcuggucccugcaccccagaaaccucauccuguacuucuaugcccuucuguuucucagcucuaccugcguggcu

SEQ ID NO: 1359 - RNA, 78 nt, Artificial Sequence
  P14784_1-26
auggccgcucccgcccugagcuggagacucccucugcuuauccugcuccugccgcuugcgaccuccugggcuucugcc

SEQ ID NO: 1360 - RNA, 81 nt, Artificial Sequence
  P05362_1-27
auggcccccagcuccccuagaccggcucugcccgcccuccuggugcuucugggcgcucucuucccugggcccggaaacgcg

SEQ ID NO: 1361 - RNA, 81 nt, Artificial Sequence
  Q13740_1-27
auggagagcaagggcgccuccucuugcagacuccuguucugucugcuuaucagcgcuaccguguuucggcccgggcuggga

SEQ ID NO: 1362 - RNA, 84 nt, Artificial Sequence
  Q13443_1-28
augggcagcggggccagauuccccuccggaacccugcgggugcgcuggcuccugcuucugggccucgucgggccuguucuggga

SEQ ID NO: 1363 - RNA, 84 nt, Artificial Sequence
  P14151_1-28
augaucuuccccuggaagugccagagcacccaaagagaccuguggaacauuuuuaaacucuggggcuggacaaugcuguguugc

SEQ ID NO: 1364 - RNA, 84 nt, Artificial Sequence
  P56199_1-28
auggcccccagaccucgggcucgcccgggcguggccgucgcgugcuguuggcugcucaccguugugcugagaugcugugugagc

SEQ ID NO: 1365 - RNA, 84 nt, Artificial Sequence
  P11279_1-28
auggccgcucccggcagcgccagacggccucugcuccugcuucugcuccugcuucugcucgggcugaugcacugcgcguccgcu

SEQ ID NO: 1366 - RNA, 84 nt, Artificial Sequence
  P40259_1-28
auggccagacuggcucucagccccgugccuucccacuggauggucgcccugcuucugcuccugucugcggagccgguucccgcu

SEQ ID NO: 1367 - RNA, 84 nt, Artificial Sequence
  P43681_1-28
auggagcugggcgggcccggagccccuagacuccugccgccccuucugcuccugcuuggcaccgggcugcuccgggcuagcucc

SEQ ID NO: 1368 - RNA, 84 nt, Artificial Sequence
  P18627_1-28
augugggaggcccaguuccugggccuccuguuucuucaaccccuguggguggcuccugucaagccgcuccagcccggggccgaa

SEQ ID NO: 1369 - RNA, 84 nt, Artificial Sequence
  Q5ZPR3_1-28
augcugagacggcgcggcagccccgggaugggagugcacgucggcgccgcucucggggcccugugguucugccuuaccggagcg

SEQ ID NO: 1370 - RNA, 84 nt, Artificial Sequence
  P23415_1-28
auguacagcuucaacacccugagacucuaucugugggagacaaucguguuuuucucccuugccgcuucuaaggaagccgaggcg

SEQ ID NO: 1371 - RNA, 84 nt, Artificial Sequence
  Q8TD46_1-28
augcugugccccuggagaaccgccaaccucggccugcuucugauccucacaauuuuccugguggcugccagcuccucucuuugu

SEQ ID NO: 1372 - RNA, 87 nt, Artificial Sequence
  P17301_1-29
augggccccgagagaaccggggccgcuccucugccgcuccugcuugugcuggcccucagccagggaauccugaacugcugucuugcg

SEQ ID NO: 1373 - RNA, 87 nt, Artificial Sequence
  P12821_1-29
augggcgccgcuagcgggagacggggacccggccugcuccugccucuuccgcugcuccugcuucugcccccucagcccgcccucgcg

SEQ ID NO: 1374 - RNA, 87 nt, Artificial Sequence
  Q14118_1-29
augagaaugagcgugggccugucccuccugcuuccccugugggggcggaccuuccuccugcuucugucugucguuauggcccagagc

SEQ ID NO: 1375 - RNA, 87 nt, Artificial Sequence
  P05231_1-29
augaacagcuucuccaccucugccuuuggccccguggcuuucagccuggggcuccugcuuguccugccugccgcguuuccggcuccc

SEQ ID NO: 1376 - RNA, 87 nt, Artificial Sequence
  O00602_1-29
auggagcugagcggcgccaccauggcuagagggcucgccgugcugcuuguccuguuccuccacaucaagaaccugcccgcgcaggcu

SEQ ID NO: 1377 - RNA, 87 nt, Artificial Sequence
  Q9Y6Q6_1-29
auggcccccagagcucggcgcagacggccucuguucgcccuccugcuucugugcgcgcuccuggcucgccuucagguggcccugcaa

SEQ ID NO: 1378 - RNA, 87 nt, Artificial Sequence
  Q9ULI3_1-29
auggccagccccagagcuucccgguggccuccgccccuccuccugcuucugcucccucugcuucugcugcccccugccgcgcccggc

SEQ ID NO: 1379 - RNA, 90 nt, Artificial Sequence
  Q8NBP7_1-30
augggcaccgugagcuccagacggucuugguggccccugccucuccugcuucugcuccugcuucugcucgggccggccggagcucgcgcc

SEQ ID NO: 1380 - RNA, 90 nt, Artificial Sequence
  P02675_1-30
augaagagaauggugagcugguccuuccacaaacugaagaccaugaaacaucuccugcuucugcuccugugcgucuuucuuguuaagucu

SEQ ID NO: 1381 - RNA, 90 nt, Artificial Sequence
  P06756_1-30
auggccuucccucccagacggcgccugagacucggcccgcgggggcugccccuucugcucagcggacugcuucugccucucugccgcgcu

SEQ ID NO: 1382 - RNA, 93 nt, Artificial Sequence
  O60609_1-31
auggugagaccccugaacccucggccgcugcccccugucguucucaugcuucugcuccugcuucccccuagcccccugccucucgccgcuggc

SEQ ID NO: 1383 - RNA, 93 nt, Artificial Sequence
  P50895_1-31
auggagcccccugacgccccggcucaggccagaggcgcgccccggcugcuccugcuugcugugcugcucgccgcccacccugaugcucaagcc

SEQ ID NO: 1384 - RNA, 93 nt, Artificial Sequence
  P28906_1-31
augcuggugagacggggcgcccgcgcugggcccagaaugccucggggauggaccgcccucugccugcuuagccugcucccguccggcuucaug

SEQ ID NO: 1385 - RNA, 93 nt, Artificial Sequence
  P08514_1-31
auggccagagcucugugcccccuccaggcccuguggcuucuggagugggugcuccugcuucugggcccuugugcggcuccgcccgccugggcc

SEQ ID NO: 1386 - RNA, 93 nt, Artificial Sequence
  P00742_1-31
augggcagaccccugcaccucgugcugcuuagcgccucccuggcugggcuccugcuucugggagagucucucuucauccggcgcgaacaggcc

SEQ ID NO: 1387 - RNA, 96 nt, Artificial Sequence
  P26006_1-32
augggccccgggccuagcagagccccgcgggcuccccgccugaugcucugcgcccuggcgcuuaugguggcugccggaggcugugucguuuccgcc

SEQ ID NO: 1388 - RNA, 96 nt, Artificial Sequence
  P13726_1-32
auggagacccccgccuggccuagagugccgcggcccgaaacagcugucgcccgcacgcugcuccugggcuggguuuucgcucagguggcgggggcc

SEQ ID NO: 1389 - RNA, 96 nt, Artificial Sequence
  P11912_1-32
augcccggcgggccuggagugcugcaggcccucccggcuaccaucuuccugcuuuuucugcucagcgccgucuaccugggccccgggugccaagcg

SEQ ID NO: 1390 - RNA, 96 nt, Artificial Sequence
  Q9H6X2_1-32
auggccaccgcugagagacgggcccugggcaucggguuccaguggcucagccuggcgacacuugugcugauuugcgcuggacaaggcgggcgcaga

SEQ ID NO: 1391 - RNA, 99 nt, Artificial Sequence
  Q8IWK6_1-33
auggagcccccuggcagacggcgcgggagagcccagccgccccugcuccugccucuuagccugcucgcucugcuugcccugcucggaggcgggggaggc

SEQ ID NO: 1392 - RNA, 99 nt, Artificial Sequence
  P58335_1-33
augguggccgagagaagccccgcucgguccccuggcucuuggcuguucccggggcucuggcugcuuguccugagcggacccggcgggcuccugcgcgcc

SEQ ID NO: 1393 - RNA, 102 nt, Artificial Sequence
  P06731_1-34
auggagagccccuccgccccuccgcacagauggugcauccccuggcagcggcugcuccugaccgcuucucuucugacauucuggaacccucccacgaccgcc

SEQ ID NO: 1394 - RNA, 102 nt, Artificial Sequence
  P33681_1-34
augggccacaccagacggcaggggacaagccccuccaagugcccuuaccugaacuucuuucaacuccuggugcuugccggacugucucauuucuguagcggc

SEQ ID NO: 1395 - RNA, 105 nt, Artificial Sequence
  P38567_1-35
augggcgugcugaaguucaaacacaucuuuuucagauccuuugucaagagcucugggguuagccagauuguguucaccuuucuccugauccccugcugucuuaca

SEQ ID NO: 1396 - RNA, 105 nt, Artificial Sequence
  P16410_1-35
auggccugccugggcuuccagagacacaaggcucaacucaaccuggccacccggacauggcccuguacgcuucuguuuuuccuccuguuuaucccuguguucugc

SEQ ID NO: 1397 - RNA, 111 nt, Artificial Sequence
  P15814_1-37
augagacccggcaccgggcagggaggccuggaggccccuggggaaccgggacccaaccuccggcaacgcuggccucugcuucugcucggccuggcuguggucacacacggg

SEQ ID NO: 1398 - RNA, 114 nt, Artificial Sequence
  Q92956_1-38
auggagcccccuggcgacugggggccgcccccuuggagaagcacccccaagacagaugugcugcggcucguccuguaccuuacguuccugggagccccuugcuaugcucccgcc

SEQ ID NO: 1399 - RNA, 123 nt, Artificial Sequence
  Q86VB7_1-41
augagcaagcugagaauggugcuccuggaggacuccggcucugccgauuuccggcgccacuuugucaaccuuagccccuucaccaucacaguugugcugcuccuguccgcuugcuuugugacg

SEQ ID NO: 1400 - RNA, 123 nt, Artificial Sequence
  P08648_1-41
augggcagcagaacccccgaguccccucugcacgccgugcagcuccggugggggccgcgcagacggcccccucugcuuccccugcuccugcuucugcucccucccccuccgcgcgucggaggc

SEQ ID NO: 1401 - RNA, 123 nt, Artificial Sequence
  P16109_1-41
auggccaacugccagaucgcuauucuguaccaaagauuccagcggguggucuuuggcaucagccagcuccuguguuucuccgcccuuauuucugagcugaccaaucagaaggaaguugcggcu

SEQ ID NO: 1402 - RNA, 132 nt, Artificial Sequence
  O75326_1-44
augaccccucccccgcccggcagagccgcuccuagcgcgccccgggcccgcgugccugggcccccugcuagacugggacucccgcugcggcuucgccugcuccugcuucugugggccgccgcugccuccgcu

SEQ ID NO: 1403 - RNA, 135 nt, Artificial Sequence
  Q8N2Q7_1-45
auggcccugcccagaugcaccuggccuaacuacguguggcgggcugucauggccugucucguucaccgcggccugggggcgccgcuuacacugugcaugcucggaugucugcuucaggcuggccaugugcugagc

SEQ ID NO: 1404 - RNA, 138 nt, Artificial Sequence
  Q86UN3_1-46
augcugcccggccucagacggcugcuucaggccccugcuagcgccugccugcuccugaugcuucuggcgcucccgcuggcugcccccuccuguccuaugcugugcaccuguuacucuagcccucccacaguguccugc

SEQ ID NO: 1405 - RNA, 540 nt, Artificial Sequence
  A0A5B9
auggaccugaagaacguguuucccccugaggucgccguuuucgaaccgagcgaggcugaaaucucccacacccagaaagccacacucgugugccuggcgacgggcuucuaccccgaucauguggagcuuucuuggugggucaaugggaaggaagugcacagcggaguuuccaccgacccucaaccccugaaagagcagccugcucucaacgauucuagauauugucugagcucccggcuucgcgugucugccacauuuuggcagaaucccagaaaccauuuccggugccagguccaauuuuacggccugagcgagaaugacgaauggacccaggaucgcgccaagccugugacacagauuguuuccgcugaggccugggggagagcugacuguggauucaccagcgaaucuuaucagcaaggcgugcucuccgccacaauccuguacgagauucugcucgggaaagcgacccuguaugccguccuugugagcgcucuggugcucauggccauggucaagcggaaggauucucgcggauga

SEQ ID NO: 1406 - RNA, 465 nt, Artificial Sequence
  B7Z8K6
augagccagccccacaccaagccuuccguguucgucaugaaaaacggcacaaauguugccugccuggugaaggaguuuuacccgaaagacaucagaauuaaccucgugucuagcaagaaaaucacggaguucgaucccgcuauugucaucuccccuucugggaaguauaaugccgugaagcugggaaaauacgaagacagcaacuccguuaccuguucugugcaacaugauaauaagacaguccacagcaccgacuuugaagugaaaacagauuccaccgaccauguuaagcccaaagagacagaaaacaccaagcagccuagcaagucuugccacaaacccaaggcgauugugcauacggagaaagucaauaugaugucccuuaccgugcugggccuccggaugcuguucgcuaagacaguggccgucaacuuucuucugaccgccaaacucuucuuucuguga

SEQ ID NO: 1407 - RNA, 645 nt, Artificial Sequence
  B9A064
augagacccaagaccggccagguggggugcgagacaccugaggaacugggaccgggcccccggcaacgcuggccucuccugcuucuggggcucgccauggucgcucacggacugcuuagacccaugguugccccucagagcggcgaccccgauccuggggcguccgugggaucuagccgguccucucugcgcagccucuggggcagacugcugcuccagccgucuccccagcgggcugacccucgcuguuggcccagaggcuucugguccgaaccucaaagccugugcuacguguuugggacgggaaccaaagucacagugcuuggccagcccaaggccaacccgaccguuacacuguucccucccuccagcgaggaacuccaggccaauaaagcuacccuggugugucuuaucucugauuuuuauccuggggccgucacaguggcuuggaaggccgacggaucccccguuaaagcgggcguggagaccacgaagcccagcaagcagucuaacaauaaauacgccgcuuccagcuaucugucucucaccccugagcaauggaagucccaucggagcuacuccugccaggucacacacgaagggucuaccguggagaaaacaguggccccgaccgaauguagcuga

SEQ ID NO: 1408 - RNA, 2520 nt, Artificial Sequence
  O00206
augaugagcgccuccagacuggcuggcacccucauccccgccauggcguuccugucuugcgugcggccugagagcugggaaccgugugucgagguugugcccaacauuacauaccagugcauggaacuuaauuuuuauaagaucccugacaaccugcccuucuccacgaaaaaucucgaucugucuuuuaacccucuucgccaccuggggagcuacuccuucuuuucuuuccccgagcuccaagugcuggaccugagcagaugugaaauucagaccaucgaggauggagcuuaucagucccucagccaucugucuacacuuauucugaccggcaauccuauccagucccucgcccugggggccuuuagcggacuuucuucccugcaaaagcucgucgcuguggagacaaaccuggccagccuggaaaauuucccgaucggccaccucaaaacccugaaggagcuuaacguugcucauaaucugauucagucuuuuaaacuccccgaauacuucuccaaccugacaaaucuugagcaccuggaccucagcuccaacaagauccagucuauuuauugcaccgaucugcgggugcugcaucagaugccucuccugaaucuuagccuggaccucucccugaaccccaugaauuuuauccaaccuggggccuucaaggagauucgccuucacaaacugacgcucagaaacaacuuugauagccugaaugucaugaagaccuguauccagggacuggcgggccucgaagugcaccggcugguucuuggcgaguuccgcaacgaagggaaucuggagaaauucgacaagucugcccucgaaggacugugcaaccugacaauugaggaguuuagacuugcuuaccucgauuauuaccuggacgauaucaucgaccuguucaauugucucaccaacguguccagcuuuucucuggucagcgugacaauugaacgggugaaagauuucuccuacaauuuuggcuggcagcaucuugagcuggucaacugcaaguucgggcaguuucccacccucaagcugaaaucucugaagcgccuuacguucacaagcaauaaaggaggcaacgccuuuuccgaaguugaccucccgagccuggaguuccuggaccucucuagaaaugggcuguccuuuaagggauguugcagccaaucugauuucggcaccacaucccuuaaauaucuggaccucagcuuuaacggcgugaucaccauguccucuaauuuccuggggcuggaacagcuugagcaccucgauuuccagcauagcaaccugaagcaaauguccgaguuuucuguguuccugagccuccggaaucugauuuaccuugacaucucccacacccacacacgcgucgcuuuuaacggaauuuucaacggccugagcucucucgaagugcugaaaauggccggaaauuccuuucaggagaacuuccugccugauaucuuuacggaacuuagaaaucucaccuuccuggaccugagccagugucagcucgagcaacugucucccacagcguuuaacucccuuagcucucugcagguucucaauaugagccauaacaauuucuuuucccuggauaccuucccuuauaagugccugaacagccuucaggugcuggacuacucucucaaucacaucaugacauccaagaaacaggaacugcaacauuuucccagcucccucgccuuccugaaccuuacccagaaugauuucgcuugcacgugugagcaccagucuuuucugcaguggauuaaggaccaacggcagcuccuggucgagguggaacgcauggagugcgccacacccagcgauaaacaggggaugccuguucugucccuuaacaucaccugucagaugaauaagaccauuaucggcgugucuguccugagcgugcucgucguguccguuguggcuguccugguguauaaauucuacuuucaucucaugcugcuugccgggugcauuaaguauggaagaggcgaaaacaucuacgacgccuucguuaucuacucuagccaagacgaggauugggugcggaaugagcuggucaagaaccucgaagagggcgugccgcccuuucagcugugucugcacuauagagacuucauuccugggguggcuaucgcggccaacauuauccacgaaggauuucauaaaucccgcaagguuauugucguggugagccagcacuucauccaaucucgguggugcauuuuugaguacgaaaucgcucagacauggcaguuccuuuccagcagagccggcaucauuuuuaucguccugcagaaaguggagaagacccuccugcgccaacagguugagcucuaucggcugcuuucuagaaauacauaccuggaaugggaggauuccgugcuggggcgccauauuuucuggcggagacuccgcaaagcccugcuugacggaaagagcuggaaccccgaaggcacggucgggaccggcuguaauuggcaggaggcuacaucuaucuga

SEQ ID NO: 1409 - RNA, 1377 nt, Artificial Sequence
  P01730
augaacagaggcgugcccuuccggcaucugcuccugguccuucagcuggcccuccugccugcugccacccaagggaagaaaguugugcuuggaaagaaaggcgacacaguggagcugacgugcaccgcgagccagaagaaauccauccaguuucacuggaaaaauucuaaccagauuaagauccucgggaaucaaggcagcuuccugacaaaaggaccguccaagcugaacgaucgcgcugacucuagacggagccucugggaucaggggaauuuuccccugauuaucaaaaaccuuaagauugaagacuccgauaccuacaucugugaggucgaagaccagaaagaggaagugcagcugcucguuuucggacugacagccaauucugauacccaccuucugcaaggccagagccucacacugacccuggaguccccucccggcagcucuccuuccgugcagugccgcagccccagagggaagaacauccagggaggcaagacgcucucugucucccaacuggagcuucaggacagcgggaccuggacauguaccgugcugcagaaucaaaagaagguugaauuuaaaauugauaucgugguccucgccuuccagaaggcuucuuccauuguguauaaaaaggagggagaacagguggaguuuagcuucccucuggccuuuacagucgagaaacuuaccggcuccggggaacugugguggcaggcugagcgggccucuagcuccaagagcuggaucacguucgaccucaagaacaaagaaguuucugugaagcgcgugacacaagauccgaaacugcagaugggaaagaaacugccccuccaucugacccuuccucaggcgcugccccaguacgccggcuccggcaaucucacacuggcucuugaggccaagaccgggaagcugcaccaagaagucaaccucgugguuaugagagcuacccagcugcagaaaaaucugacaugcgagguguggggaccuacgagccccaagcucaugcugucucuuaaacuggagaacaaggaagccaaagucagcaagcgggagaaggcgguguggguucucaauccggaagccggcauguggcagugucugcuguccgacucugggcaagugcuucucgagagcaacauuaaaguccugccuaccugguccacacccgugcagccuauggcucugaucguccucggaggcguggccgggcugcuucuguuuauuggacucggcaucuucuuuugcguucgcuguagacaucggcgcagacaggcugaacggaugagccagaucaagcgccugcugucugagaaaaagaccugccaauguccccacagauuccagaaaacaugcucccccauuuga

SEQ ID NO: 1410 - RNA, 537 nt, Artificial Sequence
  P01850
auggaggaccugaacaagguguuucccccugaagucgccguuuucgagccgagcgaagcugagaucucccacacccagaaagccacacucgugugccuggcgacgggcuucuuucccgaucauguggaacuuucuuggugggucaaugggaaggaggugcacagcggaguuuccaccgacccucaaccccugaaagagcagccugcucucaacgauucuagauacugucugagcucccggcuucgcgugucugccacauucuggcagaaucccagaaaccauuuucggugccagguccaauucuauggccugagcgaaaaugacgaguggacccaggaucgcgccaagccugugacacagauuguuuccgcugaagccugggggagagcugacuguggauuuaccagcgugucuuaccagcaaggcguccucuccgccacaauccuguaugagauucugcucgggaaagcgacccuguacgccgugcuugugagcgcucugguccucauggccaugguuaagcggaaggauuucuga

SEQ ID NO: 1411 - RNA, 624 nt, Artificial Sequence
  P07766
augcagagcggcacccacuggagagugcuggggcucugccugcuuuccgucggaguuuggggccaagacgggaacgaggaaaugggaggcaucacacagacgcccuacaaggugucuauuagcgggaccacagugauccugaccuguccucaguauccgggauccgagauucucuggcagcauaaugauaaaaacaucggcggcgacgaagaugacaagaauauugggucugaugaggaccaccugagccuuaaagaguucuccgaacuggagcaaucuggauacuaugucugcuacccccggggcagcaagccugaagaugccaacuuuuaucucuaccugcgcgcuagagugugugagaauugcauggaaauggacguuauguccguggccacaaucgucaucguggauauuuguaucaccgggggacugcuccugcuuguuuauuacuggagcaaaaaccggaaggcgaaggcuaaacccgugacacgcggcgccggggccggaggcagacagcggggccagaauaaggagcgcccucccccugucccgaaccccgacuacgagccuauuagaaaagggcagcgggaucuguauucuggacucaaucaacgcagaaucuga

SEQ ID NO: 1412 - RNA, 3915 nt, Artificial Sequence
  P08575
auguaccuguggcucaagcugcuugccuucggcuuugcuuuccuggacaccgagguguuugucacagggcagagccccacgccuuccccgaccggacucacaaccgccaaaaugcccucuguuccucugagcuccgauccccuuccuacacacaccacagcguucucucccgcuagcaccuuugaaagagagaacgacuucuccgaaacgaccacaucucugagcccugauaauaccuccacacaagugagcccggacucucucgauaacgccuccgccuuuaauaccacgggcgugagcucuguccagacaccccaucugccuacccacgcugacucccagacacccagcgccgggaccgauacccagacauucucuggauccgcugccaacgcgaagcugaauccuacgcccggcagcaacgccaucuccgacgugccgggggagcggucuaccgcuagcacauuuccuaccgaucccguuuccccucucacaaccacgcugagccuugcccaucacucuuccgcugcccugcccgcgcgcacaagcaauaccaccauuacagccaacaccucugacgcuuaucucaaugccagcgaaacaacgacccugucccccucuggaagcgcugugaucuccacaaccacaauugccaccacgccuagcaaaccgaccugcgaugagaaguacgccaacaucacagucgacuaucuuuacaauaaagagaccaagcuguucacagcuaagcucaacgugaaugaaaacguugaguguggcaauaauaccugcacgaacaacgaagugcauaaccugacagaguguaaaaaugcgucugucuccauuagccacaacucuugcaccgcccccgauaagacacugauccucgacgugccucccggcguggagaaauuucaacugcacgacuguacccaggucgaaaaggcugauaccacaaucugccuuaaauggaagaauauugagacguucaccugugacacacagaacaucaccuauagauuucagugcgggaauaugauuuucgauaacaaggaaaucaaacuggagaaucucgaaccugagcaugaguacaagugugacuccgaaauucuguauaacaaucacaaauucacaaacgccagcaagaucauuaaaaccgauuuuggaucccccggcgagccgcaaaucaucuucugccggucugaagccgcucaucaggggguuauuacguggaauccuccccagcgcagcuuucacaacuucacacuuuguuacaucaaggagaccgaaaaagacugccugaaucucgauaagaaccugauuaaguacgaccugcagaaccucaaaccuuauaccaaguacgugcugucccuucacgccuauaucauugcgaaagugcaaagaaauggaucugcugccaugugccauuuuacaaccaagagcgcucccccuucccaggucuggaacaugacagugagcaugacgucugauaauuccaugcacguuaaaugucggcccccgcgcgacagaaacggcccucaugagcgguaccaccuggagguggaagccgggaauacccucguccgcaacgagagccauaagaauugcgauuucagagugaaggaccugcaguauucuacagacuacaccuuuaaagccuauuuccacaacggagauuaccccggcgaacccuuuauccuucaccauuccacaagcuacaauucuaaggcucugaucgccuuccucgcguuucugauuaucguuaccagcauugcccugcucgugguccuguauaaaaucuacgaccuucacaagaaacgguccuguaaccuggaugagcaacaggaacucguggagcgcgacgaugagaagcagcugaugaaugucgaaccuauucaugcugacauccugcuugagacguauaagagaaaaaucgccgaugaaggccgccucuuccuggcugaguuucagagcauuccgcggguguucucuaaguuccccaucaaagaggccagaaagccuuuuaaccaaaauaaaaaccgguacguugacauucugcccuaugauuacaauagaguggaacucuccgagaucaacggggacgcgggaagcaacuauauuaaugccuccuacaucgauggcuucaaggaaccucgcaaguacauugcugcccaggggccccgggacgagaccgucgaugacuuuuggagaaugaucugggaacagaaagcuacagugaucguuauggugacccgcugcgaggagggaaaccggaauaagugugccgaauauuggccuucuauggaggaaggcacaagagccuucggggacgucguggugaaaauuaaccagcacaagcgcugccccgauuacaucauucaaaaacugaauaucguuaacaagaaagagaaggcuaccggacgggaagucacacacauucaguuuaccagcuggccggaccauggcgugccugaggauccccaccuucugcucaagcugagacgccgggugaaugcguucuccaacuuuuucucuggcccuaucgucgugcauuguagcgccgggguuggaagaacgggcacauauaucgggauugacgcuaugcuggagggacuugaagccgagaauaaaguggaugucuacggcuaugugguuaagcuccgccggcagagaugccugauggugcaggucgaagcccaauacauccugauucaccaggcucucguggaguauaaccaguuuggggaaaccgagguuaaucuguccgagcuucaucccuaccugcacaacaugaaaaagcgggacccgccuucugaacccagcccucucgaggccgaguuccagcgccugcccuccuacagaagcuggcggacccaacacaucggcaaucaggaagagaacaaaucuaagaauagaaacuccaacgugauucccuaugauuacaaucgcgucccucugaagcaugaacuugagaugagcaaagaaucugagcacgacuccgaugaaagcucugacgaugacuccgauagcgaggagccguccaaguauaucaacgcgagcuuuaucaugucuuacuggaaacccgaagugaugauugcugcccagggaccucucaaggagacaaucggcgacuucuggcaaaugauuuuucagcggaaagugaaggucaucguuaugcugaccgaacugaagcauggggaccaggagauuugugcccaguauuggggagaaggcaaacaaacguacggggauaucgagguggaccucaaggauacagacaaaagcuccaccuauacacugagaguguucgagcuucgccacucuaagagaaaagauagccggaccgucuaccaguaccaguauacaaauugguccguggaacagcugcccgcugagccuaaggaacucaucucuaugauucaaguugugaagcagaaacugccccagaagaacagcuccgagggaaauaaacaucacaagucuaccccucugcuuauccacugccgcgacggcagccagcaaacggggauuuucugugcccuccugaaccugcucgaauccgcggagaccgaggaagucguggauaucuuucagguugugaaagcucugagaaaggcccggccgggcauggucagcacauucgagcaguaccaauuucuuuaugacgugauugccucuaccuaccccgcucagaauggacagguuaaaaagaacaaucaucaggaagauaagaucgaguucgacaacgagguggauaaagucaagcaagacgccaauugcgugaacccucugggcgcucccgaaaaacucccugaggccaaggaacaggcggagggguccgaacccacaagcggaaccgagggcccggagcacucugugaaugggccugccucccccgcucugaaccagggaagcuga

SEQ ID NO: 1413 - RNA, 765 nt, Artificial Sequence
  P08637
auguggcagcugcuccugcccaccgcccuucugcuccuggugagcgcuggcaugagaacagaggaccuuccuaaggccgucguuuuccuggaaccgcaaugguaccgggugcucgagaaagauuccgugacgcugaagugccagggggcguauucucccgaagacaacagcacccagugguuucacaaugagucccugaucucuagccaggcuuccucuuacuucauugaugccgccacagucgacgauagcggagaauaucgcugucaaaccaaccucuccacacugagcgacccugugcagcuugagguucauaucggcuggcugcuccugcaggcucccagauggguguuuaaagaggaagauccuauucaccuucggugccauucuuggaagaauaccgcccugcacaaagucacauaccuccagaacgggaagggacgcaaguauuuccaucacaauuccgacuuuuacauccccaaagcuacccugaaggauagcggcucuuauuucuguagagggcuguuuggauccaaaaacgugagcucugagacgguuaauauuaccaucacacaaggccucgccguguccaccaucagcuccuucuuuccuccgggcuaccaggucucuuucugccuggugauggugcuucuguuugcggucgacacagggcucuacuucagcguuaagaccaacauucgguccagcacgcgcgauuggaaagaccacaaguuuaaguggagaaaagauccccaggacaaguga

SEQ ID NO: 1414 - RNA, 663 nt, Artificial Sequence
  P10747
augcugagacuccugcuugcccugaaccucuuccccagcauccaggugaccggcaauaagauucuggucaaacaauccccuaugcuuguugcuuacgacaacgccgugaaucugucuugcaaguauagcuacaaccucuuuucccgggaguuccgcgcgucucugcacaaagggcuggauagcgcuguggaagucugugugguuuauggaaauuacucccagcagcuccagguguauucuaagacaggcuuuaacugcgacgggaaacugggaaaugagagcgucacguucuaccuucaaaaccuguaugugaaucagaccgauaucuacuuuuguaagauugaaguuauguacccgcccccuuaucucgacaacgagaaguccaauggcacaaucauucaugugaaagggaagcaccugugccccagcccucuuuuccccggaccuucuaaaccguuuuggguccuggugguggucggcggcguucucgccuguuacucccugcuggugaccguggccuucaucaucuuuugggucagaagcaagcggucucgccuccugcauuccgauuauaugaacaugacacccagacggccugggcccacccgcaaacacuaccagccuuaugcucccccgagagacuucgccgcuuaccggagcuga

SEQ ID NO: 1415 - RNA, 681 nt, Artificial Sequence
  P11912
augcccggcgggccuggagugcugcaggcccucccggcuaccaucuuccugcuuuuucugcucagcgccgucuaccugggccccgggugccaagcgcuuuggaugcacaagguuccugcuucccugauggugucucucggagaggacgcccauuuccaguguccccacaacagcuccaauaacgccaaugugacaugguggagaguccugcauggcaacuauacguggccucccgaauuucuggggccuggagaggauccgaauggcacccucauuauccagaacgugaauaaaucucacggcgggauuuacguuugccgggugcaggaaggaaacgagagcuaucaacaguccuguggcacauaccugcgcgucagacagcccccuccccggccuuuccuugacaugggggaaggaaccaagaaucgcaucauuacagcugagggcaucauccugcucuuuugcgccgugguucccgggacccugcuucuguucagaaaacgguggcagaacgagaagcucggacuggaugcuggcgacgaauaugaggaugaaaaucuguacgagggccucaaccuggacgauuguucuauguaugaggacauuagccgcgggcuucaaggaacauaccaggaugugggcucccugaauaucggggacguccagcucgaaaaaccguga

SEQ ID NO: 1416 - RNA, 1671 nt, Artificial Sequence
  P15391
augcccccuccgagacugcuguucuuucugcuuuuccugacccccauggaggugcggccugaggaaccccucgucguuaagguggaagagggcgacaacgccgugcugcagugccuuaaagggacaagcgauggaccuacgcaacagcugaccuggucccgcgaaucuccccucaagccuuuucugaaacugagccucggccugccggggcuuggaauccacaugagaccccuggcuauuuggcucuuuaucuuuaaugucucccagcagaugggcggguucuaccugugucaaccuggacccccuucugagaaggccuggcagcccggcuggacagugaacguugagggcagcggggaacuuuuucgguggaauguguccgaccugggaggccucgggugcggacugaaaaaccgcucuagcgagggcccguccagcccuucugggaagcugaugucccccaagcucuaugucugggcgaaagauagaccugaaauuugggagggagagccucccugucugcccccgcgggacagccuuaaucagucucugucccaggaucucaccauggcucccggcagcacacuguggcuuucuugcggcgugccucccgacuccguuagccgcgggccucuguccuggacccaugugcaccccaagggaccgaaaucucuccugagccuggaacucaaggaugacagaccugcccgggauaugugggucauggagacaggccugcuucugccccgcgccaccgcucaagacgccgggaaauacuauugucauagaggaaaccucacgauguccuuccaccuggaaaucaccgcucggccugugcuuuggcauuggcugcuccgcacaggcggguggaaggugagcgccgucacccuggcguaccugauuuucugccucuguucucugguuggaauccuucaccuccagagagcccucgugcugcggcgcaagagaaaacggaugacagaucccaccagacgcuucuuuaaggugacgccucccccgggcuccggcccucagaaucaguaugggaacguccugagccuucccacacccaccucuggacucggccgggcucaaagaugggccgcugggcugggaggcacagccccuagcuacgggaauccguccucugacgugcaggcggauggcgcccugggaagccgcuccccucccggcguugggcccgaggaagaggagggagaaggcuaugaggaaccugacagcgaggaagacucugaguucuacgagaacgauuccaaucucgggcaggaccaacugagccaggauggaucuggcuacgaaaaccccgaggacgaaccucuugggcccgaggaugaagacuccuuuagcaaugcugaguccuaugagaacgaagaugaggaacugacccagccgguggcccggaccauggacuuccucucuccucacggcagcgcuugggaucccuccagagaggccacaucucugggaagccaguccuacgaggacaugcgcggcauccuguaugccgcuccucaacuucggagcauuagagggcagcccggaccgaaucaugaagaggaugcggacucuuacgaaaacauggacaacccugauggccccgacccugccuggggagggggcgggcgcaugggcacgugguccacccgguga

SEQ ID NO: 1417 - RNA, 672 nt, Artificial Sequence
  P16410
auggccugccugggcuuccagagacacaaggcucaacucaaccuggccacccggacauggcccuguacgcuucuguuuuuccuccuguuuaucccuguguucugcaaagcgaugcaugucgcucagccggccguugugcuugccagcucccgcgggauugcuucuuuugugugugaguacgccagccccggaaaggcuaccgaagucagagugacaguucugcggcaggccgacucccaggugaccgaggucugcgcggccacauauaugaugggcaaugaacucaccuuccuggaugacucuaucuguacagggaccagcuccggaaaccaagugaaucugacgauucagggccuccgcgcuauggauaccgggcuguacaucugcaaaguugagcuuauguauccucccccuuacuaucugggaauuggcaacggcacacagaucuacgugaucgaccccgaaccuuguccggauucugacuuucuccuguggauucuugccgcugucagcuccgggcuguucuuuuauagcuuccuccugaccgccgugucucuguccaagaugcucaaaaagagaagcccccugacaaccggaguguacgucaagaugccucccacggagccugagugcgaaaaacaguuucaacccuacuucaucccgauuaauuga

SEQ ID NO: 1418 - RNA, 1419 nt, Artificial Sequence
  P16671
augggcugcgacagaaacugugggcugaucgccggagcugugauuggcgccguccucgcgguuuucgggggaauccugaugcccgugggcgaucuucugauucagaagaccaucaaaaagcaagugguccucgaggaagggacaauugcuuuuaaaaauugggugaagacgggaaccgagguuuaccggcaguucuggaucuuugacgugcagaacccucaggaagucaugaugaauagcuccaacauccaagugaaacagcgcggcccguauacauacagaguucgguuccuggccaaggagaaugugacccaggaugccgaagacaacacagucucuuuucuucagcccaauggcgcuauuuucgagccuagccuguccguggggaccgaggccgauaacuuuacagugcucaaucuggcugucgccgcggccucucacaucuaucaaaaccaguucguucagaugauucugaauagccucaucaacaaguccaaaucuagcauguuucaggugcgcacccugagagaacuucuguggggauaccgggaccccuuccucucccuggugccuuaucccgucacgaccacagugggccuguuuuacccuuauaauaacaccgcugaugggguuuacaagguguucaauggaaaagacaacauuagcaaggucgccaucauugauacauacaaaggcaagcgcaaccuuucuuauugggagucccauugcgacaugaucaaugggaccgaugcugccagcuuuccgcccuucguggaaaagucucaaguucuccaguucuuuuccagcgacaucuguagaucuauuuacgcgguguucgaguccgaugucaaccugaaaggaaucccuguguaucgguuuguccugcccagcaaggccuucgcuuccccuguggagaaucccgacaacuacugcuuuuguacggagaaaauuaucucuaagaauugcacaagcuauggcguucucgacauuuccaaauguaaggagggccgcccgguguacaucagccugccucacuuccuuuaugccucucccgaugucuccgaaccuaucgacgggcugaaccccaaugaggaagaacauagaaccuaccucgauauugagcccaucacaggauuuacccugcaguucgcuaaacggcuucaagugaaccugcucguuaagccuagcgaaaagauucaggugcugaaaaaucugaagcgcaacuacaucgucccgauucucuggcugaaugagaccggcacaaucggggacgaaaaagccaacauguuuagaucucaggugacgggaaagaucaaucuucugggccucauugagaugauccugcuuagcguggggguugucauguucguggccuuuaugauuuccuauugcgcuugucggucuaaaaccaucaaguga

SEQ ID NO: 1419 - RNA, 651 nt, Artificial Sequence
  P26718
augggcuggaucagagggcggcgcagcagacacuccugggagaugucugaguuccauaacuacaaucuggaccucaagaaaagcgauuuuuccacccgguggcagaagcaacgcugccccguggucaaaucuaaguguagagaaaacgccagcccuuucuuuuucugcuguuuuauugcuguugccaugggaauccgguucauuaucaugguggcgauuugguccgcuguguuucuuaauucucuguucaaccaggaaguccagaucccgcugacagagagcuauugcggccccuguccuaaaaauuggaucugcuacaagaacaauuguuaucaguuuuucgacgaauccaagaacugguacgagagccaagccucuugcaugucccagaaugccagccuccugaaaguguauucuaaggaggaucaggaccuucugaaacucguuaaguccuaccacuggauggggcuggugcauauucccacgaacggaagcuggcagugggaagauggcucuauccuguccccuaaucuccugaccauuaucgagaugcaaaaaggggacugugcucuuuaugccagcuccuuuaagggauacauugaaaacugcucuacacccaauaccuacaucuguaugcagcgcacagucuga

SEQ ID NO: 1420 - RNA, 261 nt, Artificial Sequence
  P30273
augauccccgccgugguccugcuccugcuucugcucguugagcaggcugccgcgcugggcgaaccucaacuuugcuacauucuggacgcuauccucuuccuguaugggauugugcugacccuccuguacuguagacuuaagauccaggugcggaaagccgccauuacaagcuaugagaaguccgauggagucuacacgggccugucuacccgcaaccaggaaacauaugagacccucaaacacgaaaagccgccccaguag

SEQ ID NO: 1421 - RNA, 1137 nt, Artificial Sequence
  P32248
auggaccugggcaagcccaugaaaagcgugcucgucguugcccugcuugugaucuuccaggugugccugugucaagaugaggucaccgacgauuacauuggggacaacacaacgguggauuauacccucuuugaaucccugugcucuaagaaagacguuagaaauuucaaggcuugguuucuuccuaucauguacagcauuaucuguuucgugggacugcucggcaacgggcuggucgugcugacauauauuuacuuuaaacggcucaagaccaugacagauaccuaucugcuuaaucuggccguugcggacauccucuuccugcuuacacugccguuuugggcuuacuccgccgccaagucuuggguguucggaguccacuuuugcaaacucaucuucgcuauuuauaagaugagcuuuuucuccggcaugcugcugcuccuguguaucucuauugaucgcuacguggccaucgugcaggcugucagcgcccauagacaccgggcgcgcguucuucugauuuccaaacucagcugcguggggaucuggauucuggccaccgugcuuucuauccccgagcugcucuacuccgaccugcagagaucuagcuccgaacaggcuaugcgguguagccugaucacggagcaugucgaagccuuuauuaccauccaaguggcucagaugguuauuggauuccucgugccucugcuugccaugucuuucugcuaucuggucaucauucgcacacuccugcaggcgagaaacuuugagcggaauaaggccaucaaagugaucauugcuguuguggucguguucaucgucuuucagcuucccuacaacggcgugguucuggcccaaaccguggcuaauuucaacauuacauccagcaccugugagcucuccaagcagcugaauaucgccuaugaugucacguacucucuggccugcgugcgcuguugcguuaacccuuuucucuaugcuuucauuggcgugaaguuuagaaaugaccuguucaaacuuuuuaaggaucuggggugccucagccaggaacagcugcggcaaugguccagcugucgccacaucagacggucuuccaugagcgucgaggcggaaacaaccacaaccuucucucccuga

SEQ ID NO: 1422 - RNA, 690 nt, Artificial Sequence
  P40259
auggccagacuggcucucagccccgugccuucccacuggauggucgcccugcuucugcuccugucugcggagccgguucccgcugcccggagcgaagaccgcuacagaaacccuaagggcuccgccugcucucggaucuggcagagcccccgcuucauugcuagaaaacggggguuuaccgugaagaugcauuguuauaugaacuccgccucuggaaaugugagcuggcuuuggaaacaagagauggaugaaaauccucagcagcugaagcucgagaaaggccgcauggaagagucccagaacgagagccuggcuacacugacgauccaagggauuagauucgaagacaauggaaucuacuuuugccagcagaaguguaacaauaccucugaggucuaucagggcugcgggacagaacuccgggugaugggauucuccacccuggcccaacuuaagcagcgcaacacacugaaagauggcauuaucaugauccagacccuccugauuauccuuuuuauuaucguucccauuuuccugcuccuggacaaggaugacagcaaagcgggcauggaggaggaucacacauacgaagggcuggacaucgaucagaccgccacguaugaggacauugugacccucagaacaggagaagucaaguggucugugggcgagcauccugggcaagaauga

SEQ ID NO: 1423 - RNA, 990 nt, Artificial Sequence
  P42081
auggacccccagugcaccaugggccugagcaacauccucuucgugauggccuuucugcuuuccggggcugccccucugaagauucaagcguacuucaaugagacagcugaucucccgugucaguuugccaacucucagaaucagagccuguccgaacuugucguuuucuggcaagaccaggagaaccuggugcucaaugaaguguaucugggaaaagagaaguuugauucuguccacagcaaauacaugggcagaacguccuucgacucugauagcuggacccugcggcuccauaaccugcagaucaaggacaaagggcuuuaucagugcauuauccaccauaagaagcccacaggaaugauucgcauccaccaaaugaacuccgaacugagcgugcucgccaauuuuucucagccugagaucguucccauuuccaauaucaccgagaacguguacauuaaucugacauguagcucuauccauggcuauccugaacccaaaaagauguccguccuucugagaaccaaaaacagcacaauugaguacgauggggugaugcagaagucucaggacaauguuaccgaacucuaugauguguccaucagccuguccgucucuuucccugacgugacgagcaacaugaccaucuuuugcauucuggagacagauaaaacccggcuccuguccagcccguucucuaucgagcuugaagacccccaaccucccccugaucacauucccuggaucacagcugugcugccgaccgucauuaucuguguuaugguguuuugccucauucuguggaaguggaagaaaaagaaacgcccuagaaauuccuacaaguguggaacgaacacaauggagcgggaagagagcgaacagaccaaaaagcgcgagaaaauccacauccccgagagaucugacgaagcccagcggguguucaagagcuccaagacaucuagcugcgacaaauccgauaccuguuuuuga

SEQ ID NO: 1424 - RNA, 1011 nt, Artificial Sequence
  Q15762
auggacuaccccacccugcuccuggcccuucugcacguguauagagcucucugcgaggaaguccuguggcauacaagcguuccuuucgccgagaacaugucccuugaauguguguacccgucuaugggcauccugacccagguggagugguuuaagauugggacgcaacaggauagcaucgcgauuuucucccccacacacggaauggucauccggaaaccuuaugcugaacgcguguacuuucucaauucuaccauggccagcaacaauaugacacuguucuuuagaaacgccuccgaggacgauguuggcuauuacucuugcagccuguauaccuacccccaggggacauggcagaaggugauucaagucgugcaguccgacagcuucgaggcugccguuccuucuaauucccauaucgugagcgaacccggcaaaaacgucacccucacgugucagccucagaugaccuggccggugcaagcugugcggugggagaagauccagccccgccagauugaucugcuuacauacugcaaucugguccacggaagaaacuuuaccucuaaauucccucggcagaucguuuccaauuguagccaugggcgcuggucugugauugugauccccgacgucacaguguccgauagcggacucuauagaugcuaccugcaagccuccgcgggcgaaaacgagaccuuuguuaugcggcuuacgguggccgagggcaagacagacaaucaguauacccuguucgucgcugggggaacagugcuccugcugcucuuuguuauuucuaucaccaccauuaucgugaucuuccugaaccgcagacggcgcagagaacggcgcgaucuuuuuacagagagcugggacacgcagaaggccccuaauaacuacagaucccccauuagcaccucucaaccgacaaaucaguccauggaugacacccgggaagauaucuaugucaacuacccuacauucagcagacgccccaaaacccggguguga

SEQ ID NO: 1425 - RNA, 13482 nt, Artificial Sequence
  Q685J3
augcccagaccuggcaccauggcccugugccuccugacccuugugcugagccuccugccgccccaggcugccgccgaacaagaccuuuccgucaaccgggcuguuugggaugggggaggcuguaucucucagggggacgugcugaaucgccagugccagcaacucagccagcacgugagaacgggauccgccgccaacaccgcuaccggcaccaccucuaccaaugucguggaaccucggauguaccugagcuguuccaccaaccccgaaaugaccucuauugaaagcuccguuacgagcgauaccccuggggugucuuccacccgcaugacccccaccgagagcagaaccacgucugaauccaccagcgacucuaccacacuguucccuuccagcaccgaggauaccuccucuccgaccacgcccgagggaaccgacgucccuaugagcacacccuccgaagagagcaucucuuccaccauggccuuugugagcacagcuccucuccccucuuucgaagccuauaccagccugacguacaagguugauauguccacaccgcuuaccaccucuacacaggcgagcuccagcccuaccacacccgagucuacgaccauuccuaaauccacaaauagcgagggcucuacaccccugacauccaugcccgccagcaccaugaagguggcuuccucugaagccaucacgcuccugaccacaccugucgagauuagcaccccggugacaaucuccgcucaggccucuagcucccccaccacggcggaaggcccuagccuuucuaacuccgcccccagcgggggaucuacaccucugacccggaugccccucuccgugaugcuggucguuagcucugaggcuagcacacuguccaccaccccggccgcuacaaauaucccugugauuacgagcaccgaagccucuuccagccccacaaccgccgagggcacauccaucccuaccucuacguauacagaggggagcacaccccugaccuccaccccugcuucuaccaugcccguggcgacaagcgaaauguccacgcugucuauuaccccggucgacacaagcacccuugugacaaccuccacggagccuagcucucugcccaccacagccgaagcuaccuccaugcucacaagcacccugucugagggauccacaccccuuaccaacaugccuguuagcacgauccugguggccucuuccgaagccagcacaaccuccaccauuccggucgauagcaaaacauuugugaccacggcuucugaggccagcuccucucccacaaccgcggaggacacaagcaucgcuaccuccacaccuucugaaggcagcacaccccucacguccaugccuguuucuaccacacccguggccagcuccgaggccagcaaucugucuaccacaccugucgauuccaagacccaagugacgacaagcaccgaggcuucuuccuccccucccacagccgaggucaacuccaugcccaccucuacccccagcgaaggguccacaccucugacgagcaugucuguguccaccaugcccguugcuagcucugaggccagcacacucuccaccacaccgguggacaccucuacgccugucacaaccagcuccgaggcgucuagcuccagcaccacacccgaaggaaccucuauuccuacauccacgcccagcgagggcuccacaccccugacaaauaugccugugucuacccgccuuguugugagcuccgaagccucuacaaccagcacgaccccggcugauuccaacacauucgucaccacaagcucugaggccuccuccucuagcaccacagcugagggcacgagcaugcccaccucuacauacagcgaaagagggaccaccaucacauccaugucugugagcacgacccugguggccuccagcgaggcguccacacucucuaccacaccuguugacagcaauacccccgucacgacauccaccgaagccaccucuagcuccacaaccgcugagggaacaucuaugccuaccagcacguauacagaaggcuccacaccccugacaagcaugccugugaacaccacgcuuguggccucuuccgaggcuagcacccugucuacaaccccggucgacacauccacccccgugacaaccagcacggaggccucuuccagcccuacaaccgccgauggggcuuccaugcccaccagcacaccuucugaaggaagcacaccccucacauccaugccgguuucuaaaacgcugcugaccagcuccgaggcgucuacacucagcaccacaccucuggacaccuccacgcauaucaccacaucuaccgaagccagcugcucccccacaaccacggagggcacaagcaugcccauuucuaccccuuccgaagggagcccccuucugacaucuaucccuguguccauuaccccggucaccagccccgaggcuuccacacucucuacgaccccuguggauagcaauucccccguuacaaccagcacagaggugucuuccagcccuacccccgccgaaggaacgucuaugccgacaagcaccuacuccgagggccggaccccucugacaucuaugcccgucagcaccacacugguggccacguccgcuaucucuacccuuagcacaaccccuguugacacauccacccccgugacgaacagcaccgaagcccgcucuagcccuacaaccagcgagggcacauccaugcccaccucuacaccgggggaaggaagcaccccucucacguccaugcccgauucuacaacccccgucgugagcuccgaggcgagaacccugagcgcuacaccuguggacacgucuaccccggucacaaccuccacagaggccaccagcucucccacaaccgccgaaggcacguccauuccuaccagcacacccucugaggggaccacaccucugaccuccacgcccguuagccacacacucguggcuaacucugaagccagcacccuguccacaaccccuguggauagcaauacgccgcuuaccacauccaccgaggcgucuagcccgccucccacagcugagggaaccuccaugccuacaucuacccccagcgaaggcuccacgccgcugacacggaugccugucucuaccaccaugguggccagcuccgagacaagcacccucucuacaacgcccgccgacaccuccacacccguuaccacauauagccaggcuucuuccagcucuaccacggccgaugggaccuccaugccuacaagcaccuacucugaaggcuccacaccccugaccagcgugccugucagcacgcgccuggugguuuccucugaggcuagcacacuuuccaccacaccgguggacaccucuauccccgucaccacaagcacggaagccuccucuagcccuaccacagcggagggaaccuccauccccacaagcccucccucugagggcaccacgccgcucgccuccaugccugugagcacaacccugguugugucuuccgaagcuaacacccugagcacaacccccgucgauuccaagacacagguggccacgucuaccgaggcuagcuccccucccccuacagccgaagugaccucuaugcccacaagcaccccgggggagagauccacgccucucaccagcaugcccguccggcauacacccguugccucuuccgaagcuagcacccugucuacaagcccuguggacaccuccacaccggugaccacgucugcggagacaagcuccagccccaccaccgccgagggaacaucucuuccuacguccaccacaagcgaaggcuccacccugcucacaucuauucccgucagcaccacacuggugaccuccccugaggcuucuacgcugcuuaccacacccguugacaccaaggggccuguggucacaagcaaugaaguguccucuagccccaccccggccgagggaacguccaugccuacaagcaccuacucugaaggccgcacaccccucaccuccaucccuguuaacaccacacugguggccagcucugcuauuuccauccugagcacgacccccgucgauaauucuacaccggugaccacaagcaccgaggccuguuccagcccuacgacauccgaggggaccucuaugcccaacagcaaucccuccgaaggcaccacaccucucaccucuauucccgucagcacaacgccugugguuuccucugaggcgagcacccuguccgcuacaccgguggacaccagcacacccggaaccacgucugccgaagccaccuccagcccuacaaccgcugagggcaucucuauccccacauccaccccuagcgaggggaaaacaccccuuaagucuauuccugucuccaacacgccgguggccaauagcgaagcgucuacccuguccacaacccccguugauagcaacuccccuguggucaccagcacagcugugucuagcucccccacgccugccgagggaaccucuaucgccauuagcacacccuccgaaggcucuaccgcucucacaagcaucccgguguccaccacgacaguugccagcucugagauuaauucccugagcaccaccccugcugucacaucuacccccgugacaacguauucccaggccagcucuagccccaccacagcggacgggaccagcaugcaaacauccaccuacucugaaggaagcacgccucugaccucccuucccgugagcacaaugcucgucgugucuuccgaggccaacacccugagcacaaccccuaucgauucuaaaacacagguuaccgcuagcacggaggccuccucuagcacaaccgcugaaggcuccagcaugaccauuucuacaccguccgaggggagcccccugcucaccucuaucccuguguccacaacgcccgucgccagcccugaagccuccacccugucuacaacccccguggacagcaauuccccgguuaucacaucuaccgaggugagcuccagcccuacgcccgcugaaggcaccucuaugccuacauccaccuauacagagggaagaacaccccuuacgagcauuacaguccggaccacaccgguggcgucuuccgccaucagcacccugucuaccacaccuguugauaacuccacgcccgugaccacaagcaccgaggcuagaagcucccccacaaccucugaaggcacgagcaugccuaauuccacacccucugaggggaccaccccucucacaagcauuccggucuccaccacacccgugcugucuagcgaagccuccacgcugucugccaccccuaucgacacaagcacccccgugacaaccuccacggaggcuaccagcucuccuacaaccgccgaaggaacauccauucccaccagcacacuuucugagggcaugaccccucugacguccacaccggucagccacacccucguugcgaacucugaggcuuccacccugagcacaacgcccguggauuccaacagcccuguggucaccucuacagccgugagcuccucucccaccccugccgaagggacaagcaucgcuaccuccacacccucugagggaagcaccgcccucacguccaucccgguuucuaccacaaccguggcgagcuccgaaacaaauacccugagcacgaccccugccgucaccucuacacccgugaccacguacgcucagguuuccagcucucccaccacagccgacggcuccagcaugccuaccuccacaccccgcgaggggcggccuccgcuuaccucuauucccgugagcacaaccacggucgcuuccagcgagaucaacacacugucuaccacccucgccgauacaagaaccccugugacaacguauucccaggcuuccucuagccccaccacagccgacggcaccagcaugccuacacccgcguacucugaaggaagcaccccgcugacguccaugccucugucuaccacacuugucgugagcuccgaggccagcacccugucuacaacccccguugauacguccaccccugcuaccacaagcaccgaaggcuccucuagccccaccacagccgggggaacguccauucaaaccucuacaccuagcgagcgcaccacaccccucgcuggcaugccgguguccaccacgcugguggucagcucugaagggaauacacucuccaccacccccguugacagcaagacacaggugaccaacucuacagaggccuccagcucugccacggcugagggauccagcaugaccaucucugcgccuagcgaaggcagcccccugcuuacaagcauuccucuguccaccacaccgguggccucucccgaggcuagcacccucuccacgaccccugucgacucuaauagccccgugaucacauccaccgaaguuucuagcuccccuauccccacagagggcaccagcaugcagacaucuaccuauuccgaucggagaacgccucugacaagcaugcccgugucuaccaccgucguggccuccagcgccauuucuacacuguccacgaccccggucgacacaagcaccccugugacaaacuccaccgaagcucgcagcucucccacaaccuccgaggggacgagcaugccuaccucuacacccagcgagggauccaccccguuuacaucuaugccuguuagcaccaugcccguggucacguccgaagccucuacacuuagcgcgacccccguggauacauccaccccuguuaccacaagcacggaggccaccucuucccccacaaccgcugaaggcacaagcaucccuaccucuacgcuguccgaggggacaaccccgcucaccagcauucccgugucccauacacuggucgccaauucugaagugagcacccucuccacaacgccuguggacagcaacacccccuucacaaccucuacagaggcuuccagcccucccccgaccgccgagggaacgucuaugccuaccuccacaagcucugaaggcaauacaccccugacacggaugccuguuagcaccacaauggucgcguccuuugagacgucuacccuuagcacaacccccgccgauaccuccacaccugugacgaccuacagccaagcugggucuucccccacaaccgccgacgauacaagcaugccgaccuccacguacucugaaggaagcacaccccugaccuccgugccugucucuaccaugcccguugugagcuccgaggcuagcacacacucuaccacaccuguggacacguccacccccgucacaaccagcacagaggccucuuccagcccuaccacggcugaaggcaccucuaucccgacaucucccccuagcgagggcaccacaccccuggccagcaugccugugagcaccacacccguuguguccagcgaagcggggacccucuccacgacaccggucgauaccucuaccccuaugacaaccagcacagaggccuccucuagccccacgaccgcugaagacauugugguuccuaucuccacagccucugagggaagcacccugcuuacauccauccccgugagcaccacgccggucgcuucuccugaggccuccacccugagcacaacccccguggauucuaacucccccguggucacaagcaccgaaauuucuuccagcgccacguccgcggagggcacaucuaugccuaccagcacauauuccgaagggagcacaccccucagaucuaugccuguuagcaccaaaccgcuggcuuccucugaggccagcacacucuccacgacccccguggacacaucuaucccugugaccacaagcaccgaaacguccagcucucccacaaccgcuaaggauaccuccaugccuauuagcacacccucugaggucuccaccagccugacauccauccuugugucuacgaugccuguugccagcuccgaggccucuacccugagcacaaccccgguggacacacgcacccuggucacgaccuccacaggaaccuccucuagccccacaaccgcugaaggcagcucuaugccuacaagcacgcccggggagcgguccaccccucucacaaauauucuggugucuaccacccuucuggccaacagcgaagcguccacacucagcacgacccccguugacacaucuaccccggugacaaccuccgccgaggcuagcuccucucccacaaccgccgaaggaacgagcaugagaaucuccaccccuucugauggcagcacaccccugaccuccauucucgucagcacacugccuguggcuucuuccgaggccagcaccguuucuacgacagcgguggacaccuccauccccgucacaaccagcacggaggccucuuccagcccuaccacagcugaagugaccucuaugccgacauccacccccagcgagacaagcaccccucuuacguccaugcccgucaaucacacaccuguggccucuagcgaagcuggcacccuguccaccacacccguugauaccucuacaccggugacgaccagcacaaaggccuccucuagcccuaccacagcugaggggaucgucgugcccauuuccaccgccagcgagggaucuacgcugcucaccuccaucccugugagcacaacccccguugcgucuuccgaagccagcacacugucuaccacgccuguggacacauccauucccgucaccacaagcaccgagggcuccucuagcccgaccacagcugaagggacguccaugcccaucagcaccccuucugagguguccacaccccuuaccagcauucugguuucuacagugccugucgccggaagcgaggcuuccacccucucuacgacacccguggauacccgcaccccggucacaaccagcgccgaggccuccagcucuccuacaacggcggagggcaccuccaugcccaucagcacaccuggggaacggagaacaccccugacaucuauguccgugagcaccaugccuguugcuuccucugaggccagcacgcucucccggacccccgccgacacaucuaccccggugacaaccagcacagaggcuuccagcucuccuaccacggccgagggaacaggcauccccauuuccaccccuagcgaaggcucuacaccccugacauccaucccggucagcacgacccccguggcuauuccugaggccucuacacuuagcaccacacccguugauuccaacagcccuguggucaccucuacagagguguccagcucccccaccccugcggaagggacgucuaugccgaucagcaccuacuccgagggaucuacaccccugaccggcgugccuguuagcacaacccccgucacguccucugccauuagcacacuguccaccacaccuguggacaccagcacccccgugacaacgucuaccgaagcucauuccagcccgacaaccucugaggggacauccaugccuaccagcacgcccucugaaggauccacaccucucaccuauaugcccgucagcaccaugcuggugguuuccagcgaggauucuacacuuagcgccaccccuguggacacauccacgcccgucaccacaucuaccgaggcuacaagcuccaccacggccgaaggcaccucuaucccgacaagcacccccuccgaggggaugacaccucugaccucugugcccguuagcaauacaccuguggcguccagcgaagccucuauccucuccacgacccccgucgauagcaacacaccucugaccaccucuacagaggcuuccagcuccccgcccacggccgagggaaccucuaugccuacaagcacccccuccgaaggcagcacaccucugaccucuaugcccguguccacgacaaccguugcuagcucugagaccagcacacucuccaccacaccggccgacacgucuaccccugugacaaccuacagccaggcuuccucuuccccucccauugccgacggcacauccaugcccaccagcacguauucugaaggguccaccccgcuuacaaacaugagcuucuccaccacacccgucgugucuagcgaggcguccacccugucuacaaccccuguggauacgagcacacccgucaccaccuccacagaagccagccugucuccuaccacagcugagggaacguccauccccaccagcucuccuuccgagggcacaaccccgcucgccagcaugcccguuucuacaaccccuguggugagcuccgaagucaauacgcugucuaccacacccguggacagcaacacccuuguuacaaccuccacggaggccagcuccucuccuacaauugcugaagggaccagccugcccacauccaccaccucugagggaagcacaccucucuccaucaugccgcugucuacgacccccguggccagcuccgaagcgagcacacugucuaccacaccugucgauaccuccacgcccgugacaaccagcucuccuaccaauuccagccccacaaccgcugagguuacaucuaugccgacguccaccgccggcgaggggagcacaccccucaccaacaugccuguguccacaacccccgucgccagcucugaagcuagcacgcuuuccaccacaccuguggacucuaauaccuuugucacaagcuccucucaggccagcuccucucccgcuacccuccaggugacaacgaugcgcaugagcaccccuuccgagggauccucuucccugacaaccaugcuccugagcucuaccuacguuacauccagcgaagccuccacgccgucuacccccagcguggauagauccacaccugucaccacaagcacccaaucuaacuccacacccaccccucccgaggugauuacgcuuccgaugagcaccccuucugaaguuagcacaccccugaccaucaugccuguguccacaaccucugucacgauuagcgaggcgggcacagccuccacccuccccguggacacaucuaccccugugaucacgagcacccagguuuccagcucucccgucacaccggagggcaccacaaugcccaucuggaccccuuccgaagggagcacaccccugaccacgaugccuguguccacaacccgggugaccucuagcgagggauccacacugucuacccccagcgucgugacauccacgccgguuaccacaagcaccgaagcuauuucuuccagcgccacacucgauucuaccacgauguccgugagcaugccuauggagaucucuacccuuggcacaaccauucuggucuccacaacccccgugacgagauucccugagagcucuacacccagcaucccuuccguuuauaccagcauguccaugacaaccgcuucugaagggagcuccucucccaccacacuggagggaacgaccacaaugccgaugagcaccacauccgaacgcucuacccuccugacgacagugcuuauuagcccuaucuccgucaugagccccucugaggccuccacccugagcaccccucccggcgacacaucuaccccgcuccugacauccacgaaagcggggagcuuuucuauccccgccgaagugaccacaauucggaucuccauuaccagcgagagauccacaccucugaccacgcuccuugugucuaccacacugcccaccagcuucccuggagcuagcaucgccuccacacccccucuggauaccucuacaaccuuuacgccgagcacagacaccgcuuccacccccacaauuccuguugccacgaccaucucugucagcgugaucacagagggcuccacccccggcacaaccauuuucaucccuucuacacccgugaccagcuccacggccgaugucuucccggcuaccacaggggcgguuagcaccccugugauuacaucuaccgaacucaauacgcccuccacauccucuuccagcaccacaaccuccuuuucuacgaccaaggaguucacaaccccugccaugacaaccgcugcgccccugacauacgugaccaugagcacggccccuuccacaccccgcaccaccucuagaggaugcacaaccagcgcuuccacacuuagcgccacgucuaccccgcacacauccaccagcgucacaacccggcccgugacgccuucuagcgaauccucucgccccagcaccaucacaucccauaccauuccucccacauuuccuccggcgcacagcucuacacccccuacaacguccgcuagcuccaccacaguuaaccccgaggccgugaccaccaugacaacgagaaccaaaccuucuacacggaccaccagcuuccccaccgucacgacaaccgccgugccgaccaauacaaccaucaaguccaacccuacaucuacgcccaccguuccucgcacaaccacauguuuuggcgacgggugccagaauaccgcuagcagauguaaaaacggaggcacgugggaugggcugaagugccagugucccaaucucuacuauggcgaacugugcgaggagguggucuccagcauugacaucggaccgcccgaaaccaucucugcccaaauggagcugacagugaccgugacauccgucaaauucaccgaagaacucaagaaccacagcucucaggaauuucaggaguucaagcagacauuuaccgagcaaaugaauauuguuuacuccggcaucccugaauaugugggggugaacauuacgaaacuucggcugggaagcgucguuguggagcaugacgugcugcuccgcacaaaguacacccccgaauauaaaaccguccuggauaacgcuacagaggugguuaaggagaaaaucacgaaggugaccacacagcagauuaugaucaaugacaucugcucugauaugauguguuucaacaccacaggcacccaaguccagaauauuacagugacccaguacgacccugaagaggauugcagaaagauggccaaagaauauggggacuacuuuguuguggaguaccgggaucagaagcccuauuguaucuccccuugcgaaccgggauucagcgucucuaaaaacuguaaucuuggcaagugccaaaugagccuguccgggccccagugucucugcgugacgaccgagacacacugguacagcggcgagaccuguaaccagggaacacagaaaucccuggucuauggccuggugggggcgggaguugugcucaugcuuauuauccuggucgcccugcucaugcugguguuucgcucuaagagagaagugaagcggcaaaaauacagacuuagccagcuguauaaguggcaggaggaagacuccggcccugcucccgggaccuuccagaauauuggauucgauaucugccaagacgaugacucuauccaucucgagagcauuuacuccaacuuucagccuucucugcgccacaucgaucccgaaacgaaaauucggauccagagaccucaaguuaugacaaccagcuucuga

SEQ ID NO: 1426 - RNA, 1215 nt, Artificial Sequence
  Q9NNX6
augagcgacuccaaggagcccagacugcagcaacucggccugcuugaagaggaacagcugcgggggcucggauuccgccagaccagaggcuacaaaucucuggccgggugccuuggacacggcccucuggugcuccagcugcugagcuuuacacuccuggcugggcuucugguccaaguuuccaaggugccgucuagcaucucccaggagcagucucggcaggaugccauuuaucaaaaccucacgcagcugaaagcggcugugggagaacuuagcgagaaguccaaacugcaggagaucuaccaggaacucacccaacugaaggccgccgucggcgagcugcccgaaaagagcaaacuccaggagauuuaucaggagcugacacgccuuaaggcugccgugggcgaacugccugagaaaucuaagcuccaagaaaucuaccaggagcugaccuggcuuaaagcugccguuggggaacugcccgagaaguccaagaugcaggagauuuaucaggaacucacaagacugaaagcggccgugggagagcugccugaaaagagcaaacaacaggagaucuaccaggaacucacccggcugaaggcugccgucggcgagcuucccgagaaaucuaagcagcaagaaaucuaucaggagcugacacgccucaaagcugccgugggggaacugccugagaaguccaagcagcaggaaauuuaccaagagcuuacccagcugaaagcggccguugagagacucugucauccgugccccugggaauggacguucuuucagggaaauuguuacuucaugagcaacucucagcggaauuggcacgacuccaucaccgcuugcaaggaggugggcgcccaacuggucgugauuaaaagcgcugaagaacagaacuuucugcagcuccaauccucucgcagcaauagauucacauggauggggcuguccgaucuuaaccaggagggaaccuggcaguggguggacggcagcccucugcuccccucuuuuaagcaguauuggaaucggggcgaaccuaacaaugucggggaggaagauugugccgaguucuccggaaacggcuggaaugacgauaaaugcaaccuggccaaguuuuggaucuguaagaaaagcgcugcgucuugcagccgcgacgaggagcaauuccugucccccgccccggcuacaccuaaucccccucccgccuga

SEQ ID NO: 1427 - RNA, 3126 nt, Artificial Sequence
  Q9NR97
auggagaacauguuccugcagagcuccaugcugaccugcaucuuucugcuuauuucuggcagcugugaacugugcgccgaggaaaauuucuccagaucuuaccccugugacgagaagaaacaaaacgauagcgugaucgcugaaugcuccaaucggcgccuccaggaggucccucagacaguugggaaguaugugacggagcuggaccuuucugauaacuuuauuacccacaucacaaaugaauccuuccagggacugcaaaaccucaccaaaauuaaucugaaccauaauccgaacgugcagcaccagaauggcaaccccgggauccaguccaauggacugaacaucacagacggcgccuuucucaaucugaagaaccuuagagagcugcuccuggaagauaaccaacuuccucagauucccagcgggcugccugagucucucaccgagcugucccugauccagaauaacauuuacaauaucacaaaagaaggaauuagccggcucaucaaccugaagaaucuuuaucuggcguggaacuguuacuucaauaaggucugcgagaaaaccaacauugaagacggcguguuugagacgcucaccaaucuggaacuucugucucucuccuucaacagccugucucauguucccccuaagcugccguccagccuccgcaaacuguuucuuuccaauacacagaucaaguauaucucugaggaggauuucaaaggccugauuaaccucacccugcuugaccugagcgggaauugucccagaugcuuuaacgcuccuuuccccugugugccuugcgauggaggcgccuccaucaauauugaccgguuugccuuccaaaaccucacacagcugcgcuaccugaaccucagcucuaccucccugagaaagaucaaugcugccugguucaagaacaugccccaccuuaaaguccuggaucucgaauuuaauuaucuggugggggagauugcuagcggagccuuccugacgaugcuuccgcggcucgaaauccuggaccugucuuuuaacuacaucaagggcagcuacccucagcauauuaauaucucccgcaacuucucuaaacuccugagccuuagagcgcugcaccuccggggguauguuuuucaagagcugcgcgaagaugacuuccagccccugaugcagcuuccuaaucucuccacaauuaaccugggaaucaauuuuauuaagcagaucgacuucaaacuguuucaaaacuucagcaaucucgagaucauuuaccugucugagaacagaaucagcccccuugugaaggauacccggcagagcuaugccaauucuuccagcuuucagcgccacauuagaaaacggagauccacagacuucgaauuugauccccauucuaacuucuaccacuucacccgcccucugaucaagccgcagugugcugccuauggcaaggcucucgaccugagccucaauuccauuuucuucaucggccccaaccaauuugagaaccuuccugauauugccugccucaaucugucugcgaacagcaaugcccagguccuguccgggaccgaauuuagcgcuaucccccaugugaaauaccucgaccugacaaacaaucggcuugauuuugacaacgccucugcucugacggagcucuccgaucuggaagugcuggaccuuagcuauaauucucacuacuucagaaucgccggagucacccaccaucucgaguuuauucagaacuucacaaaucugaagguucugaaccucucccacaauaacaucuacacccugacagauaaauauaaucuugagagcaagucucugguggaacucguguuuagcggcaaccgccuggacauucuguggaaugacgaugacaaccgguacaucuccauuuucaaagggcuuaagaaccugaccagacucgaucugagccucaaucgccugaagcauaucccuaacgaggccuuucuuaaucugcccgcuucucucacggaacugcacaucaacgacaauaugcugaaauucuuuaacuggacacuucugcagcaauucccgcggcucgagcugcucgaucugagaggaaauaaacuucuguuccucaccgacucccugagcgauuuuaccuccucucugcgcacacuucugcucagccauaaccggauuucccaucugccuucuggcuuccucagcgaggucuccucucugaagcaccuugaccugagcuccaaucugcucaagaccaucaacaaaagcgcgcuggaaacaaagacgaccacaaaacuuucuaugcuggagcuccacgggaaucccuuugaaugcaccugugauauuggagacuucagacgcuggauggaugagcaccugaacgugaagaucccucggcucguugacgugauuugcgccucccccggcgaucagagaggcaagagcaucgucucucuggaacuuacaaccuguguguccgacguuacggcugugauccuguuuuucuuuaccuucuuuauuacaaccauggucaugcuggccgcccucgcucaucaccuguucuauugggacgugugguuuaucuacaaugucugccuugccaaagugaagggguaucggagccugucuacaucccagaccuucuacgaugcguauauuagcuacgacacgaaagaugcuuccguuacagacugggugaucaacgagcuccgcuaccaccuggaggaaagcagagauaagaauguccuccugugucuugaggaacgggacugggauccuggacuggccauuaucgacaaccugaugcagucuaucaaucaaagcaagaaaaccguguucguucucacaaagaaauaugccaaguccuggaacuuuaaaaccgcuuucuaccuggcccuucagagacugauggaugagaacauggacgugauuaucuuuauucuccuggaacccguccuccagcauucucaauaucugcgccuucggcagagaaucugcaagagcuccauucugcaguggccggauaauccuaaagcugagggccuguucuggcagacccuccgcaacguggugcugacagagaaugacucuagauacaacaauauguauguugauagcaucaagcaauacuga

SEQ ID NO: 1428 - RNA, 66 nt, Artificial Sequence
  P16671_TM_1_8-29
ggccugaucgccggggcugugauuggagccguccucgcgguuuucggcgggauccugaugcccgug

SEQ ID NO: 1429 - RNA, 81 nt, Artificial Sequence
  P32248_TM_1_60-86
uuccugcccaucauguacagcauuaucugcuuugugggccuccuggggaacggacuugucguucugaccuauauuuacuuc

SEQ ID NO: 1430 - RNA, 66 nt, Artificial Sequence
  P16671_TM_2_440-461
cugcucggccugaucgagaugauucuucugagcgugggggucguuauguucguggccuuuaugauc

SEQ ID NO: 1431 - RNA, 63 nt, Artificial Sequence
  P32248_TM_2_96-116
uaccugcucaaccuggccguggcugacauccuuuuccugcucacccugcccuuuugggccuau

SEQ ID NO: 1432 - RNA, 66 nt, Artificial Sequence
  P32248_TM_3_131-152
cugaucuucgccauuuacaagaugagcuuuuucuccggcaugcuccugcuucugugcaucucuauu

SEQ ID NO: 1433 - RNA, 63 nt, Artificial Sequence
  P32248_TM_4_171-191
gugcugcucaucagcaagcuguccugcgucggcauuuggauccuugccaccguucugucuauu

SEQ ID NO: 1434 - RNA, 84 nt, Artificial Sequence
  P32248_TM_5_220-247
uucaucaccauucagguggcccaaauggucaucggcuuucugguuccccuccuggcuaugagcuucugcuaccuugugauuauc

SEQ ID NO: 1435 - RNA, 78 nt, Artificial Sequence
  P32248_TM_6_264-289
gugaucauugccgucguugugguguucaucgucuuucagcugcccuacaacggcgugguucucgcucaaaccguggcc

SEQ ID NO: 1436 - RNA, 54 nt, Artificial Sequence; identical to SEQ ID NO: 1020
  P32248_TM_7_314-331

SEQ ID NO: 1437 - RNA, 69 nt, Artificial Sequence
  A0A5B9_TM_145-167
accauccuguacgagauucuccugggcaaggccacacuuuaugcugugcuggucagcgcccucguucug

SEQ ID NO: 1438 - RNA, 69 nt, Artificial Sequence
  B7Z8K6_TM_130-152
cugggccucagaaugcuguucgccaagaccguggcugucaacuuucuucugacagccaaacucuucuuu

SEQ ID NO: 1439 - RNA, 63 nt, Artificial Sequence
  O00206_TM_632-652
accaucauuggcgugagcguccuguccguucucguggugucugucguggccguucugguguac

SEQ ID NO: 1440 - RNA, 66 nt, Artificial Sequence
  P01730_TM_397-418
auggcccugaucgugcucggcggggucgcuggacugcuucuguucauuggccucgggaucuuuuuc

SEQ ID NO: 1441 - RNA, 63 nt, Artificial Sequence
  P01850_TM_151-171
auccugcucggcaaggccacccuguacgcugugcuugucagcgcccugguucucauggcgaug

SEQ ID NO: 1442 - RNA, 78 nt, Artificial Sequence
  P07766_TM_127-152
gugaugagcgucgccaccaucguuauuguggacaucugcauuacaggcgggcugcuccugcuuguguacuauuggucc

SEQ ID NO: 1443 - RNA, 66 nt, Artificial Sequence
  P08575_TM_576-597
gcccugaucgcuuuccucgccuuucugauuaucgugaccagcauugcgcuucuggucguucucuac

SEQ ID NO: 1444 - RNA, 63 nt, Artificial Sequence
  P08637_TM_209-229
gugagcuucugccuggucaugguucuccuguuugccguggacaccggccuuuacuucuccgug

SEQ ID NO: 1445 - RNA, 81 nt, Artificial Sequence
  P10747_TM_153-179
uucugggugcuggucguugugggcggggugcucgccugcuacagccugcuugucaccguggcuuuuaucauuuucuggguu

SEQ ID NO: 1446 - RNA, 66 nt, Artificial Sequence
  P11912_TM_144-165
aucauuaccgccgagggcaucauucuccuguucugcgcugugguccccgggacacugcuucuguuu

SEQ ID NO: 1447 - RNA, 66 nt, Artificial Sequence
  P15391_TM_292-313
gugagcgccgucacccuggcuuaccucaucuucugccuguguucccuuguuggcauucugcaccuc

SEQ ID NO: 1448 - RNA, 63 nt, Artificial Sequence
  P16410_TM_162-182
uuccugcucuggauccuggccgcugugagcuccggccuguuuuucuacucuuuucuucucacc

SEQ ID NO: 1449 - RNA, 63 nt, Artificial Sequence
  P26718_TM_52-72
cccuucuuuuucugcuguuuuaucgccguggcuaugggcauuagauucaucauuauggucgcc

SEQ ID NO: 1450 - RNA, 63 nt, Artificial Sequence
  P30273_TM_24-44
cugugcuacauccucgacgccauucuguuccuuuauggcaucgugcugacccuccuguacugu

SEQ ID NO: 1451 - RNA, 63 nt, Artificial Sequence
  P40259_TM_160-180
ggcaucauuaugauccagacccugcucauuauccuguucauuaucgugcccaucuuucuucug

SEQ ID NO: 1452 - RNA, 63 nt, Artificial Sequence
  P42081_TM_248-268
uggaucaccgccgugcugcccacagucauuaucugcguuaugguguucugucucauucugugg

SEQ ID NO: 1453 - RNA, 63 nt, Artificial Sequence
  Q15762_TM_255-275
ggcgggaccgugcugcuccugcuuuucgucaucagcauuacaacgaucauuguuaucuuucug

SEQ ID NO: 1454 - RNA, 63 nt, Artificial Sequence
  Q685J3_TM_4394-4414
cuggugggcgccggggucguucucaugcugaucauucuuguggcucugcucaugcugguguuc

SEQ ID NO: 1455 - RNA, 63 nt, Artificial Sequence
  Q9NNX6_TM_38-58
cugggccacgggccccucgugcugcagcuucugagcuucacccuccuggccggacuucugguc

SEQ ID NO: 1456 - RNA, 63 nt, Artificial Sequence
  Q9NR97_TM_828-848
gccgugauccuguucuuuuucaccuuuuucauuacaacgauggucaugcucgcugcccuggcg

SEQ ID NO: 1457 - RNA, 48 nt, Artificial Sequence
  P14207_1-16
augguauggaaauggaugccauuauuauuauuauuaguauguguagca

SEQ ID NO: 1458 - RNA, 48 nt, Artificial Sequence
  O75787_1-16
auggcuguauuuguaguuuuauuggcauuaguagcuggaguuuuaggu

SEQ ID NO: 1459 - RNA, 48 nt, Artificial Sequence
  P07359_1-16
augccccuucuccuucuccuucuccuucucccuuccccucuucauccc

SEQ ID NO: 1460 - RNA, 48 nt, Artificial Sequence
  P08637_1-16
auguggcaacuuuuacuuccuacugcccuuuuacuuuuaguuucugcu

SEQ ID NO: 1461 - RNA, 51 nt, Artificial Sequence
  P07237_1-17
augcuuagacgugcacuuuuauguuuagcuguagcugcacuuguacgugca

SEQ ID NO: 1462 - RNA, 51 nt, Artificial Sequence
  O60911_1-17
augaauuuaucuuuaguuuuagcugcuuuuugucuugguauugcuucugcu

SEQ ID NO: 1463 - RNA, 51 nt, Artificial Sequence
  P20138_1-17
augccuuuauuauuauuauuaccuuuauuaugggcuggcgcuuuagcuaug

SEQ ID NO: 1464 - RNA, 51 nt, Artificial Sequence
  P27797_1-17
augcuuuuaucuguaccuuuacuuuuagguuuacuuggacuugcaguugca

SEQ ID NO: 1465 - RNA, 54 nt, Artificial Sequence
  P10747_1-18
augcuccgucuucuucuugcucuuaauuuauuuccuucuauucaaguuacuggc

SEQ ID NO: 1466 - RNA, 54 nt, Artificial Sequence
  O75487_1-18
auggcacguuuugguuuaccugcacuuuuauguacacuugcaguuuuaucugca

SEQ ID NO: 1467 - RNA, 54 nt, Artificial Sequence
  P07996_1-18
auggguuuagcuugggguuuagguguauuauuuuuaaugcauguauguggaacu

SEQ ID NO: 1468 - RNA, 54 nt, Artificial Sequence
  P22748_1-18
augcguaugcuuuuagcuuuacuugcacuuucagcugcacguccaucugcaucu

SEQ ID NO: 1469 - RNA, 54 nt, Artificial Sequence
  Q15762_1-18
auggauuacccuacacuucuacuugcacuucuacauguauauagagcucuaugu

SEQ ID NO: 1470 - RNA, 54 nt, Artificial Sequence
  P30273_1-18
augauaccagcaguaguacuacuacuacuacuauuaguagaacaagcagcagca

SEQ ID NO: 1471 - RNA, 54 nt, Artificial Sequence
  P38570_1-18
auguggcuuuuucauacuuuacuuuguauugcuucuuuagcuuuacuugcugcu

SEQ ID NO: 1472 - RNA, 54 nt, Artificial Sequence
  Q01638_1-18
auggguuucuggauacuugcaauuuuaacuauacuuauguauucaacugcagcu

SEQ ID NO: 1473 - RNA, 54 nt, Artificial Sequence
  Q9NZQ7_1-18
augagaauauucgcaguauucauauucaugacauacuggcauuuacuaaacgca

SEQ ID NO: 1474 - RNA, 57 nt, Artificial Sequence
  P13591_1-19
augcuacaaacaaaagacuuaauauggacauuauucuuucuaggcacagccguauca

SEQ ID NO: 1475 - RNA, 57 nt, Artificial Sequence
  P26842_1-19
auggcuagaccucauccuuggugguuauguguauuaggaacuuuaguuggauuaagu

SEQ ID NO: 1476 - RNA, 57 nt, Artificial Sequence
  P15391_1-19
augccuccuccucgucuucuuuuuuuucuucuuuuucuuacuccuauggaaguucgu

SEQ ID NO: 1477 - RNA, 57 nt, Artificial Sequence
  Q8NI17_1-19
augauguggacuugggcuuuauggauguuaccaaguuuauguaaauuuaguuuagca

SEQ ID NO: 1478 - RNA, 57 nt, Artificial Sequence
  P08571_1-19
auggaaagagcuucaugucuacuucuacuucuacuuccacuuguacauguaucugca

SEQ ID NO: 1479 - RNA, 57 nt, Artificial Sequence
  P05154_1-19
augcaacuauuucuacuucuaugucuaguucuacuuucaccucaaggugcaucuuua

SEQ ID NO: 1480 - RNA, 57 nt, Artificial Sequence
  P02787_1-19
augagauuagcaguaggagcauuauuaguaugugcaguauuaggauuauguuuagca

SEQ ID NO: 1481 - RNA, 57 nt, Artificial Sequence
  P02671_1-19
auguuuucaaugagaauuguauguuuaguuuuaaguguaguugggacugcauggaca

SEQ ID NO: 1482 - RNA, 57 nt, Artificial Sequence
  P04216_1-19
augaaucuagcgauaucgauagcgcuauugcuaacgguauugcaagugagcagggga

SEQ ID NO: 1483 - RNA, 57 nt, Artificial Sequence
  P00747_1-19
auggaacauaaagaaguaguacuauuacuauuacuauuucuaaaaagcggacaagga

SEQ ID NO: 1484 - RNA, 57 nt, Artificial Sequence
  P01764_1-19
auggaauuuggauuaaguugguuauuuuuaguggcaauauuaaaaggaguacagugu

SEQ ID NO: 1485 - RNA, 57 nt, Artificial Sequence
  P16150_1-19
auggcuacuuuauuauuauuauuagguguuuuaguuguuucuccugaugcuuuaggu

SEQ ID NO: 1486 - RNA, 57 nt, Artificial Sequence
  Q6DN72_1-19
auguuauuauggacugcuguuuuauuauuuguuccuuguguugguaaaacuguuugg

SEQ ID NO: 1487 - RNA, 57 nt, Artificial Sequence
  Q01151_1-19
augucuagaggucuacaauuacuucuacuuucaugugcauauucacuugcaccugca

SEQ ID NO: 1488 - RNA, 57 nt, Artificial Sequence
  P07093_1-19
augaacuggcaucuaccucuauuucuacuugcaucuguaacucuaccuucaaucugc

SEQ ID NO: 1489 - RNA, 57 nt, Artificial Sequence
  Q8WWQ8_1-19
augauguuacaacauuuaguuauauuuugucuuggcuuagucguucaaaauuucugu

SEQ ID NO: 1490 - RNA, 60 nt, Artificial Sequence
  Q13291_1-20
auggauccuaaaggucuucuuucucuuacuuuuguucuuuuucuuucucuugcuuuuggu

SEQ ID NO: 1491 - RNA, 60 nt, Artificial Sequence
  P35225_1-20
auggcacuuuuacuuacaacuguaauugcacuuacauguuuaggcggauuugcaagucca

SEQ ID NO: 1492 - RNA, 60 nt, Artificial Sequence
  P25942_1-20
augguaagacuaccauuacaauguguauuauggggaugucuauuaacagcaguacaucca

SEQ ID NO: 1493 - RNA, 60 nt, Artificial Sequence
  P52803_1-20
auguugcauguggaaaugcuuacgcuuguguuuuuaguuuuauggauguguguauuuucg

SEQ ID NO: 1494 - RNA, 60 nt, Artificial Sequence
  Q15116_1-20
augcaaauaccacaagcaccauggccaguaguaugggcaguauuacaauuaggauggaga

SEQ ID NO: 1495 - RNA, 60 nt, Artificial Sequence
  P05556_1-20
augaauuuacaaccuauuuuuuggauugguuuaauuucuucugucuguuguguuuuugcu

SEQ ID NO: 1496 - RNA, 60 nt, Artificial Sequence
  Q12891_1-20
augagagcaggaccaggaccaacaguaacauuagcauuaguauuagcaguagcaugggca

SEQ ID NO: 1497 - RNA, 60 nt, Artificial Sequence
  Q8IV16_1-20
augaaagcauuaggagcaguauuauuagcauuauuauuauguggaagaccaggaagagga

SEQ ID NO: 1498 - RNA, 60 nt, Artificial Sequence
  Q03167_1-20
augacuucacauuacguuauagcuauauuugcacuuaugucuucaugucuagcuacagcu

SEQ ID NO: 1499 - RNA, 60 nt, Artificial Sequence
  Q14246_1-20
augagaggguuuaauuuauuguuauuuuggggguguuguguaaugcauaguugggaggga

SEQ ID NO: 1500 - RNA, 60 nt, Artificial Sequence
  P16871_1-20
augacaauauuaggaacaacauucggaaugguauuuucauuacuacaaguaguaucagga

SEQ ID NO: 1501 - RNA, 60 nt, Artificial Sequence
  P61769_1-20
augucuagaucuguagcuuuagcuguacuugcacuuuuaucuuuaucuggacuugaagcu

SEQ ID NO: 1502 - RNA, 60 nt, Artificial Sequence
  Q9Y6W8_1-20
augaaaucagguuugugguauuuuuuucuuuuuuguuugcguauaaaagugcuuacgggc

SEQ ID NO: 1503 - RNA, 63 nt, Artificial Sequence
  P10966_1-21
augcguccacguuuaugguuacuuuuagcugcacaauuaacuguacuucaugguaauucugua

SEQ ID NO: 1504 - RNA, 63 nt, Artificial Sequence
  Q9BZW8_1-21
augcuaggacaaguaguaacacuaauacuacuacuacuacuaaaaguauaccaaggaaaagga

SEQ ID NO: 1505 - RNA, 63 nt, Artificial Sequence
  P02778_1-21
augaaccaaacagcaauacuaauaugcugccuaauauuccuaacacuaucaggaauacaagga

SEQ ID NO: 1506 - RNA, 63 nt, Artificial Sequence
  P18564_1-21
auggguauagaauuauuaugcuuauucuuucuauuucuagguagaaaugaccauguacaagga

SEQ ID NO: 1507 - RNA, 63 nt, Artificial Sequence
  O14525_1-21
auggcauuagcaggauuaugugcauuauuagcauguuguuggggaccagcagcaguauuagca

SEQ ID NO: 1508 - RNA, 63 nt, Artificial Sequence
  P01130_1-21
augggaccauggggauggaaauuaagauggacaguagcauuauuauuagcagcagcaggaaca

SEQ ID NO: 1509 - RNA, 63 nt, Artificial Sequence
  P01732_1-21
auggcuuuaccuguaacugcacuuuuacuuccacuugcacuuuuacuucaugcugcacgucca

SEQ ID NO: 1510 - RNA, 63 nt, Artificial Sequence
  P48061_1-21
augaaugcaaaaguaguaguaguauuaguauuaguacugacagcauuauguuuaucagacgga

SEQ ID NO: 1511 - RNA, 63 nt, Artificial Sequence
  P01589_1-21
auggauucauauuuauuaauguggggauuauuaacuuuuauuaugguuccagguugucaagca

SEQ ID NO: 1512 - RNA, 63 nt, Artificial Sequence
  Q86T13_1-21
augagaccagcauuugcauuauguuuauuauggcaagcauuauggccaggaccaggaggagga

SEQ ID NO: 1513 - RNA, 63 nt, Artificial Sequence
  Q5DID0_1-21
augcuaagaacaucaggacuagcacuacuagcauuaguaucagcaguaggaccaucacaagca

SEQ ID NO: 1514 - RNA, 66 nt, Artificial Sequence
  P40189_1-22
augcuaacucuacaaaccuggcuaguucaagcucuauuuauauuucuaacuacagaaucaacuggc

SEQ ID NO: 1515 - RNA, 66 nt, Artificial Sequence
  Q86YL7_1-22
auguggaaagugagugcguuauuguuuguguuagggagugcgaguuuguggguguuagcggaaggg

SEQ ID NO: 1516 - RNA, 66 nt, Artificial Sequence
  P55075_1-22
auggguucuccucguucugcucuuucuugucuucuucuucauuuacuuguucuuugucuucaagcu

SEQ ID NO: 1517 - RNA, 66 nt, Artificial Sequence
  Q30201_1-22
augggaccaagagcaagaccagcauuacuauuacuaaugcuauuacaaacagcaguacuacaagga

SEQ ID NO: 1518 - RNA, 66 nt, Artificial Sequence
  P07766_1-22
augcaaaguggaacgcauuggagaguguuaggguuauguuuauugaguguaggaguguggggacaa

SEQ ID NO: 1519 - RNA, 66 nt, Artificial Sequence
  P18827_1-22
augagaagagcagcauuaugguuaugguuaugugcauuagcauuaucauuacaaccagcauuacca

SEQ ID NO: 1520 - RNA, 66 nt, Artificial Sequence
  P55290_1-22
augcaaccacguacaccucuaguucuauguguacuucuaucucaaguucuacuucuaacuucagcu

SEQ ID NO: 1521 - RNA, 66 nt, Artificial Sequence
  P37173_1-22
augggaagaggauuauuaagaggauuauggccauuacauauaguauuauggacaagaauagcaagu

SEQ ID NO: 1522 - RNA, 66 nt, Artificial Sequence
  Q07325_1-22
augaaaaaaucgggaguacuauuucuauugggaauaauauuacuaguacuaauaggagugcaaggg

SEQ ID NO: 1523 - RNA, 66 nt, Artificial Sequence
  P04156_1-22
auggcuaauuuaggauguuggauguuaguuuuauuuguagcuacauggagugauuuagguuuaugu

SEQ ID NO: 1524 - RNA, 66 nt, Artificial Sequence
  P31785_1-22
augcuuaaaccuucacuuccauuuacaucucuacuuuuccuucaacuuccacuucuaggcgucggc

SEQ ID NO: 1525 - RNA, 69 nt, Artificial Sequence
  P01579_1-23
augaaauauacaucuuacauucuagcuuuccaacuauguauaguucuagguucacuuggauguuacugu

SEQ ID NO: 1526 - RNA, 69 nt, Artificial Sequence
  P23229_1-23
auggcagcagcaggacaauuauguuuauuauauuuaagugcaggauuauuaaguagauuaggagcagca

SEQ ID NO: 1527 - RNA, 69 nt, Artificial Sequence
  O60494_1-23
augaugaacaugucacuuccauuucuauggucauuacuaacucuauuaauauuugcagaaguaaaugga

SEQ ID NO: 1528 - RNA, 69 nt, Artificial Sequence
  P08575_1-23
auguauuuaugguuaaaauuacuugcauuuggauuugcauuuuuagauacagaaguauuugugacuggg

SEQ ID NO: 1529 - RNA, 69 nt, Artificial Sequence
  Q8IWY4_1-23
augggagcagcagcaguaagauggcauuuauguguauuauuagcauuaggaacaagaggaagauuagca

SEQ ID NO: 1530 - RNA, 69 nt, Artificial Sequence
  Q08431_1-23
augccucguccucguuuauuagcugcuuuauguggugcuuuauuaugugcuccuucuuuauuaguugcu

SEQ ID NO: 1531 - RNA, 69 nt, Artificial Sequence
  Q99665_1-23
auggcccauacuuuucgcggauguucacuugcauuuauguuuauaauuacaugguuacuuauaaaagca

SEQ ID NO: 1532 - RNA, 69 nt, Artificial Sequence
  Q6Q8B3_1-23
augucagcuccacgucuacuuauaucuauaauuauaaugguaucugcaucuucaucuucauguaugggu

SEQ ID NO: 1533 - RNA, 69 nt, Artificial Sequence
  Q07011_1-23
augggcaauagcuguuauaauauuguggccacacuuuuacuuguacuuaauuuugaacgcacacguuca

SEQ ID NO: 1534 - RNA, 69 nt, Artificial Sequence
  Q8NHL6_1-23
augacuccaauuuuaacuguacuuauaugcuuaggcuuaaguuuaggcccacgcacacacguacaagca

SEQ ID NO: 1535 - RNA, 69 nt, Artificial Sequence
  P36894_1-23
augccacaacuauauauauauauccgucuauuaggcgcuuacuuauucauuauaucuagaguucaaggu

SEQ ID NO: 1536 - RNA, 69 nt, Artificial Sequence
  Q16552_1-23
augaccccaggcaaaacaagccuaguaucacuacuauuacuauuaagccuagaagcaauaguaaaagca

SEQ ID NO: 1537 - RNA, 69 nt, Artificial Sequence
  P42081_1-23
auggauccacaauguacuaugggucuaucuaauauuuuauuuguaauggcauuuuuacuuucaggugca

SEQ ID NO: 1538 - RNA, 69 nt, Artificial Sequence
  P43121_1-23
auggguuuaccuagauuaguaugugcauuuuuauuagcagcuuguuguuguuguccacguguagcugga

SEQ ID NO: 1539 - RNA, 69 nt, Artificial Sequence
  O00206_1-23
augaugucugcaucuagauuagcagguacauuaauaccugcaauggcauuucuaucuuguguuagaccu

SEQ ID NO: 1540 - RNA, 69 nt, Artificial Sequence
  P42701_1-23
auggaaccauuaguaacauggguaguaccauuauuauuuuuauuuuuauuaucaagacaaggagcagca

SEQ ID NO: 1541 - RNA, 72 nt, Artificial Sequence
  P06729_1-24
augucuuuuccuuguaaauuuguugcuucuuuucuucuuauuuuuaauguuucuucuaaaggugcuguuucu

SEQ ID NO: 1542 - RNA, 72 nt, Artificial Sequence
  P15328_1-24
auggcacaaagaaugacaacacaauuacuauuacuauuaguauggguagcaguaguaggagaagcacaaaca

SEQ ID NO: 1543 - RNA, 72 nt, Artificial Sequence
  P05112_1-24
augggucuuacuucucaacuuuuaccuccucuuuuuuuuuuacuugcuugugcugguaauuuuguucauggu

SEQ ID NO: 1544 - RNA, 72 nt, Artificial Sequence
  P06127_1-24
augccaaugggaucacuacaaccauuagcaacacuauaucuauuaggaaugcuaguagcaucaugcuuagga

SEQ ID NO: 1545 - RNA, 72 nt, Artificial Sequence
  P32248_1-24
auggauuuagguaaaccuaugaaaucaguuuuaguuguagcuuuacuuguaauuuuucaaguauguuuaugu

SEQ ID NO: 1546 - RNA, 72 nt, Artificial Sequence
  Q7Z7D3_1-24
auggcaucauuaggacaaauauuauucuggagcauaauaagcauaauaauaauacuagcaggagcaauagca

SEQ ID NO: 1547 - RNA, 72 nt, Artificial Sequence
  P54756_1-24
augagaggaaguggaccaagaggagcaggaagaagaagaccaccaaguggaggaggagauacaccaauaaca

SEQ ID NO: 1548 - RNA, 72 nt, Artificial Sequence
  Q92823_1-24
augcaacuaaaaauaaugccaaaaaaaaaaagacuaucagccggaagaguaccacuaauacuauuccuaugc

SEQ ID NO: 1549 - RNA, 72 nt, Artificial Sequence
  P19320_1-24
augccaggaaaaaugguaguaauauuaggagcaaguaauauauuauggauaauguuugcagcaagucaagca

SEQ ID NO: 1550 - RNA, 72 nt, Artificial Sequence
  Q86UN2_1-24
auguuaagaaaaggauguuguguagaauuauuauuauuauuaguagcagcagaauuaccauuaggaggagga

SEQ ID NO: 1551 - RNA, 75 nt, Artificial Sequence
  P33151_1-25
augcaaagauuaaugauguuauuagcaacuucaggugcauguuuagguuuauuagcaguugcagcuguagcugca

SEQ ID NO: 1552 - RNA, 75 nt, Artificial Sequence
  P17813_1-25
auggauagagguacacuuccacuugcaguugcacuucuacuugcaucuugcucucuaucuccaacuucacuugca

SEQ ID NO: 1553 - RNA, 75 nt, Artificial Sequence
  P25445_1-25
augcuaggaauauggacacuacuaccacuaguacuaacaucaguagccagacuaucaucaaaaucaguaaacgca

SEQ ID NO: 1554 - RNA, 75 nt, Artificial Sequence
  P01730_1-25
augaacagaggaguaccauucagacaucuacuauuaguacuacaacuagcacuauuaccagcagcaacacaagga

SEQ ID NO: 1555 - RNA, 75 nt, Artificial Sequence
  Q685J3_1-25
augccuagaccuggaacuauggcucuaugucuacuuacacuuguacuuucacuuuuaccuccacaagcagcugca

SEQ ID NO: 1556 - RNA, 75 nt, Artificial Sequence
  P17787_1-25
auggcaagaagauguggaccaguagcauuauuauuaggauuuggauuauuaagauuauguaguggaguaugggga

SEQ ID NO: 1557 - RNA, 75 nt, Artificial Sequence
  Q6UQ28_1-25
auggcuguuuuucaugauauguuacuucaaccuuuagguauguuucuuugucuuucucuucaacuuucuucugcu

SEQ ID NO: 1558 - RNA, 75 nt, Artificial Sequence
  P13987_1-25
auggguauacaaggagguucaguuuuauuuggauuauuauuaguuuuagcaguauuuugucauaguggacauuca

SEQ ID NO: 1559 - RNA, 75 nt, Artificial Sequence
  P10721_1-25
augagaggagcaagaggggcaugggauuuuuuauguguauuauuauuauuauuaagaguacaaacaggaaguagu

SEQ ID NO: 1560 - RNA, 75 nt, Artificial Sequence
  P12319_1-25
auggcuccagcuauggaaucaccuacacuuuuauguguagcuuuacuuuuuuuugcaccugaugguguacuugca

SEQ ID NO: 1561 - RNA, 78 nt, Artificial Sequence
  Q9BZR6_1-26
augaaaagagcaagugcaggaggaaguagauuauuagcauggguauuaugguuacaagcauggcaaguagcagcacca

SEQ ID NO: 1562 - RNA, 78 nt, Artificial Sequence
  P25063_1-26
augggaagagcaaugguagcaagauuaggauuaggauuacuauuacuagcacuauuacuaccaacacaaauauauagc

SEQ ID NO: 1563 - RNA, 78 nt, Artificial Sequence
  Q9NR97_1-26
auggaaaauauguuucuacaaucaucuaugcuuacauguauauuucuacuuauaucuggaucuugcgaacuaugugca

SEQ ID NO: 1564 - RNA, 78 nt, Artificial Sequence
  Q8N131_1-26
augggauuaggagcaagaggagcaugggcagcauuauuauuaggaacauuacaaguauuagcauuauuaggagcagca

SEQ ID NO: 1565 - RNA, 78 nt, Artificial Sequence
  P49771_1-26
augacaguacuagcaccagcauggucaccaacaacauaucuauuacuauuacuauuacuaucaucaggacuaucaggc

SEQ ID NO: 1566 - RNA, 78 nt, Artificial Sequence
  P02679_1-26
augucuuggucucuucauccucguaaucuuauucuuuauuuuuaugcucuucuuuuucuuucuucuacuuguguugcu

SEQ ID NO: 1567 - RNA, 78 nt, Artificial Sequence
  P14784_1-26
auggcugcuccugcauuaucauggagauuaccauuacuaauucuauuacuaccucuagcaacaucuugggcuucagcu

SEQ ID NO: 1568 - RNA, 81 nt, Artificial Sequence
  P05362_1-27
auggcuccaucuucaccuagaccugcauuaccagcuuuauuaguauuauuaggugcauuauuuccuggaccuggaaaugca

SEQ ID NO: 1569 - RNA, 81 nt, Artificial Sequence
  Q13740_1-27
auggaaaguaaaggagcaaguucauguagacuauuauucugucuauuaauaucagcaacaguauuuagaccaggauuagga

SEQ ID NO: 1570 - RNA, 84 nt, Artificial Sequence
  Q13443_1-28
augggaaguggagcaagauuuccaaguggaacauuaagaguaagaugguuauuauuauuaggauuaguaggaccaguauuagga

SEQ ID NO: 1571 - RNA, 84 nt, Artificial Sequence
  P14151_1-28
augauauuuccauggaaaugucaaucaacacaaagagaucuauggaacauauucaaacuauggggauggacaaugcuauguugc

SEQ ID NO: 1572 - RNA, 84 nt, Artificial Sequence
  P56199_1-28
auggcaccaagaccaagagcaagaccaggaguagcaguagcauguugcuggcuauuaacaguaguauuaagauguugcguaagc

SEQ ID NO: 1573 - RNA, 84 nt, Artificial Sequence
  P11279_1-28
auggcugcaccuggaucugcacguagaccucuauuauuauuauuacuucuauuauuacuuggacuuaugcauugcgcuucagcu

SEQ ID NO: 1574 - RNA, 84 nt, Artificial Sequence
  P40259_1-28
auggcuagauuagcauuaucaccuguaccuucacauuggaugguagcucuauuacuauuacuaucugcagaaccaguuccagcu

SEQ ID NO: 1575 - RNA, 84 nt, Artificial Sequence
  P43681_1-28
auggaacuaggaggaccaggagcaccaagacuauuaccaccacuauuacuauuacuaggaacaggacuauuaagagcaaguuca

SEQ ID NO: 1576 - RNA, 84 nt, Artificial Sequence
  P18627_1-28
augugggaagcacaauuuuuaggacuauuauuuuuacaaccauuauggguagcaccaguaaaaccauuacaaccaggagcagaa

SEQ ID NO: 1577 - RNA, 84 nt, Artificial Sequence
  Q5ZPR3_1-28
auguuaagaagaagaggaaguccaggaaugggaguacauguaggagcagcauuaggagcauuaugguuuuguuuaacaggagca

SEQ ID NO: 1578 - RNA, 84 nt, Artificial Sequence
  P23415_1-28
auguacucauucaacacacuaagacuauaccuaugggaaacaauaguauucuucucacuagcagcaucaaaagaagcagaagca

SEQ ID NO: 1579 - RNA, 84 nt, Artificial Sequence
  Q8TD46_1-28
augcuuuguccuuggcguacugcuaaucuuggucuuuuacuuauucuuacuauuuuucuuguugcugcuucuucuucucuuugu

SEQ ID NO: 1580 - RNA, 87 nt, Artificial Sequence
  P17301_1-29
augggaccagaaagaacaggagcagcaccacuaccacuacuauuaguacuagcacuaucacaaggaauauuaaacuguugcuuagca

SEQ ID NO: 1581 - RNA, 87 nt, Artificial Sequence
  P12821_1-29
augggagcagcaucaggaagaagaggaccaggacuauuacuaccacuaccacuauuacuauuacuaccaccacaaccagcacuagca

SEQ ID NO: 1582 - RNA, 87 nt, Artificial Sequence
  Q14118_1-29
augagaaugagcguaggauuaucauuacuauugccauuauggggaagaacauucuuacuauuacuaagcguaguaauggcacaauca

SEQ ID NO: 1583 - RNA, 87 nt, Artificial Sequence
  P05231_1-29
augaauucuuuuucuacuucugcuuuugguccuguugcuuuuucucuuggucuucuuuuaguucuuccugcugcuuuuccugcuccu

SEQ ID NO: 1584 - RNA, 87 nt, Artificial Sequence
  O00602_1-29
auggaauuaagcggagcaacaauggcaagaggacuagcaguauuacuaguacuauuucuacauauaaaaaacuuaccagcacaagca

SEQ ID NO: 1585 - RNA, 87 nt, Artificial Sequence
  Q9Y6Q6_1-29
auggcaccaagagcaagaagaagaagaccauuauucgcacuauuacuauuaugcgcacuauuagcaagacuacaaguagcacuacaa

SEQ ID NO: 1586 - RNA, 87 nt, Artificial Sequence
  Q9ULI3_1-29
auggcuucaccuagagcuucacguuggccuccaccucuauuacuacuucuacuuccauuacuauuacuaccuccagcugcaccugga

SEQ ID NO: 1587 - RNA, 90 nt, Artificial Sequence
  Q8NBP7_1-30
augggaacaguaaguucaagaagaagcugguggccacuaccacuauuacuauuacuauuauuauuacuaggaccagcaggagcaagagca

SEQ ID NO: 1588 - RNA, 90 nt, Artificial Sequence
  P02675_1-30
augaaaagaaugguauccuggucauuccacaaacucaaaaccaugaaacaccuccuacuccuacuccuaugcguauuccuagucaaaucc

SEQ ID NO: 1589 - RNA, 90 nt, Artificial Sequence
  P06756_1-30
auggcauuuccaccaagaagaagauuaagauuaggaccaagaggacuaccacuauuacuaucaggauuacuauuaccauuaugcagagca

SEQ ID NO: 1590 - RNA, 93 nt, Artificial Sequence
  O60609_1-31
augguaagaccacuaaacccaagaccacuaccaccaguaguacuaaugcuacuacuacuacuaccaccaucaccacuaccacuagcagcagga

SEQ ID NO: 1591 - RNA, 93 nt, Artificial Sequence
  P50895_1-31
auggaaccaccagacgcaccagcacaagcaagaggagcaccaagauuacuauuacuagcaguauuacuagcagcacauccagaugcacaagca

SEQ ID NO: 1592 - RNA, 93 nt, Artificial Sequence
  P28906_1-31
augcuaguaagaagaggagcaagagcaggaccaagaaugccaagaggauggacagcacuaugucuauuaagccuauuaccaagcggauucaug

SEQ ID NO: 1593 - RNA, 93 nt, Artificial Sequence
  P08514_1-31
auggcuagagcuuuauguccauuacaagcauuaugguuauuagaauggguauuauuauuauuagguccaugugcugcuccuccagcaugggca

SEQ ID NO: 1594 - RNA, 93 nt, Artificial Sequence
  P00742_1-31
augggaagaccacuacaccuaguacuacuaucagcaucacuagcaggacuacuacuacuaggagaaucacuauucauaagaagagaacaagca

SEQ ID NO: 1595 - RNA, 96 nt, Artificial Sequence
  P26006_1-32
augggaccaggaccaaguagagcaccaagagcaccaagauuaauguuaugugcauuagcauuaaugguagcagcaggaggauguguaguaagugca

SEQ ID NO: 1596 - RNA, 96 nt, Artificial Sequence
  P13726_1-32
auggaaacaccagcauggccaagaguaccaagaccagaaacagcaguagcaagaacauuauuauuaggauggguauuugcacaaguagcaggagca

SEQ ID NO: 1597 - RNA, 96 nt, Artificial Sequence
  P11912_1-32
augccuggagguccagguguacuucaagcauuaccugcuacuauauuuuuauuauuuuuauuaucugcaguuuaucuuggaccuggaugucaagcu

SEQ ID NO: 1598 - RNA, 96 nt, Artificial Sequence
  Q9H6X2_1-32
auggcaacagcagaaagaagagcauuaggaauaggauuucaaugguuaaguuuagcaacauuaguauuaauaugugcaggacaaggaggaagaaga

SEQ ID NO: 1599 - RNA, 99 nt, Artificial Sequence
  Q8IWK6_1-33
auggaaccaccaggaagaagaagaggaagagcacaaccaccauuauuauuaccauuaaguuuauuagcauuauuagcauuauuaggaggaggaggagga

SEQ ID NO: 1600 - RNA, 99 nt, Artificial Sequence
  P58335_1-33
augguagcagaaagaaguccagcaagaaguccaggaaguugguuauuuccaggauuaugguuauuaguauuaaguggaccaggaggauuauuaagagca

SEQ ID NO: 1601 - RNA, 102 nt, Artificial Sequence
  P06731_1-34
auggaaucaccaucagcaccaccacacagauggugcauaccauggcaaagacuacuacuaacagcaucacuacuaacauucuggaacccaccaacaacagca

SEQ ID NO: 1602 - RNA, 102 nt, Artificial Sequence
  P33681_1-34
augggucacacuagacgucaagguacaucuccaucuaaauguccauaucuaaauuucuuucaacuucuaguucuagcuggacuuucacauuucuguucaggu

SEQ ID NO: 1603 - RNA, 105 nt, Artificial Sequence
  P38567_1-35
auggguguucuuaaauuuaaacauauuuuuuuucguucuuuuguuaaaucuucugguguuucucaaauuguuuuuacuuuucuucuuauuccuuguugucuuacu

SEQ ID NO: 1604 - RNA, 105 nt, Artificial Sequence
  P16410_1-35
auggcuugccuuggauuucaacgucacaaagcacaacuaaaucuagcuacacguacauggccauguacacuucuauuuuuccuucuauuuauaccuguauuuugc

SEQ ID NO: 1605 - RNA, 111 nt, Artificial Sequence
  P15814_1-37
augagaccaggaacaggacaaggaggauuagaagcaccaggagaaccaggaccaaauuuaagacaaagauggccauuauuauuauuaggauuagcaguaguaacacaugga

SEQ ID NO: 1606 - RNA, 114 nt, Artificial Sequence
  Q92956_1-38
auggaaccaccaggagauuggggaccaccaccauggagaucaacaccaaaaacagacguacuaagauuaguacuauaucuaacauucuuaggagcaccauguuacgcaccagca

SEQ ID NO: 1607 - RNA, 123 nt, Artificial Sequence
  Q86VB7_1-41
augucuaaacuuagaaugguacuucuagaagacucuggaucugcagauuuccguagacauuucguuaaccuuucaccuuucacuauaacuguaguucuacuucuaucugcauguuucguuaca

SEQ ID NO: 1608 - RNA, 123 nt, Artificial Sequence
  P08648_1-41
augggaucaagaacaccagaaagcccacuacaugcaguacaauuaagauggggaccaagaagaagaccaccauuacuaccacuauuacuauuacuauuaccaccaccaccaagaguaggagga

SEQ ID NO: 1609 - RNA, 123 nt, Artificial Sequence
  P16109_1-41
auggcaaacugucaaauagcaauacuauaucaaagauuccaaagaguaguauucggaauaagccaacuacuaugcuucagcgcacuaauaagcgaacuaacaaaccaaaaagaaguagcagca

SEQ ID NO: 1610 - RNA, 132 nt, Artificial Sequence
  O75326_1-44
augacaccaccaccaccaggaagagcagcaccaucagcaccaagagcaagaguaccaggaccaccagcaagauuaggauuaccauuaagauuaagauuacuauuacuauuaugggcagcagcagcaucagca

SEQ ID NO: 1611 - RNA, 135 nt, Artificial Sequence
  Q8N2Q7_1-45
auggcuuuaccuagauguacauggccaaauuauguuuggcgugcaguuauggcuuguuuaguacauagagguuuaggugcaccuuuaacuuuauguauguuaggauguuuauuacaagcuggacauguauuauca

SEQ ID NO: 1612 - RNA, 138 nt, Artificial Sequence
  Q86UN3_1-46
augcuuccaggucuacguagacuucuacaagcuccugcaucugcaugucuacuucuaaugcuacuugcacuuccacuugcagcaccaucuugcccuaugcuuugcacuugcuauucaucuccaccuacaguuucaugu

SEQ ID NO: 1613 - RNA, 540 nt, Artificial Sequence
  A0A5B9
auggaccuaaaaaacguauucccaccagaaguagcaguauucgaaccaucagaagcagaaauaucacacacacaaaaagcaacacuaguauguuuagcaacaggauucuacccagaccacguagaauuaucaugguggguaaacggaaaagaaguacacucaggaguaucaacugacccacaaccacuaaaagaacaaccagcauuaaacgacucaagauacugcuuaucaucaagacuaagaguaucagcaacauucuggcaaaacccaagaaaucacuuuagaugccaaguacaauucuacggacuaucagaaaacgacgaauggacacaagacagagcaaaaccaguaacacaaauaguaucagcagaagcauggggaagagcagacugcggauucacaucagaaucauaccaacaaggaguacuaucagcaacaauacuauacgaaauacuacuaggaaaagcaacacuauacgcaguccuaguaucagcacuaguacuaauggcaaugguaaaaagaaaagacucaagaggauaa

SEQ ID NO: 1614 - RNA, 465 nt, Artificial Sequence
  B7Z8K6
augucacaaccacacacaaaaccaucaguauucguaaugaaaaacggaacaaacguagcaugccuaguaaaagaauucuacccaaaagacauaagaauaaaccuaguaucaucaaaaaaaauaacagaauucgacccagcaauaguaauaucaccaucaggcaaauacaacgcaguaaaacuaggaaaauacgaagacucaaacucaguaacaugcucaguacaacacgacaacaaaacaguacacucaacagacuucgaagucaaaacagacucaacagaccacguaaaaccaaaagaaacagaaaacacaaaacaaccaucaaaaucaugccacaaaccaaaagcaauaguacacacagaaaaaguaaacaugaugucacucacaguacuaggacuacgaaugcucuucgcaaaaacaguagcaguaaacuuccuacuaacagcaaaacuauucuuccuauaa

SEQ ID NO: 1615 - RNA, 645 nt, Artificial Sequence
  B9A064
augagaccaaaaacaggacaaguaggaugugaaacaccagaagaacuaggaccaggaccaagacaaagauggccucucuuacucuuaggauuagcaaugguagcucacggcuuacuaagaccaaugguagcaccacaaucaggagauccagacccaggagcaagcguaggaucaucaagaucaucauuaagaucauuauggggaagacuauuacuacaaccaucaccacaaagagcagaccccagauguuggccaagaggauucuggucagaaccacaaucauuauguuauguauucggaacaggcacaaaaguaacaguacuaggacaaccaaaagcaaacccaacaguaacauuauucccaccaucaagugaagaauuacaagcaaacaaagcaacacuaguaugcuuaauaagcgacuuuuauccaggagcagucacaguagcauggaaagcagauggaucacccguaaaagcaggcguugaaacaaccaaaccaucaaaacaaucaaauaacaaauacgcagcaucaucauaucuaucacuaacuccagaacaauggaaaucacacagaucauacucaugucaaguaacacaugaagguucaacaguagaaaaaacagucgcaccuacagaauguucauga

SEQ ID NO: 1616 - RNA, 2520 nt, Artificial Sequence
  O00206
augaugucagcuucuagacuugcaggcacccuaauacccgcaauggcauuccuaucauguguaagaccugaauccugggaaccuugcguagaaguuguaccuaacaucacauaccaaugcauggaacucaauuuuuauaaaaucccagacaaucuaccauuuucaaccaaaaaucuagaccuuuccuuuaacccauuaagacaucuuggaucauauucauucuucucauucccugaacuacaaguacucgaucuuucacguugcgaaauccaaacaauagaagacggcgcuuaccaaucacucucacaucuaucuacucuuauauuaacuggaaaccccauacaaucauuggcacucggagcauucucagggcucucaucacuccaaaaauuaguugcuguugaaacaaacuuagccucacuagaaaacuuuccuauaggacaucuuaaaacacucaaagaacucaauguagcacacaaccucauacaaucauucaaacuucccgaauacuucucaaaucucaccaaccuagaacaucuugaccucaguucaaacaaaauacaaucaauauacugcacggaucuacgcguacuacaucaaaugccccuuuuaaaccuaagccuagacuuaucuuuaaacccaaugaacuuuauucaacccggcgcauuuaaagaaauacgucuucauaaauuaacccuuagaaacaauuuugacucucuaaacguuaugaaaacaugcauacaaggauuagcuggccuugaaguacaccgucuaguacucggagaauuuagaaaugaaggaaaucuagaaaaauuugacaaaucugcauuagaaggauuauguaaccuaacuauugaagaauuucgucucgcauacuuagauuauuaccuagacgacauaauagaucuauuuaauuguuuaacaaauguaucuagcuucucucuaguaucaguuacgauugaaagaguaaaagauuucuccuacaauuucggcuggcaacacuuagaauuaguaaacuguaaauucggccaauuuccaacucuaaaacuaaaaucauuaaaacgccuaaccuuuacaucuaauaaaggaggaaaugcauuuucugaagucgaccucccaucccuagaauuucuagaucuaagucgcaauggacuaucauucaaaggauguugcucacaaucagauuuuggaacaacaucacucaaauauuuagauuuaucauucaacggcguaauaacaauguccucaaacuuucuaggccucgaacaauuggaacacuuagacuuccaacauucaaauuuaaaacaaauguccgaguucagcguauuucuuucccugcgaaaccuaauauaccucgacauaucccacacacauacgaggguagcuuucaacgguauuuuuaacggcuuaucaucacuagaaguacucaaaauggccggcaacucuuuccaagaaaauuuccuacccgacauauucacagaacuaagaaaucuaacauuccucgaccucucccagugccaacucgaacaacugagcccuacagcuuuuaacucccuaagcucucuacaaguacucaacaugucacauaacaacuucuucucuuuagacaccuucccauauaaaugccucaauucccuucagguauuagacuauaguuuaaaccauauuaugacaucaaagaaacaggaacuucaacacuuccccuccagccucgcuuucuuaaacuuaacacaaaaugauuucgcuuguacaugugaacaccaaucuuuucuacaauggauaaaagaccaacgucaacuauuagucgaaguagaacgcauggaaugugccacacccuccgauaaacaaggcaugcccguacuaucacuaaacaucacaugucaaaugaacaaaacuauaauaggcguuucaguccuuucaguucuagucguauccguagucgcuguccuaguauauaaauucuauuuccaccuaauguuauuggcuggcuguauaaaauauggucgcggugaaaacaucuacgacgcuuucguaauauacagcagucaagacgaagacuggguaagaaacgaacuugucaaaaaucuagaagaaggcguaccucccuuccaacuaugccuacauuaccgagauuucauacccgguguagccauagcagcaaauauuauccacgaaggcuuccacaaauccagaaaaguaauugucguuguaucccagcacuuuauacaaucaagaugguguauuuucgaauacgaaauugcccaaaccuggcaauuuuuaucaucacgagcaggaaucaucuuuauaguauuacaaaaaguugagaaaacacucuuacgacaacaaguagaacuauauagacuuuuaucucgcaauacauaucuagaaugggaagauucuguuuuaggaagacacaucuucuggagaagacuaagaaaagcacuauuagacggcaaaucauggaaucccgaagguacaguaggaacuggcuguaauuggcaagaagcaacaucaauauga

SEQ ID NO: 1617 - RNA, 1377 nt, Artificial Sequence
  P01730
augaaccgaggaguaccauuccgacaccuccuacuaguacuacaacuagcacuauuaccagcagcaacacaaggaaaaaaaguaguacuaggaaaaaaaggagacacaguagaauuaaccuguacagcaagccaaaaaaaaucaauacaauuccacuggaaaaacucaaaccaaauaaaaauauuagguaaccaaggcaguuuucuaacaaagggaccaagcaaauuaaacgauagggccgauucaagaagaucacuuugggaccaaggcaacuucccauuaauaauaaaaaauuuaaaaauagaagauagcgacaccuacauaugugaaguagaagaccaaaaagaagagguacaacuauuaguauucggacuaaccgccaacucggacacacacuuauuacaaggacaaucacucacccuaacauuagaaucaccaccaggauccagcccaucaguacaaugcagaucacccagaggaaaaaacauacaaggaggaaaaaccuuaagcguaucucaacucgaacuacaagacucaggaacauggacaugcacaguucuacaaaaccaaaaaaaagucgaauucaaaauagauauaguaguauuagcauuccaaaaagcaagcucuauaguuuauaaaaaagaaggagaacaaguagaauucaguuuccccuuagcauucaccguagaaaaauuaacuggcagcggagaacuuugguggcaagcugaacgagcgagcagcucaaaaucauggauaacauucgaucuaaaaaauaaagaaguaagcguuaaaagaguaacucaagacccaaaacuucaaaugggaaaaaaacuaccucuacaucuaacacucccacaagcauuaccacaauaugcaggaucaggcaauuuaacacuagcucuagaagcaaaaacaggaaaacuacaucaagaaguaaauuuagucguaaugcgcgccacccaauuacaaaaaaaucucacaugcgaaguauggggaccaaccucucccaaacuaauguuaucacucaaauuagaaaauaaagaagcaaaaguaagcaaaagagaaaaagcaguauggguacuaaacccagaagcaggaauguggcaaugccuauuaucagauuccggacaaguacuacuagaauccaauauaaagguacuaccaacauggucaaccccaguucaaccaauggcauuaauaguccuaggcggaguagccggacuacuauuauucauuggacuaggaauauucuucuguguuagaugcagacauagaagaagacaagcugaaagaaugucacaaaucaaaagacuauuaagugaaaagaaaacaugccaaugcccacaccgcuuucaaaaaacaugcagcccuauauga

SEQ ID NO: 1618 - RNA, 537 nt, Artificial Sequence
  P01850
auggaagaucuaaauaaaguauucccaccagaaguagcaguauuugaaccaagcgaagcagaaauaucgcacacacaaaaagcaacacuaguaugcuuagcaacuggauuuuucccagaccauguagaacuaucaugguggguaaauggaaaagaaguacacucaggaguaucaacagacccacaaccacuaaaagaacaaccagcacuaaaugacucaagauacugccuaagcucaagauuaagaguaagcgcaaccuucuggcaaaacccaagaaaucacuucagaugucaaguacaauuuuacggacuaucagaaaaugacgaauggacacaagacagagcaaaaccaguaacacaaauaguaucagcagaagcauggggaagagcagacugcggauucacaagcguaagcuaucaacaaggaguacuaucagcaacaauauuauacgaaauacuacuaggaaaagcaacauuauacgcaguauuaguaucagcauuaguauuaauggcaaugguaaaaagaaaagauuucuaa

SEQ ID NO: 1619 - RNA, 624 nt, Artificial Sequence
  P07766
augcaaaguggaacacauuggagaguauuaggauuaugcuuauuaucaguaggaguauggggacaagacggaaacgaagaaaugggaggaauaacgcaaacaccauauaaaguaagcauaaguggaacaacaguaauacuaacaugcccacaauauccaggaagcgaaauacuauggcaacacaaugacaaaaauauaggaggagacgaagaugacaaaaauauaggaagugaugaagaucacuuaagccuaaaagaauuuucagaauuagaacaaagcggauacuauguauguuacccaagaggaaguaaaccagaagacgcaaacuucuacuuauacuugagagcaagaguaugcgaaaacuguauggaaauggauguaaugaguguagcaacaauaguaauaguagacauaugcauaacagggggauuacuacuauuaguauacuauuggaguaaaaacagaaaagcaaaagcaaaaccaguaacaagaggagcaggagcaggaggaagacaaagaggacaaaauaaagaaagaccaccaccaguaccaaacccagacuacgaaccaauaagaaaaggacaaagagacuuauacucaggauuaaaccaaagaagaauauga

SEQ ID NO: 1620 - RNA, 3915 nt, Artificial Sequence
  P08575
auguacuuauggcucaaacuauuagcauucggauuugccuuucucgacaccgaagucuuuguaacuggccaauccccaacacccucccccaccggccuaacuaccgcaaaaaugccgucagucccccuuucaucugaucccuugccaacacacacaacagcauuuucaccggcaagcacuuuugaacgagaaaacgauuuuucugagacaacaacaagucuauccccagacaacacuuccacccagguuuccccagauucccuagauaacgcaagugcauucaacacuacaggaguguccucuguacaaacgccacaucuaccgacacacgcugacucacaaacaccuagugcaggaaccgauacccaaacauuuucaggcucugccgccaacgcuaaauugaacccaacgccuggcagcaacgcaauaucugacguucccggcgaacgcucaacagcuucuaccuuuccaaccgauccaguuaguccuuuaacaacaacuuuaagccuagcacaccauucaucagccgcucuaccagcucgaaccucuaacacaaccauuacagcaaacaccuccgaugcauaucuuaacgcaucagaaacaacuacauuguccccaucaggaucugcggucaucaguacaaccacuauagcaaccacaccuucaaaaccuaccugcgaugaaaaauaugccaacauuacaguagauuaccuauacaauaaagaaacaaaauuguuuaccgcaaaauuaaacgucaacgaaaauguagaaugcggaaacaauacaugcacuaacaaugaaguacacaaccuuacagaaugcaaaaaugcgucuguauccauaagccauaacucauguacagccccugacaaaacauuaauacuagacguaccacccggcguagaaaaauuucagcuucacgauuguacacagguagaaaaagccgauaccacuauaugcuuaaaauggaaaaauauagaaacguuuacuugugauacacaaaauauuaccuauagauuccaaugcgggaauaugauauuugacaacaaagaaaucaaauuagaaaauuuagaaccugaacacgaauauaaaugugacagcgaaauacuuuacaauaaucauaaauuuacaaaugcaucaaaaauaaucaaaaccgauuucgguucaccaggugaaccccaaauuaucuuuugcaggagcgaagcagcacaccaagguguaauaacuuggaauccaccucaaagaucuuuucacaacuucacauuaugcuacaucaaagaaacagaaaaagauugccuaaaucuagauaaaaauuuaaucaaauaugauuuacaaaaucuaaaacccuacacuaaauacguauugagcuuacacgcauacauaauugcaaaaguacaacgcaacggaucagcagcaaugugucacuucaccaccaaaucugcuccaccaucccaaguauggaacaugaccguaucaaugacuucagauaauucuaugcauguaaaaugcagacccccgagagacagaaacggaccacaugaaagauaucaucuugaaguugaagcgggaaauacccucguacgcaacgagucacacaaaaauugcgacuucagagugaaagaucuacaauauuccacagacuacaccuucaaagcauauuuucacaacggugauuacccaggagaaccuuucauuuugcaucauucuacauccuacaauagcaaagcacuaauagcauucuuggcuuuucuaauaauaguaacauccauagcacuucuagucguacuauacaaaauuuaugauuuacacaagaaaagaucauguaaccucgacgaacaacaggaauuagucgaaagagaugaugaaaaacaacugaugaacgucgaaccaauucaugcagacauccuauuagaaacauauaaaagaaaaauagcugacgaagguagauuauuucuagcagaguuccaaucaauaccuagaguuuucagcaaauucccaauaaaagaagcaagaaaaccuuucaaccaaaauaaaaaccgauacguugauauuuuaccauacgacuauaacagaguugaacuaagugaaauaaacggagacgcaggaaguaauuauaucaaugcauccuacauagacggguucaaagaaccaagaaaauauaucgcagcacaaggcccucgagaugaaacaguugaugauuuuuggagaaugauaugggaacaaaaagcaaccgugauuguaaugguuaccagaugcgaagaaggaaacagaaacaaaugugcggaauacuggcccaguauggaagaagguacaagagcauuuggggaugucguagucaaaauaaaucagcauaaaagaugcccugacuacauuauucaaaaacugaauauugucaacaagaaagaaaaagcaacaggacgugaaguaacucauauacaauucaccucuuggccagaucauggaguacccgaagacccgcauuuacugcuaaaacuucgcagaagaguaaaugcauucucaaacuucuucagcgguccgauuguaguacacuguucagcaggcguaggcagaacaggaacuuacauaggaauagacgccaugcuagaaggacucgaagcugaaaacaaagucgaugucuaugguuauguugugaaacuuagacgacaaagaugccuaaugguucaaguagaagcacaauacauccucauccaccaagcacucguugaauacaaucaauuuggagaaacagaaguaaaccuuucugaauuacaccccuaccuccacaacaugaagaaaagagaucccccaagugaaccuucaccgcuagaagcugaguuccaaagguuacccuccuauagauccuggagaacccaacauauaggcaaccaggaagaaaacaaaaguaaaaaucgcaacucaaaugucaucccuuaugacuacaauagaguucccuuaaaacaugaauuagaaaugucuaaagaaucugaacaugacagugacgaaucuuccgacgacgauuccgauagugaagaaccaucuaaauacauaaacgcaucguuuaucaugagcuauuggaaaccagaaguaaugaucgcagcacaagguccacuuaaagaaacgaucggagauuuuuggcaaaugaucuuucaaagaaaagucaaagucauaguaaugcugacugaacuuaaacauggagaccaagaaauaugugcccaauacuggggagaagguaaacaaacauacggagacauagaagucgacuuaaaagacacagacaaaaguucaaccuacacccuaagaguauuugagcuucgacauucgaaacgaaaagauucaagaacaguauaccaauaucaauauaccaauuggucagucgaacaacucccagcugaacccaaagaauuaauaucaaugauucaaguagucaaacagaaacuaccacagaaaaauagcucagaggguaauaaacaucacaaaucaaccccauuauuaauccauugcagagauggaagucaacaaacgggaauauucugugcucuguuaaaccuacuagaaucagcagaaacagaggaaguaguggauauauuucagguaguuaaagcacuuagaaaagcacguccaggaaugguuucaacauuugaacaauaccaauuucuauacgacguuauagcuucaacuuauccagcucaaaacggacaggugaagaaaaacaaucaccaagaagauaaaauugaguuugacaacgaaguagacaaagucaaacaagaugcuaacugugucaacccguuaggugccccugaaaaacuaccagaagccaaagaacaagcagaaggcucagaaccaacaucuggcaccgaaggaccagaacacaguguaaauggucccgccagcccagcuuuaaaucaagguucauaa

SEQ ID NO: 1621 - RNA, 765 nt, Artificial Sequence
  P08637
auguggcaacuacuacuaccaacagcacucuuacuauuaguaucagcaggaaugagaacagaagaccucccaaaagcaguaguauuccuagaaccacaaugguacagaguacuagaaaaagacucaguaacauuaaaaugccaaggagcauacucaccagaagauaacucaacccaaugguuccacaacgaaucacuaauaucaucccaagcaucaucauacuucauagacgcagcaacaguagacgacucuggagaauacagaugccaaaccaacuuaucaacauuaucagacccaguacaacuagaaguccacauaggauggcuacuacuacaagcacccagaugggucuucaaagaagaagacccaauacaccuaagaugccacagcuggaaaaacacagcauuacacaaaguaacauaccuacaaaacggaaaaggaagaaaauacuuucaccacaacucagacuuuuacauaccaaaagccacauuaaaagacucaggaucauacuucugccgaggacuauucggauccaaaaacguuucaucagaaacaguaaacauaacaauaacacaaggacuagcagucucaacaauaucaucauucuucccaccaggcuaccaaguaucauucugccuaguaaugguauuacuauuugcaguagacacaggacuauacuucucaguaaaaacaaacauaagaucaucaacaagagacuggaaagaccacaaauuuaaauggagaaaagacccacaagacaaauga

SEQ ID NO: 1622 - RNA, 663 nt, Artificial Sequence
  P10747
auguuaagacuacuacuagcacuaaaccuauucccaucaauacaaguaaccggaaacaaaauacuaguaaaacaaucaccaaugcuaguagcauacgacaacgcaguaaacuuaucaugcaaauacuccuacaaccuauucucuagagaauucagagcaucacuccacaaaggacuagacucagcaguagaaguaugcguaguauacggaaacuacucccaacaacuacaaguauacucaaaaacaggauucaacugcgacggaaaacuaggaaacgaaucaguaacauucuaccuacaaaaccuauacguaaaccaaacagacauauacuucugcaaaauagaaguaauguacccaccaccauaucuagacaacgaaaaaucaaacggaacuauaauccacguaaaaggaaaacaccucugcccaucaccacuauuccccggaccaucaaaaccauucuggguauuaguaguaguaggaggaguacuagcaugcuacucacuacuagucacaguagcauucauaauauucuggguaagaucaaaaagaucaagauuacuacacucagacuacaugaacaugacaccaagacgaccaggaccaacaagaaaacacuaucaaccauacgcaccaccaagagacuucgcagcauaccgaucauga

SEQ ID NO: 1623 - RNA, 681 nt, Artificial Sequence
  P11912
augccaggaggaccaggaguauuacaagcacuaccagcaacaauauuucuauuauuuuuacuaucugcaguauacuuaggaccuggaugucaagcauuauggaugcauaaaguaccagcuagcuuaaugguaucacuaggagaagacgcacacuuucaauguccacauaacucuucaaacaacgcaaacguaacaugguggagaguacuacacggaaacuauacauggccaccagaauuucuaggaccaggagaagauccaaauggaacauuaauaauacaaaacguaaacaaaagccacggaggaauauauguauguagaguacaagaaggaaaugaaucauaccaacaaucaugcggaacauaucuaagaguaagacaaccaccaccaagaccauucuuagacaugggagaaggaacuaaaaauagaauaauaacagcagaaggaauaauauuacuauuuugcgcaguaguacccggaacauuacuauuauuuagaaaacgauggcaaaacgaaaaauuaggacuagacgcaggagaugaauaugaagaugaaaaucuauaugaaggacuaaaucuagaugacuguucaauguacgaagacauaucacgaggacuacaaggaacauaucaagauguaggaucauuaaacauaggagacguacaauuagaaaaaccauga

SEQ ID NO: 1624 - RNA, 1671 nt, Artificial Sequence
  P15391
augccaccacccagauuauuauuuuuccuacuauucuuaacaccaauggaaguaagaccagaagaaccauuaguaguaaaaguagaagaaggugauaaugcgguacuucaauguuuaaaaggaacaucggauggaccaacacaacaauuaacauggucaagagaaaguccauuaaaaccguuuuuaaaauuaaguuuaggauuaccuggacuuggaauacauaugagaccacuagcaauaugguuauucauuuuuaauguaucacaacaaaugggaggauuuuaccuaugccaaccaggaccaccaagugaaaaggcuuggcaaccuggauggacaguaaauguagaaggauccggugaacuauuuagauggaacguaucagaucuugguggauuaggaugcggucuuaaaaauagauccagugaaggaccaaguagcccaaguggaaaacuaaugaguccaaaacuauacguaugggcaaaagaucgaccagagaucugggaaggagaaccuccauguuuaccuccaagagauagucuaaaucaaagucuuucacaagacuuaacaauggcaccaggaaguacuuuguggcuaucuuguggcguaccaccggauucuguaagcagaggaccgcuaaguuggacacauguacauccuaaaggaccaaaaaguuuauuaucacuagaacuaaaagaugacagaccagcuagggauauguggguuauggaaacaggauuguuauuacccagagcuacagcgcaggaugcuggaaaauauuauugccauagaggaaaucuaacaaugaguuuccacuuagaaauuacagcacgaccaguacuauggcauugguuauuaagaacaggaggauggaaaguaucugcaguaacauuagccuaucucauauuuugcuuauguucauuaguaggcauacuacaucuucaaagagcuuuaguacucagaagaaaaagaaagagaaugacagauccaacacgaagauuuuucaaaguuacacccccaccuggcucaggaccucaaaaucaauaugguaauguacuuucacuucccacaccuacaucugguuuagggagagcacaaagaugggcagcuggauuaggcggcacagcuccauccuaugguaauccaucaagugauguacaagcagauggagcacucggaaguagaagcccuccgggaguaggaccagaagaagaagaaggagaaggauaugaagaaccagauucagaagaagauagugaauuuuacgaaaaugauuccaauuuaggucaagaucaauuaagucaagacgguagcggauaugaaaauccugaagaugaaccauuagguccugaagaugaagacucauucucgaaugcagaaaguuaugaaaacgaagaugaagaacuaacucaaccaguagcaagaacaauggacuuuuuauccccacauggaucagcuugggauccaucaagagaagccacaucauuaggaucccaaaguuaugaagauaugagaggaauauuauaugcugcaccucaauugcgaucuauaagaggacaaccgggaccaaaucaugaagaagaugcagauagcuaugaaaacauggauaacccagauggaccugauccagcauggggaggaggaggucgaauggguacauggucaacaagauaa

SEQ ID NO: 1625 - RNA, 672 nt, Artificial Sequence
  P16410
auggcuugccuaggauuccaaagacacaaagcacaacuaaaccuagcaacacgaacauggccaugcacacuauuauucuucuuacuauucauaccaguauucugcaaagcaaugcauguagcacaaccagccguaguacuagcauccucaagaggaauagcaucauucguaugcgaauacgcaucaccaggaaaagcaacagaaguaagaguaacaguauuaagacaagcagacucacaaguaacagaaguaugcgcagcaacauacaugaugggaaacgaauuaacauucuuagacgacucaauaugcacaggaacaucaagcggcaaccaaguaaaucuaacaauacaaggacuaagagcaauggacacaggccuauacauaugcaaaguagaacuaauguacccaccaccauacuaccuaggaauaggaaacggcacacaaauauacguaauagacccagaaccauguccagauucagacuucuuauuauggauacuagcagcagucucaucaggauuauucuucuacucauuccuacuaacagcaguaucacuaucaaaaauguuaaaaaaaagaucaccacuaacaacaggcguauacguaaaaaugccaccaacagaaccagaaugcgaaaaacaauuccaaccauacuucaucccuauaaacuga

SEQ ID NO: 1626 - RNA, 1419 nt, Artificial Sequence
  P16671
augggaugcgacagaaacugcggccuaauugcaggagcaguaauaggagcaguacuugccguauucggaggaauacucaugccaguuggagaccuccuaauacaaaaaacaaucaaaaaacaaguaguacuagaagaaggcacaaucgcauuuaaaaacuggguaaaaacaggaacagaaguauaccgacaauucuggauauuugacguacaaaauccacaagaagucaugaugaacagcucuaacauacaaguaaaacaacgaggaccauacacauacagaguaagauucuuagcaaaagaaaacguaacccaagacgccgaagacaacaccgucucauuucuacaaccaaacggagccauauucgaaccuucauuaucaguaggcacugaagcagauaacuucacaguacuaaaucuagcaguagcagcagcaagucacauauaccaaaaccaauucguacaaaugauacuaaacuccuuaauaaacaaaucaaaaucaucaauguuucaaguaagaacacuacgagaauuacuauggggauacagagacccauuccuaucucuaguucccuauccaguaacuacaacagucggacuuuucuaucccuauaacaacacugcugacggcgucuacaaaguauucaacggaaaagacaacauauccaaagucgcgauaauagacacauacaaagguaaacgcaaccuaucuuacugggaaucacacugugacaugauaaacggaacagacgcagcauccuuccccccauucguagaaaaaucacaagucuuacaauucuucucauccgacaucuguagaucaauauacgcaguauucgaauccgauguaaaucucaaaggaauuccaguauaccgauucgucuuaccaucuaaagcauuugcaucacccguagaaaauccagacaacuacuguuucugcacagaaaaaauaauuuccaaaaacugcacaucauacggcguacucgauauuucaaaaugcaaagaaggcagacccguauacaucucacuaccacauuuucuauacgcaagccccgauguaagcgaaccaauagauggacucaacccaaacgaagaagaacacagaacauauuuagacauagaacccauuacaggcuucacacuacaauucgcuaaaagauuacaagucaaucuacuagucaaaccaucagaaaaaauucaaguccuaaaaaauuuaaaaaggaauuacauaguaccaauacuaugguuaaaugaaacaggaacaauaggggaugaaaaagcaaauauguuccgaucacaaguaacaggcaaaauaaaccuccuaggauuaauagaaaugauacuauuaucaguaggcguagucauguuuguagcauuuaugauaucauacugcgccugcagaucaaaaacaauaaaauga

SEQ ID NO: 1627 - RNA, 651 nt, Artificial Sequence
  P26718
augggauggauaagaggaagaagaagcagacacucaugggaaaugucagaauuccacaacuacaaccuagaccuaaaaaaaucagacuucucaacaagauggcaaaaacaaagaugcccaguaguaaaaucaaaauguagagaaaacgcaucaccauucuucuucugcugcuuuauagcaguagcaaugggaauaagauucauaauaaugguagcaauauggagcgcaguauuccuaaacucacuauucaaucaagaaguacaaauaccauuaacagaaucauacugcggaccaugcccaaaaaauuggaucugcuacaaaaacaacugcuaccaauucuucgacgaaaguaaaaacugguacgaaagccaagcaucaugcaugagccaaaacgcaucacuacuaaaaguauacagcaaagaagaccaagaccuacuaaaacucguaaaaagcuaccacuggaugggacuaguacacauaccaacaaacggaagcuggcaaugggaagacggaucaauacuaagcccaaaccucuuaacaauaauagaaaugcaaaaaggcgacugcgcauuauacgcaucaagcuucaaaggauacauagaaaacugcucaacaccaaacacauacauaugcaugcaaagaacaguauaa

SEQ ID NO: 1628 - RNA, 261 nt, Artificial Sequence
  P30273
augauaccagcaguaguacuacuacuacuacuauuaguagaacaagcagcagcacuaggagaaccacaacuaugcuacauacuagacgcaauacuauuccuauacggaauaguacucacacuacuauacugcagacuaaaaauacaaguaagaaaagcagcaauaacaucauacgaaaaaucagacggaguauacacaggacuaucaacaagaaaccaagaaacauacgaaacacuaaaacacgaaaaaccaccacaauag

SEQ ID NO: 1629 - RNA, 1137 nt, Artificial Sequence
  P32248
auggauuuaggcaaaccaaugaaauccguauuaguagucgcucuccuaguaauauuccaaguaugucuaugucaagacgaaguaaccgacgacuacauaggagacaacacuacaguugacuauacccuauucgaaagcuuaugcucaaaaaaagauguaagaaauuucaaagcaugguuucuaccaaucauguauucaaucauauguuucguaggccuauuaggaaacggacuaguagucuuaacuuauauauauuucaaacgacuaaaaacaaugacagacacuuacuuacuaaacuuagcaguagcagacauccuauuccuauuaacauuacccuucugggcauacucugccgcaaaaucuuggguauuuggaguccacuucugcaaacuaauauucgcuauauacaaaaugucauuuuucuccggaaugcuacucuuauuauguaucucaauagacagauauguagcaauaguacaagcaguauccgcccacagacacagagcuagaguacucuuaaucucaaaacuuucaugcguaggaauauggauauuagcuacaguauuaucaauaccagaacuuuuauacucugaucuacaaagauccucaucagaacaagcaaugcguugcucucuaauaaccgaacacguagaagcauucauuacaauacaaguagcacaaauggucauaggauuccuaguaccacuauuagcaauguccuucugcuacuuaguaaucauaagaacacuauuacaagcacgaaauuucgaaagaaauaaagcaaucaaaguaauaauagcgguaguagucguauuuauaguuuuucaacuaccauacaacggaguaguacucgcacaaacaguugcaaauuucaacauuacuucauccaccugcgaauuaucuaaacaauuaaauauagcauacgaugucacauacucacuagcaugcguacgcuguuguguuaacccauucuuauaugcauucauaggaguaaaauucagaaacgacuuauuuaaacuauucaaagaccucggaugcuuaucucaagaacaacuaagacaaugguccucaugcagacacauaagaagauccucaaugucaguagaagcagaaacaacaacaacauucucucccuga

SEQ ID NO: 1630 - RNA, 690 nt, Artificial Sequence
  P40259
auggcaagauuagcauugaguccaguaccaagccauuggaugguagcauuauuacuauuauuaucagcagaaccaguaccagcagcaagaagcgaagacagauacagaaacccaaaaggaagcgcaugcucaagaauauggcaaagcccaagauucauagcaagaaaaagaggauucacaguaaaaaugcauugcuauaugaauagcgcgagcggaaacguaaguuggcuauggaaacaagaaauggacgaaaacccacaacaacuaaaacuagaaaaaggaagaauggaagaaagucaaaacgagagcuuagcaacacuaacaauacaaggaauaagauucgaagauaacggaauauauuucugucaacaaaaaugcaauaauaccucagaaguauaucaaggauguggaacagaauuaagaguaaugggauucucaacauuagcacaacuaaaacaaagaaacacacuaaaagacggaauaauaaugauacaaacacuauuaauaauacuauuuauaauaguaccgauauuuuuacuauuagauaaagacgacucaaaagcgggaauggaagaagaccauacauaugaaggacuagauauagaucaaacagcaacauaugaagacauaguaacacuaagaacaggagaaguaaaauggagcguaggagaacacccaggacaagaauga

SEQ ID NO: 1631 - RNA, 990 nt, Artificial Sequence
  P42081
auggacccacaaugcaccaugggacuaucaaauauacuauucguaauggcauucuuacuauccggagcagcaccacuaaaaauccaagcauacuucaaugaaacagcugaucuaccaugccaauucgcaaacucccaaaaccaaucacuaucagaauuaguaguuuucuggcaagaccaagaaaacuuaguacucaacgaaguauaccucggaaaagaaaaauucgacucaguacauuccaaauacaugggacgaacaucauucgacucagacuccuggacauuaagacuacacaaucuacaaauaaaagauaaaggacuauaccaauguauuauacaccacaaaaaaccaacaggaaugauaagaauacaccaaaugaacucagaacucucaguucucgcaaacuucucacaaccagaaauaguaccaauaucaaacauaacagaaaauguauacauaaacuuaacuugcucaucuauacacggauaccccgaaccaaaaaaaaugucaguacucuuaagaacaaaaaacucaaccauagaauacgacggaguaaugcaaaaaucacaagauaacguaacagaacuauacgauguaucaauaucccuaucaguaucauuccccgacgucaccuccaauaugacaauauucugcauauuagaaacagacaaaacaagauuacuaucauccccauucucaauagaacuagaagacccacaaccacccccagaccauaucccauggauaacagccguacuaccuacaguaauaaucugcguuaugguuuucugcuuaauacuauggaaauggaaaaaaaaaaaaagaccuagaaacuccuacaaaugcggaacaaacacaauggaaagagaagaaucagaacaaacaaaaaaacgagaaaaaauacacauucccgaaagaucagacgaagcacaaagaguauucaaaucaucaaaaacauccucaugcgacaaaucugacacaugcuucuga

SEQ ID NO: 1632 - RNA, 1011 nt, Artificial Sequence
  Q15762
auggauuacccaacacuacuacuagcacuacuccacguauacagagcacuaugcgaagaaguauuauggcauacaucaguaccauuugcagaaaacaugucacuagaaugcguauacccaucaaugggaauacucacacaaguagaaugguucaaaauaggaacacaacaagauucaauagcaauauucucaccuacccauggcaugguaauaagaaaaccauacgcagaaagaguauauuuuuuaaacucaaccauggcaucaaacaacaugacacuauucuuccgaaacgcaucagaagacgauguaggauacuacucaugcagccuauacacauacccacaaggaacauggcaaaaaguaauacaaguaguacaaagcgacucauucgaagcagccguaccaucaaacucacacauaguaucagaaccaggaaaaaacguaacacuaacaugccaaccacaaaugaccuggccaguacaagcagucagaugggaaaaaauacaaccacgccaaauagaccuacuaacauacugcaacuuaguacacggaagaaacuucacaagcaaauucccaagacaaaucguaucaaacugcucacacggacgauggucaguaauaguaauaccagacgucaccguauccgauucaggacuauaucgauguuacuuacaagcaucugcaggcgaaaacgaaacauuuguaaugagacuaacaguagccgaaggcaaaaccgauaaucaauacacacuauucguagcaggaggaacaguacuacuacuacuauucguaauaucuauaacaacaauaauaguaauauuccuaaacagaagaagaagaagagaaagacgagacuuauucacagaaucaugggacacacaaaaagcccccaacaacuaucgaucaccaauauccacaucccaaccaacaaaccaaaguauggacgauacaagagaagacauauacguaaauuacccaacuuucucaagacgaccaaaaacaagaguauga

SEQ ID NO: 1633 - RNA, 13482 nt, Artificial Sequence
  Q685J3
augccccguccuggcacuauggcgcucugucuauugacuuugguauuaaguuuacuuccgccccaagcggcugcggaacaagaucuuuccgugaaccgcgcaguuugggaugguggcggcugcaucucacaaggagacguguuaaaccgccaaugucaacaacugagucaacacgugcguacugguucugcugcaaauacggcaaccggaacuacuuccacgaacguaguagaaccccgaauguauuuaucaugcuccacuaaccccgaaaugaccaguaucgaauccucuguaacuucagauacuccuggcguuucaucuacucguaugacccccacugaaucacgcacuacuuccgaaucaacuucagacuccacuacccuauucccuucaucaaccgaagauaccagcucacccacuacuccagaaggaaccgacgucccaaugucaaccccgucggaagaaucuauauccucuaccauggcuuucguuagcaccgcuccuuuaccgucuuucgaagcauacacuucccuuacauauaagguagacaugagcacuccucuuacaacgaguacacaggcuucgucuucaccgacgaccccggaaucgacgacaaucccuaaguccaccaacucggaaggcucaacgccauuaacauccaugccagccaguacuaugaaagucgcgucaucagaagcuauaacccuccuaacaacgccgguugaaauaagcacaccuguuacaauaagcgcgcaagcaucaucuagucccaccacagcagaagggccuucguuguccaauuccgcuccaagcggaggcucuacaccccuuacacgaaugccauuaucagucauguuaguuguaaguucggaggcuucaacucuaucaacaacucccgccgccacaaacauaccaguaaucacguccacagaggcuucuuccuccccuacuaccgcagaaggaacuucaauaccaacuuccacauauacagaagggucaacuccauuaacuucuacaccagcaucuacgaugccuguagcuaccucagaaaugucuacacuuucaauuaccccuguggauacgucuacccuagugacuacgagcacagaaccaaguucacugccaacaacugcugaagcaacgucuaugcuaacaucuacacucagcgaagguucuacaccuuugaccaacaugcccguuagcacuauccugguugcgagcucagaggcuucuacgacaucaacuaucccaguagacucaaaaacuuuuguuaccacagcgucugaagcaucuucaucuccuacuaccgcggaagacacuuccaucgcaacuuccacuccaucagaagguucuacuccucuuacaucgaugcccguaagcacgacacccguagcuucuuccgaggcuucaaauuuaucuacgacccccgucgacucuaagacacaagugacaacgagcaccgaagccucgagcucaccaccaacugcugaaguuaacucgaugcccacaucuacuccuucggaaggguccacucccuuaaccucaaugucagugucaacaaugccugucgcguccagcgaggcuucuacccucucgaccacuccaguggauacauccacgccaguaacuacuuccagcgaagcaaguucauccucaacgacgccagaaggaacuucuauaccgacaucgacaccgucagaagguucuacaccccucacgaacaugcccguaagcacucggcuggugguaucuucagaagccucaacgacauccacuacacccgcugauuccaacacauucgucacuacaaguucggaagcauccucuaguucuacuacggcggaaggaacaucuaugcccacaaguaccuauucagaaaggggaacaacgauuaccaguaugagcguauccaccacgcugguugcaagcagugaagcaaguacccuaucuacaacuccaguagacaguaauacgcccguaacgacuucaacggaagcaacaucuucauccacuaccgcagaagggaccucuaugccaaccuccacguacacagaaggaaguacaccucucacaagcaugcccguaaauaccacacuugucgcgaguagugaagcaucaacccucucaaccacaccuguugauacaucuacccccguuacaaccaguaccgaggccucaucuuccccuaccacagcagauggugcuucaaugccaaccuccacgcccagugaagguucgacuccgcucacuucuaugcccgucucaaagacccuacuaacaaguucugaagccucaacccuuucaacuacuccgcuagauacaaguacgcauauuacaacaucaacggaagcaucguguagcccuaccacaacugagggcacuuccaugcccaucucaaccccauccgagggaucuccacuacucacgucuaucccagucaguauuaccccugugacaagucccgaggcuucaacucucucaaccacaccaguagauuccaauucuccaguuacaacaagcacugagguaucuucaaguccaacacccgcagaagguacaaguaugccaacgucuacauacagcgaagguaggaccccucuaacauccaugccuguauccaccaccuuaguugcaaccagugcuaucuccacccuaucgacaacucccguugacaccuccacaccuguaacuaacucaacagaagcccgaucuucccccacaacauccgaaggaacaucaaugccuacuucuacucccggagagggaucaacuccucuaacgaguaugccugacucuaccaccccaguaguuucauccgaggcuagaacauuaagugccaccccugucgacaccucaacuccugucaccacuucaacagaagcaaccucaucgccaacuacggccgaaggcacaucaauuccaacaagcacuccuuccgaaggaacuaccccacucacuagcacaccugugucgcacacccuuguagcaaauucagaagcaucgacacucucuacaaccccggucgauucuaauacuccauuaaccacaucaacagaagcaagcucuccaccaccaaccgcggaaggaacuuccaugccuacaagcacuccaucggaagguuccacuccucuaacuagaaugcccgugucgacuaccauggucgccucguccgagacuuccacuuuaaguacgaccccugccgacacuuccacucccgugacaacauauucccaagccucgucuucuucuacgacugcggacggaacaucaaugcccacaucaacauauuccgaaggaaguacgcccuuaacaucagucccaguaaguaccagauuaguuguaucuucagaagcaucuacccucuccaccacucccguugacacuucuauucccguuacuacguccacugaagccuccagcucgccgaccaccgcugaaggcaccucaauucccacuucaccuccaagugaagguacaacaccauuagcgaguaugccgguuaguacgacacucgucguaucaucugaagcuaacacacucucuacuacucccguugauucaaagacacaaguagccacaaguacugaggcuucgucuccaccgccgaccgcagaaguaacuucuaugcccacuucaacaccgggagagcgguccacuccauuaacgucuaugccuguucgacauacccccguggccucaucagaagcgucaaccuugucaaccuccccaguugauacaaguaccccagugacaaccucagcugaaacuucuuccucccccacuaccgcugaaggcacaucauuaccuacuucaacaacuucagaaggaucuacccuacuaacauccauucccguaucuaccacacuuguaacaucacccgaggcuucaacauuauugacuacgccaguagacacuaaagguccaguuguuacaucaaaugaggugucauccuccccgacuccagcugaagguacuucaaugccuacgucaacuuauuccgaaggucgaaccccuuuaacaucuauaccgguaaacacuacauuaguagccaguuccgcgauauccauacucucaacgaccccaguagauaauucuacgccuguaacaaccucuacggaagcaugcuccucuccuacaaccuccgaagguaccuccaugccaaauuccaacccaucagaaggcaccacccccuuaacuucuaucccugucuccacuacacccguuguauccuccgaagcaucaacguugucagcuacccccguagacacguccacuccggguaccacaagcgcugaagcaaccucuucccccaccacugcagaagguauuagcauacccacuucgacacccucagaagguaaaacaccccuaaaaaguauccccguuucuaauacccccguugcaaacucagaagcuaguaccuugaguacaacuccagucgacucuaacaguccuguaguaacaucuacagcggucucaucaucaccaacacccgcugaagggacuuccauagcaaucaguacaccguccgagggcuccaccgcauuaacaucgauacccguuaguaccacuacgguggcuaguuccgaaaucaauucucuuucuacgacuccugcggucacuucaacucccgugacgacauauagucaagcaucaagcucaccuaccaccgcagacggaacuucuaugcaaaccuccacuuauuccgaaggcaguacccccuuaacuucauuaccuguguccacgaugcuaguaguuaguucugaggcuaauacucuuucaacuaccccaauugacucgaaaacacaagucaccgcaucaacagaggcuuccucguccacgacggcggagggaucgucaaugaccauaucaacaccaucugaagggucaccccucuugacuucgauccccgucaguacuaccccugucgcaucgccagaagccucgacacuuucgaccacaccaguagauuccaauagcccgguaauaacaucaacugaagucucuucaucuccaaccccagcagaggguacaagcaugcccacaaguacuuauacagaaggacgaacaccccugaccucuauaacugugcgaacaaccccuguagcuaguucagcgaucuccacucuuucaaccacacccgucgauaacucaaccccagugacuacgucgacagaagcucguuccucaccgaccacauccgaaggaacgucaaugccaaacuccacucccucagaagggaccacaccuuuaaccucaauuccuguuaguacaaccccaguucuguccagugaagccuccacauuguccgcuacacccauugacacaaguacaccaguuacaacguccacagaagcaacgucgucuccaaccacagcagagggaacaaguauuccuacaaguacucuaagcgaagguaugacuccuuuaacuucuacuccugugucucauacguuaguagcaaauucagaggccuccacacucucaaccacaccaguagacucuaauuccccagugguuacuucaacagcgguaucuucaagcccaacucccgcugaagguacuuccaucgccaccucgacacccucugaagggaguacggcacuaacaaguauaccuguaucaacuacaacaguugccagcucugaaacuaauacucucagcaccacaccagcaguuacuucaaccccaguuacuacauaugcccaagucagcucaucccccacuaccgccgaugguucgucuaugccaacuucuacaccaagagaaggacguccaccucuaacaucaauuccggugucuaccaccacgguggcgucaucagaaauaaauaccuuaaguacaacucuagcagauacacgaacaccugucacuacauauucacaagcgagcucgucgccuacuaccgcggacggaaccucaaugcccaccccagcauauucugagggaucaacacccuuaacaucuaugccccuuaguacaacacuuguuguauccucugaggcuuccacucucucgacaaccccuguagauacaaguacacccgccacuacaucaacagagggaucaucaucgccuacuacugcugguggaacaaguauucaaacauccaccccaagcgaaaggacaacuccauuggccggaaugcccgucagcacaaccuugguggugagcagcgagggaaacacucuuaguacuaccccggucgacaguaagacucaaguaacaaauaguacggaggcaucaaguucugcgaccgccgaagguucauccaugaccauaucugcaccgucagaggguagucccuuacuaacaucaauuccguuaucaacuacgcccguagccucgccggaggcuuccacuuuaucgacgaccccaguagauucgaauagucccguaauuacuucuacagaaguuuccucauccccgaucccuaccgaagggacaaguaugcaaacauccacauauucagauagacgcacuccacuaacgucaaugccugugucaacgacugucguugcuaguucagcaaucuccacacuaucaacaacacccguagauaccuccaccccuguaacuaacucgacggaggcucguucaucacccaccaccucggaggggacauccaugcccaccucuacccccucagaggggucuacucccuucaccucuaugccaguuucuaccaugccaguggugacaucagaagcgucuacccuuagcgcuaccccgguagacacaaguaccccagucacuacgucuaccgaagcaacaaguucccccacgacagccgaagggacuagcauaccuaccucaacuuuaucagaaggcacuacucccuuaaccucgaucccaguaucacauacuuuggucgcgaacagcgagguauccacacuaaguacuacaccaguagauagcaacacaccuuucacgacgucuacugaggcuucuucaccaccuccaaccgcagaaggaacuuccaugcccacaaguacuucaucggaggggaauacuccacuuacgagaaugccuguuucgaccacuauggucgccucuuucgaaacgagcacgcucucuacaacgcccgccgacacuagcacaccagucacaacuuauucucaagccggcucaagcccuacuaccgcggacgauaccuccaugccgacgucgacguacucugaaggaucgacuccacuuacgaguguuccagucuccaccaugcccgucguuuccucugaagcaagcacucacucgacaacgcccguugauacaaguacacccgugaccacuucaaccgaagcgucgucuucaccaacuacagcugagggcaccucgauaccgacgaguccgccaucagaaggcacuaccccucuugccagcaugccuguuagcacuacaccugucgucaguucagaagcaggaacacucucaacgacacccguggacacaagcaccccgaugacuacaucaacagaagccucguccagucccaccacugcagaggacauuguggucccuauuucaacagcuucggaaggaucgacacuccuuacuucaauaccagucuccacuacuccuguggcaucucccgaagcaucaacuuugucaacuacuccgguugauagcaauucuccuguaguuacuucgacagagauuuccuccucggccacgagcgccgaaggcaccucaaugccgacuuccacauauuccgaagguucuaccccucuucguucgaugcccguuucaaccaaaccauuagcaucaucugaggcaucaacccuuucuaccaccccgguggauaccucaauucccguuacuacaucgaccgaaacguccuccuccccgaccacagccaaggacacgagcaugcccaucaguaccccaagcgaaguuucuacuagccuuaccucuauacugguuucaacgaugcccguagcuuccagugaagcgucaacacuaaguaccacacccgucgacacgcguacucucgucacaaccaguacagguaccuccagcagccccaccacagcugaaggaagcucuaugccuacuucaacaccaggugaacgcaguacaccucucacuaacaucuugguaucuacuacacugcuagccaacuccgaagcaucaacacuaucaacaacaccuguagacaccucuacaccaguuacuacaucagcagaggcuuccucuucaccuaccaccgcagaaggcacaaguaugagaauuagcaccccauccgauggaaguaccccucucacuucaauauuggucucgacucucccaguugccaguucugaagccaguaccguauccacaacugcgguugacacaagcaucccuguaacuaccucuacugaggcaucaucaucuccgacuacagcagaagucaccucaaugcccacuucaacucccucagaaacaaguacuccccuaaccucaaugcccguaaaucacacucccguagcuucuagcgaagcugggacauuaucgacaacgccagucgacaccuccacgccugugacuacuuccacaaaagccagcuccucgccaacuacagcagagggaaucguaguaccaaucucuacagcaagcgaaggauccacccuacucacauccauuccggugucgacuaccccaguggcuagcucagaagccagcacccucagcacuacuccugucgacacuucuaucccgguaaccacgucaaccgagggaucuuccagcccuacaacugccgaaggcacuagcaugccgauauccacuccaagugaagucucuaccccauuaaccucgauacucguaucaacgguuccuguugccggcucugaagcauccacacuauccacaacaccaguagauacgagaacucccguaacaacuagcgcugaagcguccucaagcccuacaaccgcugaaggaacgaguaugccaauauccacucccggcgaacggagaacaccauuaacaaguaugucaguaaguacuaugccugucgcgucuagcgaggccuccacccuaucacgaacucccgcggacacauccacaccagucaccacgucgacagaagcgaguucgaguccaaccaccgcggaagguacaggcaucccaauuuccaccccuucagaaggcuccacuccacucaccuccauaccuguaucgacuacuccaguggccauacccgaagcaucuacucucucuacaacuccgguggauuccaauucccccguuguaacaucuacggagguauccucauccccuaccccugcugaagguacauccaugcccauaagcaccuauucagaaggaucuacaccucucacaggaguaccaguaucaacuacuccaguaaccuccagugcaauaucuacgcucaguacaacacccguugacaccaguacaccaguaacaacuuccacggaagcacauuccucuccaacaacuucagaagggacaagcaugccaacgucuacuccgagugaagguagcacaccacucacguacaugccaguaucuacaaugcuuguagucucuagcgaggauucuacuuuaucagcgacgccaguugacacuuccacaccaguuacgacaucaaccgaggcuacaucaucgacaacagccgaagguaccaguaucccgaccucaacacccucugaagggaugacaccccuuacaagcguucccguuaguaacacuccuguugcuucuuccgaggcuucgauccucucuacaacacccguagacucuaacacuccacuaacgacaucaacagaggcaagcucaagucccccgacugccgaaggcacaagcaugcccacuucaacuccauccgaggggucuacaccccucacaucaaugcccguuucaaccacaacgguggcaucuuccgaaaccucaacgcuguccacuacuccagcggauacgucaacaccuguaacaacuuauagccaggcuucaaguaguccacccauugcugacgguaccagcaugcccacaucaaccuauucagaaggcucaacaccccuuacuaauaugucauucuccacuacuccaguaguaucguccgaggcaucaacucuaucaacuacucccgucgauaccucaaccccugucaccacaucgacagaagccucccugucuccaacgacggcagaagguacauccaucccaacuuccaguccaucugaaggcacuacuccccucgccuccaugccugucaguacuacaccuguggugagcucggaaguuaauacccucuccacuacaccgguugacucgaauacauuagugacaacaucuaccgaggcuucaagcucaccaacuauagcagagggaacgucauuacccaccucuacuacaagugaaggcuccacuccacucucaauaaugccuuuaaguacaacaccaguggcgucgagcgaggcaagcacucugucuaccacgccuguugauaccucaaccccgguaaccacuucaucuccaacaaauucaucaccuacuacagccgaagucacaagcaugccuacuucaacugcgggugaaggaaguacucccuuaacaaacaugcccguauccaccacaccagucgcuuccucagaggcgucaacacucucuacuacccccguugauucgaauacauucguuacaucuucuagucaggcuucuuccagcccugcuacucuccaagucaccacuaugcgaaugucgacucccucagaaggaagcuccucgcuuacuacaaugcuacucuccagcaccuacgucacuucaucggaagcuagcacaccuaguacgccauccgucgaccgaucaacuccugugaccacuuccacccaaaguaacuccacuccaacaccaccagaaguuaucacacuccccauguccacucccuccgaggucagcaccccucucaccauuaugccugugucgaccacaagcguaacaauaucagaagcaggaacagcuucaacucuaccggucgacaccucaacucccgugauuacgucgacccaggucucaaguucaccugucaccccggaagguacuacgaugccaauauggacccccucggaaggcucaacccccuugacgacaaugccggucaguacuacacguguuacuucaucugaagguucaacucucuccacuccauccgucgucacuucaacacccguuaccaccagcacggaagcuauaucaucuucggcaacuuuagacucaacgaccaugucaguuucgaugccgauggagauaucgacccuaggcaccacuauccucguaucuacaaccccugucacucgauuuccagaaucauccacacccuccauaccgucuguuuauacuucaauguccaugacaacagcauccgaagggagcuccagcccaacaacacuugaaggaaccacgacuaugccuaugaguacaacauccgaaagaaguacauuauuaacaacagugcuuaucuccccaauuucugugaugucaccaagcgaagccagcacucuuuccacaccacccggggacacgucuacgccuuuauuaaccucaacaaaagcaggaucuuucucgauuccugcugaggugaccacgaucagaauuucuauuacaagugagcguucuacaccuuuaacaacucuucuggucuccaccacauugccuacaucuuuucccggagcuucaauugccucgacuccacccuuggacaccuccaccacuuuuacuccgucaaccgacacugcuuccacaccuacaaucccuguugccaccacuauaagugucucugugauaaccgaggggaguacucccggaacuaccaucuucauaccuuccacgccagugacuucauccacagcagauguauuucccgcgacaacaggcgcuguuucuacccccgucauaacuucuacggaacucaauacaccauccacaaguuccucaagcacaacaacauccuucucgacaacuaaagaguucacuacgccagcgaugacgacugcugcaccccuaacuuacgugacgaugaguacugcucccuccaccccaagaacaaccucccggggcugcacaacguccgcgucuacauuaagugcaaccuccacaccucacaccagcaccucgguuaccacuagaccugucaccccuucaagcgagucuuccaggccgucaacaauuacaucucacacaaucccuccaaccuuucccccggcccacucaucaacaccuccuacaacaucagcgagcuccacaacgguuaauccugaagcagugacaacgaugacaacaagaacgaaaccaucuacucgaacgacuuccuuuccuaccguuaccacuaccgccguucccacuaauacuaccauaaaaagcaaccccaccucgacaccgacgguccccagaacuacgacuugcuuuggggauggaugucagaauacagccagucgcugcaaaaauggugguacuugggacggccuuaaaugucaauguccaaacuuauauuauggcgaacuaugugaggaagucguaucauccaucgauauaggcccucccgaaacaaucucagcacaaauggaacucacagucacaguuaccucaguaaaauucaccgaagaacuuaaaaaccacucaucucaagaguuccaggaguucaaacaaacuuuuacugaacaaaugaauaucguauacagcgguauacccgaauauguaggcgucaacauuacuaagcuacggcuuggaucuguaguaguagaacaugauguguuacuaagaacaaaguauacuccagaguauaaaacaguguuggacaacgcuacagaaguuguaaaagaaaagaucacuaaggucaccacucaacaaauaaugauaaacgacauaugcucugauaugauguguuucaauacuacagguacacaaguacaaaacaucacgguuacacaauacgacccggaagaagacuguaggaaaauggcuaaagaauauggcgacuacuuugucguggaauaucgagaucaaaaaccuuacuguaucaguccuugugagccggguuucaguguuaguaaaaauugcaacuuaggaaagugucagaugaguuuaagcggaccgcagugucuuugcguuacuacagagacucacugguauuccggggaaaccugcaaccaagguacgcaaaaaucccuaguuuaugggcucgugggugcuggagucguacucauguuaauuauucuagucgcucuccuuaugcuaguauuuaggucgaaaagggaaguaaaacggcaaaaguaucgucucagucagcuauauaaguggcaagaagaagauaguggaccagcaccaggcacauuucaaaacauagguuucgacauaugccaagacgacgauucaauucauuuagaaucgauuuauuccaacuuucagccuucucuacgucacauagaccccgaaacuaagauacgaauccaacgaccucagguuaugacaacuucguucuga

SEQ ID NO: 1634 - RNA, 1215 nt, Artificial Sequence
  Q9NNX6
augagcgacucaaaagaaccaagacuacaacaacuaggauuauuggaagaagaacaacuuagaggacucggauucagacaaacuagaggcuacaaaaguuuagcagguuguuuaggacacggaccauuagucuuacaacuacuaucauucacacuucucgcuggacuacuaguucaaguaucaaaagucccaucaucaauaucacaagaacaaagcagacaagacgcaaucuaucaaaauuuaacacaacuuaaagcagcugucggcgaacuaagcgaaaaaucaaaauuacaagaaauauaucaagaacuaacacaauuaaaagcugccguaggagaacuaccagaaaaaaguaaauuacaagaaauauaucaagaauuaacaagacuaaaagcugcuguaggagaauuaccagaaaaaagcaaacuacaagaaauauaccaagaacuaacaugguuaaaagcagccguaggagaacuacccgaaaaaucaaaaaugcaagaaauauaccaagaacuaacaagauuaaaagcagcagucggcgaauuacccgaaaaaucaaaacaacaagaaauauaccaagaacuaacaagacuaaaagcugcagucggagaauuaccagaaaaaagcaaacaacaagaaauauaccaagaacucacaagacucaaagcagcaguaggugaacuacccgaaaaaagcaaacaacaagaaaucuaccaggaauuaacucagcuaaaagcagcgguagaaagauuaugccacccaugcccaugggaauggacauuuuuccaaggaaauugcuauuucaugagcaacucacaacgaaauuggcacgauaguauaacagcaugcaaagaaguaggagcacaacuaguaguaauaaaaucagcagaagaacaaaacuuccuacaauuacaaucaaguagaucaaacagauucacauggaugggacuaucagauuuaaaucaagaaggaacauggcaauggguagacggcucaccacuacuuccaagcuuuaaacaauacuggaacagaggagaaccaaacaauguaggagaagaagacugcgcagaauucagcggaaacggauggaacgaugacaaaugcaaccuagcaaaauucuggauauguaaaaaaucagcagcaucauguagcagagaugaagaacaauucuuaaguccagcaccagcaacuccaaauccaccaccagccuga

SEQ ID NO: 1635 - RNA, 3126 nt, Artificial Sequence
  Q9NR97
auggaaaauauguuucuacaauccuccaugcuaacaugcauauuucuacucauaucaggcucuugugaauugugcgcugaagaaaacuucucccguuccuaccccugcgaugaaaagaaacaaaacgauuccguaauugccgaaugcucuaaccgacgguuacaagaaguuccccaaacagucggaaaauacguaaccgaacuugaccuaucagauaauuucauaacgcacauuacaaaugaauccuuccaaggccuucaaaaucucacaaaaaucaaccucaaucauaacccaaacguacaacaccaaaacgguaacccagguauacaaucaaauggacuaaacauaaccgacggcgcauuucucaaucucaaaaaccuccgagaacuacuuuuagaagacaaucaacuuccccaaauuccauccggccuaccagaaucauuaacagaacucagcuuaauucaaaauaauaucuauaacauaacuaaagaagguaucucacgauuaauaaauuuaaagaaucuauaucuagccuggaacugcuauuucaacaaaguaugcgagaaaacuaacauugaagacggaguauuugaaacauuaacaaaccuugaauuacuaucucuaucauucaacucauuaucacacgucccaccaaaacugccaucaucccucagaaaauuauuucuaagcaacacacagauuaaauauaucagugaagaagauuucaaagguuuaauaaaccuaacauuacucgaccuaucagguaauuguccacgaugcuucaacgcaccauuuccauguguuccaugcgacgguggcgcuucaauuaauauagacagauucgcuuuucaaaaucuaacucaacuaagauaucuuaacuuauccuccacuuccuuacgcaaaauaaaugcagcaugguucaaaaauaugccacacuuaaaaguccuagauuuagaauuuaauuacuuaguaggagaaauagcaucaggagcauucuuaacaaugcuaccuagauuagaaauucuagauuuaucauucaacuauauaaaaggcagcuacccgcaacacauaaacaucucuagaaacuucucgaaauuacuaaguuuaagagcccuacaccuacgagguuaugucuuccaagaacuucgagaagacgauuuccaaccacuaaugcaacuuccaaaucuaucaaccauaaaccuuggaauaaauuuuaucaaacaaauugauuuuaaacuauuccagaauuuuuccaaucuagaaauaauauaccucuccgaaaacagaauaucuccauugguaaaagauacccgucaaucauaugccaacucuucuucauuucaacgacacauaagaaaaagacguuccacugacuuugaauuugauccacacucgaauuucuaucacuucacaagacccuugaucaaaccucaaugugccgcauacggcaaagcauuagaccuuucacucaacucaaucuucuuuauaggccccaaucaauucgaaaaucuaccagacauagccugccuaaaccuaucagcaaacucaaacgcacaaguacuuuccgguacugaauuuucagcaauaccacacgugaaauaucuagaccuaacaaauaacagacuagauuucgauaacgccucggcacucacugaacucucugacuuagaaguacuagaucuauccuacaauucacacuacuuccgaauagcaggaguuacacaccacuuagaguucauccaaaacuucacuaacuuaaaaguacuaaaccucucacauaacaauauuuacacauuaacagauaaauacaaccuagaaucaaaaucauuaguugagcuaguauuuucuggcaaccgacuugacauacucuggaacgacgacgauaaccgcuacaucucuauuuucaaaggucucaaaaacuuaacuagacuugaccucagccuuaaucgacuaaaacacauaccuaaugaagccuuuuuaaaccucccagcuucccucaccgaacuacacaucaacgauaauauguuaaaauucuuuaauuggacuuuauuacaacaauucccucgacuagaacuucuugaucuuagagguaauaaauuauuauuucuuaccgauucauuaagcgacuuuacuuccucucuaagaacucuccuacuaagccacaacagaauuucucaucuacccagcgguuuucuaucugaaguuaguucacuaaaacaccuugacuuaaguucaaacuuacuaaaaacaauuaacaaaucagcucucgaaacuaaaacuaccacaaaacugucuaugcucgaauuacacgggaaucccuuugaauguaccugcgacauuggagauuuccgaagauggauggaugaacaccuuaacguuaaaaucccacgccuuguugacgugauuugcgcauccccuggcgaucaacgugguaaaucuauaguuucucuagaacucacaacuuguguuucugauguuacugcagucauccuauuuuucuuuaccuucuuuauaaccacuaugguuaugcuggccgccuuagcccaucaccuguucuauugggacguaugguucauuuauaacguaugccucgcaaaagucaaagguuaucguucccuaucaacuucacaaacuuucuacgaugcauauaucucauacgauacaaaagacgcaucagucacugauuggguuaucaaugaacuccguuaccaccucgaagaauccagagacaagaacguccuacuaugccuagaagaaagagacugggauccaggccuagcaauaaucgauaaccuaaugcaauccaucaaucaaucaaagaaaacuguauuuguauuaacaaagaaauacgcaaaauccuggaacuucaaaacagccuuuuacuuagccuuacaacgucugauggacgaaaacauggacguaauaauuuucauuuuacuugaacccguacuacaacauagucaauacuuacgauuaagacaaagaaucugcaaauccucuauauuacaauggcccgauaacccuaaagccgaaggauuauucuggcaaaccuuacgcaacgucguuuuaacagaaaacgacucaagauacaauaauauguacguagauucaauaaaacaauacuaa

SEQ ID NO: 1636 - RNA, 66 nt, Artificial Sequence
  P16671_TM_1_8-29
gguuuaauugcuggugcaguuauaggugcaguuuuagcaguauuuggagguauauuaaugccugua

SEQ ID NO: 1637 - RNA, 81 nt, Artificial Sequence
  P32248_TM_1_60-86
uuccuuccaauuauguauucaauuauauguuucguuggacuucuagguaacggucuaguuguacuuacauauauauauuuc

SEQ ID NO: 1638 - RNA, 66 nt, Artificial Sequence
  P16671_TM_2_440-461
uuguuagguuuaauugaaaugauuuuguuaucuguugguguuguuauguuuguugcuuuuaugauu

SEQ ID NO: 1639 - RNA, 63 nt, Artificial Sequence
  P32248_TM_2_96-116
uaucuacuuaaccuugcaguugcagauauacuuuuccuucuaacucuaccuuucugggcauau

SEQ ID NO: 1640 - RNA, 66 nt, Artificial Sequence
  P32248_TM_3_131-152
cucauuuucgcuauuuauaaaauguccuuuuucucuggcaugcuccuucuccuuuguauuuccauu

SEQ ID NO: 1641 - RNA, 63 nt, Artificial Sequence
  P32248_TM_4_171-191
guucuacuuauaucuaaacuuucauguguagguauauggauacuugcaacuguacuuucaauu

SEQ ID NO: 1642 - RNA, 84 nt, Artificial Sequence
  P32248_TM_5_220-247
uuuauuacuauucaaguugcucaaaugguuauugguuuucuuguuccucuucuugcuaugucuuuuuguuaucuuguuauuauu

SEQ ID NO: 1643 - RNA, 78 nt, Artificial Sequence
  P32248_TM_6_264-289
guaauaauagcaguaguaguaguauuuauaguauuccaacuaccauauaacggaguaguauuagcacaaacaguagca

SEQ ID NO: 1644 - RNA, 54 nt, Artificial Sequence
  P32248_TM_7_314-331
cuugcauguguacguuguuguguaaauccguuuuuauaugcauuuauaggugua

SEQ ID NO: 1645 - RNA, 69 nt, Artificial Sequence
  A0A5B9_TM_145-167
acaauacuauacgaaauacuacuaggaaaagcaacacuauacgcaguacuaguaucagcacuaguacua

SEQ ID NO: 1646 - RNA, 69 nt, Artificial Sequence
  B7Z8K6_TM_130-152
cuaggccuacgcaugcucuuugccaaaacuguagccguaaauuuucuuuuaacugcaaaauuauucuuu

SEQ ID NO: 1647 - RNA, 63 nt, Artificial Sequence
  O00206_TM_632-652
acuauuauugguguuucuguucuuucuguuuuaguuguuucuguuguugcuguuuuaguuuau

SEQ ID NO: 1648 - RNA, 66 nt, Artificial Sequence
  P01730_TM_397-418
auggcuuuaauuguuuugggugguguugcugguuuguuauuguuuauugguuuggguauuuuuuuu

SEQ ID NO: 1649 - RNA, 63 nt, Artificial Sequence
  P01850_TM_151-171
auacuuuuagguaaagcuacacuuuaugcuguacuuguaucugcacuuguacuuauggcuaug

SEQ ID NO: 1650 - RNA, 78 nt, Artificial Sequence
  P07766_TM_127-152
guuaugucuguagcuacaauuguaauuguagauauauguauaacuggagguuuacuuuuacuuguauauuacugguca

SEQ ID NO: 1651 - RNA, 66 nt, Artificial Sequence
  P08575_TM_576-597
gcucuuauugcuuuucuugcuuuucuuauuauuguuacuucuauugcccuucuuguuguucuuuau

SEQ ID NO: 1652 - RNA, 63 nt, Artificial Sequence
  P08637_TM_209-229
guuucuuuuuguuuaguuaugguuuuacuuuuugcuguugauacuggucuuuauuuuucuguu

SEQ ID NO: 1653 - RNA, 81 nt, Artificial Sequence
  P10747_TM_153-179
uuuuggguuuuaguuguuguuggugguguuuuggcuuguuauucuuuauuaguuacuguugcuuuuauuauuuuuuggguu

SEQ ID NO: 1654 - RNA, 66 nt, Artificial Sequence
  P11912_TM_144-165
auaauuacagcugaagguauaauuuuacuuuucugugcaguuguaccuggaacuuuacuuuuauuu

SEQ ID NO: 1655 - RNA, 66 nt, Artificial Sequence
  P15391_TM_292-313
guaucugcagucacacuugcauauuuaauauuuuguuuauguucacuuguaggcauucuucaucuu

SEQ ID NO: 1656 - RNA, 63 nt, Artificial Sequence
  P16410_TM_162-182
uuucuucuuuggauucuugcugcuguuucuucuggucuuuuuuuuuauucuuuucuucuuacu

SEQ ID NO: 1657 - RNA, 63 nt, Artificial Sequence
  P26718_TM_52-72
ccuuuuuuuuuuuguuguuuuauugcuguugcuauggguauucguuuuauuauuaugguugcu

SEQ ID NO: 1658 - RNA, 63 nt, Artificial Sequence
  P30273_TM_24-44
cuuuguuauauucuugaugcuauucuuuuucuuuaugguauuguucuuacucuucuuuauugu

SEQ ID NO: 1659 - RNA, 63 nt, Artificial Sequence
  P40259_TM_160-180
ggcauaaucaugauccaaacccuacucauaauccuauucauaaucguccccauauuccuacuc

SEQ ID NO: 1660 - RNA, 63 nt, Artificial Sequence
  P42081_TM_248-268
uggauuacugcuguucuuccuacuguuauuauuuguguuaugguuuuuugucuuauucuuugg

SEQ ID NO: 1661 - RNA, 63 nt, Artificial Sequence
  Q15762_TM_255-275
ggcgguaccguucuccuucuccuuuucguuaucucuaucacuaccauuaucguuaucuuucua

SEQ ID NO: 1662 - RNA, 63 nt, Artificial Sequence
  Q685J3_TM_4394-4414
cuuguaggugcugguguaguuuuaauguuaauuauauuaguggcauuacuuaugcuuguauuu

SEQ ID NO: 1663 - RNA, 63 nt, Artificial Sequence
  Q9NNX6_TM_38-58
uuaggucaugguccucuuguucuucaacuuuuaucuuuuacuuuacuugcugguuuacuuguu

SEQ ID NO: 1664 - RNA, 63 nt, Artificial Sequence
  Q9NR97_TM_828-848
gcuguaauucuauuuuucuuuacauuuuucauuacaacuaugguuaugcuugcagcucuagcu

SEQ ID NO: 1665 - RNA, 48 nt, Artificial Sequence
  P14207_1-16
augguguggaaguggaugccccugcuccuguugcuggucugcguggcc

SEQ ID NO: 1666 - RNA, 48 nt, Artificial Sequence
  O75787_1-16
auggccguguucgucgugcugcucgcacugguagccggcguguugggg

SEQ ID NO: 1667 - RNA, 48 nt, Artificial Sequence
  P07359_1-16
augccccugcuccuguugcugcuccuguugccaagcccgcugcacccc

SEQ ID NO: 1668 - RNA, 48 nt, Artificial Sequence
  P08637_1-16
auguggcagcugcuccugcccaccgccuugcugcuccuggugagcgca

SEQ ID NO: 1669 - RNA, 51 nt, Artificial Sequence
  P07237_1-17
augcugaggcgggcccuccugugcuuggcaguggccgcgcugguccgcgcc

SEQ ID NO: 1670 - RNA, 51 nt, Artificial Sequence
  O60911_1-17
augaaccugagccucgugcuggccgcauucugcuugggcaucgccuccgcg

SEQ ID NO: 1671 - RNA, 51 nt, Artificial Sequence
  P20138_1-17
augccccugcuccuguugcugccacuccugugggccggcgcauuggccaug

SEQ ID NO: 1672 - RNA, 51 nt, Artificial Sequence
  P27797_1-17
augcugcucagcgugccccuguugcugggccuccugggguuggccgucgca

SEQ ID NO: 1673 - RNA, 54 nt, Artificial Sequence
  P10747_1-18
augcugaggcuccuguuggcccugaaccucuuccccagcauccaggugaccggc

SEQ ID NO: 1674 - RNA, 54 nt, Artificial Sequence
  O75487_1-18
auggccagguucggccugcccgcacuccugugcaccuuggccgugcugagcgcg

SEQ ID NO: 1675 - RNA, 54 nt, Artificial Sequence
  P07996_1-18
augggccuggccugggggcucggugugcuguucuugaugcacgucugcggcacc

SEQ ID NO: 1676 - RNA, 54 nt, Artificial Sequence
  P22748_1-18
augaggaugcugcucgcccuguuggcacugagcgccgcgcggcccuccgccagu

SEQ ID NO: 1677 - RNA, 54 nt, Artificial Sequence
  Q15762_1-18
auggacuaccccacccugcuccuggccuugcugcacguguauagggcacucugc

SEQ ID NO: 1678 - RNA, 54 nt, Artificial Sequence
  P30273_1-18
augauccccgccgugguccugcuccuguugcugcucguggagcaggcagccgcg

SEQ ID NO: 1679 - RNA, 54 nt, Artificial Sequence
  P38570_1-18
auguggcuguuccacacccuccugugcaucgccagcuuggcacugcucgccgcg

SEQ ID NO: 1680 - RNA, 54 nt, Artificial Sequence
  Q01638_1-18
augggcuucuggauccuggccauucucaccauccugauguacagcacugcagcc

SEQ ID NO: 1681 - RNA, 54 nt, Artificial Sequence
  Q9NZQ7_1-18
augaggaucuucgccguguuuauuuucaugaccuacuggcaccuccugaacgca

SEQ ID NO: 1682 - RNA, 57 nt, Artificial Sequence
  P13591_1-19
augcugcagaccaaggaccucaucuggacucuguucuuuuugggcaccgccgugagc

SEQ ID NO: 1683 - RNA, 57 nt, Artificial Sequence
  P26842_1-19
auggccaggccccacccaugguggcugugcgugcucggcacccuggucggguugagc

SEQ ID NO: 1684 - RNA, 57 nt, Artificial Sequence
  P15391_1-19
augcccccaccgaggcuccuguucuuucuguuguuccugacccccauggaggugcgg

SEQ ID NO: 1685 - RNA, 57 nt, Artificial Sequence
  Q8NI17_1-19
augauguggaccugggcccuguggaugcuccccagccugugcaaguucuccuuggca

SEQ ID NO: 1686 - RNA, 57 nt, Artificial Sequence
  P08571_1-19
auggagagggccagcugccugcuccuguugcugcucccccuggugcacgucuccgca

SEQ ID NO: 1687 - RNA, 57 nt, Artificial Sequence
  P05154_1-19
augcagcuguuccuccuguugugccuggugcuccugagcccccaaggcgccuccuug

SEQ ID NO: 1688 - RNA, 57 nt, Artificial Sequence
  P02787_1-19
augaggcuggccgugggcgcacuccuggucugcgccguguuggggcugugucucgcg

SEQ ID NO: 1689 - RNA, 57 nt, Artificial Sequence
  P02671_1-19
auguucagcaugaggaucgugugccugguccucuccgugguaggcaccgccuggacu

SEQ ID NO: 1690 - RNA, 57 nt, Artificial Sequence
  P04216_1-19
augaaccuggccaucagcauugcacuccuguugaccgugcugcaggucuccaggggc

SEQ ID NO: 1691 - RNA, 57 nt, Artificial Sequence
  P00747_1-19
auggagcacaaggaagugguccugcuccuguugcuguuccucaaaagcggccagggg

SEQ ID NO: 1692 - RNA, 57 nt, Artificial Sequence
  P01764_1-19
auggaguucggccugagcuggcucuuucugguggccaucuugaaggggguccagugc

SEQ ID NO: 1693 - RNA, 57 nt, Artificial Sequence
  P16150_1-19
auggccacccugcuccuguugcugggcgugcucgucgugagccccgacgcacugggg

SEQ ID NO: 1694 - RNA, 57 nt, Artificial Sequence
  Q6DN72_1-19
augcugcucuggaccgccgugcuguuguucguccccugcgugggcaagacuguaugg

SEQ ID NO: 1695 - RNA, 57 nt, Artificial Sequence
  Q01151_1-19
augagcaggggccugcagcuccuguugcuguccugcgccuacagucucgcacccgcc

SEQ ID NO: 1696 - RNA, 57 nt, Artificial Sequence
  P07093_1-19
augaacuggcaccucccccuguuccuguuggccagcgugacccugccauccaucugc

SEQ ID NO: 1697 - RNA, 57 nt, Artificial Sequence
  Q8WWQ8_1-19
augaugcugcagcaccucgugaucuucugccugggcuuggucgugcaaaacuuuugu

SEQ ID NO: 1698 - RNA, 60 nt, Artificial Sequence
  Q13291_1-20
auggaccccaagggccugcucagccugaccuucguguuguuucugucccucgccuucggg

SEQ ID NO: 1699 - RNA, 60 nt, Artificial Sequence
  P35225_1-20
auggcccugcuccugaccacugugaucgcauugaccugccugggcggguucgccagcccc

SEQ ID NO: 1700 - RNA, 60 nt, Artificial Sequence
  P25942_1-20
auggugaggcugccccuccagugcguccuguggggcuguuugcugaccgccgugcaccca

SEQ ID NO: 1701 - RNA, 60 nt, Artificial Sequence
  P52803_1-20
augcugcacguggagaugcucacccuggucuucuuggugcuguggaugugcguauuuagc

SEQ ID NO: 1702 - RNA, 60 nt, Artificial Sequence
  Q15116_1-20
augcagaucccccaagccccauggccgguggucugggcagugcugcagcucggcuggagg

SEQ ID NO: 1703 - RNA, 60 nt, Artificial Sequence; identical to SEQ ID NO: 1287
  P05556_1-20

SEQ ID NO: 1704 - RNA, 60 nt, Artificial Sequence
  Q12891_1-20
augagggccggccccgggccaaccgugacucuggcacucguccuggccguggcgugggcc

SEQ ID NO: 1705 - RNA, 60 nt, Artificial Sequence
  Q8IV16_1-20
augaaggcccugggcgcagugcuccuggccuugcugcucugcgggaggcccggucggggc

SEQ ID NO: 1706 - RNA, 60 nt, Artificial Sequence
  Q03167_1-20
augaccagccacuacgugaucgccauuuucgcacugauguccaguugccucgccacugcg

SEQ ID NO: 1707 - RNA, 60 nt, Artificial Sequence
  Q14246_1-20
augaggggcuucaaccugcuccuguuuugggggugcugugugaugcacagcugggagggu

SEQ ID NO: 1708 - RNA, 60 nt, Artificial Sequence
  P16871_1-20
augaccauccugggcacuaccuucgggaugguguuuagccuccugcaggucguguccggu

SEQ ID NO: 1709 - RNA, 60 nt, Artificial Sequence
  P61769_1-20
augagcagguccguggcccuggcaguccucgcccuguugagucugagcggccucgaggcg

SEQ ID NO: 1710 - RNA, 60 nt, Artificial Sequence
  Q9Y6W8_1-20
augaaaagcggccugugguacuucuuucucuucugccugaggaucaagguguugaccggg

SEQ ID NO: 1711 - RNA, 63 nt, Artificial Sequence
  P10966_1-21
augaggccccggcuguggcuccuguuggccgcacagcugaccgugcuccacggcaacagcguc

SEQ ID NO: 1712 - RNA, 63 nt, Artificial Sequence
  Q9BZW8_1-21
augcugggccagguggucacccucauccuguugcugcuccugaagguguaccaagggaaaggu

SEQ ID NO: 1713 - RNA, 63 nt, Artificial Sequence
  P02778_1-21
augaaccagaccgccauccugauuugcugucucaucuuccugacuuugagcggcauucaaggg

SEQ ID NO: 1714 - RNA, 63 nt, Artificial Sequence
  P18564_1-21
augggcaucgagcugcucugccuguucuuuuuguuccuggggaggaacgaccacgugcagggu

SEQ ID NO: 1715 - RNA, 63 nt, Artificial Sequence
  O14525_1-21
auggcccuggcaggccucugcgcccuguuggcguguugcugggggcccgccgcagugcuggcc

SEQ ID NO: 1716 - RNA, 63 nt, Artificial Sequence
  P01130_1-21
augggccccuggggguggaagcugagguggaccguggcccuccuguuggcagccgcggguacu

SEQ ID NO: 1717 - RNA, 63 nt, Artificial Sequence
  P01732_1-21
auggcccugcccgugaccgcacuccuguugccacuggcccuccuguugcacgcggccaggccg

SEQ ID NO: 1718 - RNA, 63 nt, Artificial Sequence
  P48061_1-21
augaacgccaagguggucgugguacuggugcucguccugaccgcauugugccugagcgacggc

SEQ ID NO: 1719 - RNA, 63 nt, Artificial Sequence
  P01589_1-21
auggacagcuaccugcucauguggggccuguugaccuucaucauggugcccgggugccaggcc

SEQ ID NO: 1720 - RNA, 63 nt, Artificial Sequence
  Q86T13_1-21
augaggccggccuucgcacugugccuccuguggcaggccuuguggccaggccccggggguggc

SEQ ID NO: 1721 - RNA, 63 nt, Artificial Sequence
  Q5DID0_1-21
augcugaggaccagcggccucgcccuguuggcacugguguccgccgucgggcccagucaggcg

SEQ ID NO: 1722 - RNA, 66 nt, Artificial Sequence
  P40189_1-22
augcugacccuccagacuuggcuggugcaagccuuguucaucuuucugaccacggagagcacuggc

SEQ ID NO: 1723 - RNA, 66 nt, Artificial Sequence
  Q86YL7_1-22
auguggaaggugagcgcccuccuguucguccugggcuccgcaaguuugugggugcuggccgagggg

SEQ ID NO: 1724 - RNA, 66 nt, Artificial Sequence
  P55075_1-22
augggcagccccagguccgcccugaguugccuccuguugcaccuccuggugcuguguuugcaggca

SEQ ID NO: 1725 - RNA, 66 nt, Artificial Sequence
  Q30201_1-22
augggccccagggcccggccagcacugcuccuguugaugcugcuccagaccgccgugcugcaaggg

SEQ ID NO: 1726 - RNA, 66 nt, Artificial Sequence
  P07766_1-22
augcagagcggcacccacuggagggugcuggggcucugccuguuguccgucgguguguggggccaa

SEQ ID NO: 1727 - RNA, 66 nt, Artificial Sequence
  P18827_1-22
augaggcgggccgcacuguggcucuggcugugcgccuuggcgcugagccuccagcccgcccugcca

SEQ ID NO: 1728 - RNA, 66 nt, Artificial Sequence
  P55290_1-22
augcagcccaggaccccacuggugcucugcguccuguugagccaagugcugcuccugacuuccgcc

SEQ ID NO: 1729 - RNA, 66 nt, Artificial Sequence
  P37173_1-22
augggcagggggcugcuccggggucuguggcccuugcacaucgugcuguggacccgcauugccagc

SEQ ID NO: 1730 - RNA, 66 nt, Artificial Sequence
  Q07325_1-22
augaagaaaagcggcgugcuguuccuccuggggaucauuuugcugguccucaucggugugcagggc

SEQ ID NO: 1731 - RNA, 66 nt, Artificial Sequence
  P04156_1-22
auggccaaccugggcugcuggaugcucgugcuguucgucgcaaccuggagcgacuuggggcugugu

SEQ ID NO: 1732 - RNA, 66 nt, Artificial Sequence
  P31785_1-22
augcugaagcccagccucccauucaccucccuguuguuucugcagcucccgcuguugggcgugggg

SEQ ID NO: 1733 - RNA, 69 nt, Artificial Sequence
  P01579_1-23
augaaguacaccagcuauauccuggccuuccagcucugcauugugcugggcuccuugggguguuacugc

SEQ ID NO: 1734 - RNA, 69 nt, Artificial Sequence
  P23229_1-23
auggccgcagccggccagcugugccuccuguacuugagcgcggggcugcucuccaggcugggugccgca

SEQ ID NO: 1735 - RNA, 69 nt, Artificial Sequence
  O60494_1-23
augaugaacaugagccugcccuuccucuggucccuguugacccugcucaucuuugccgaggugaauggc

SEQ ID NO: 1736 - RNA, 69 nt, Artificial Sequence
  P08575_1-23
auguaccuguggcucaagcuguuggccuucggcuuugcauuccuggacaccgagguguuugucacuggg

SEQ ID NO: 1737 - RNA, 69 nt, Artificial Sequence
  Q8IWY4_1-23
augggcgccgcagccgugagguggcaccugugcguccuccuggcguuggggacccggggucgccuggcc

SEQ ID NO: 1738 - RNA, 69 nt, Artificial Sequence
  Q08431_1-23
augcccaggccacggcugcucgccgcacugugcggcgccuugcugugugcgccgagccuccugguggcc

SEQ ID NO: 1739 - RNA, 69 nt, Artificial Sequence
  Q99665_1-23
auggcccacaccuucaggggcugcagccuggcauuuauguucaucauuacuuggcuccugaucaaggcc

SEQ ID NO: 1740 - RNA, 69 nt, Artificial Sequence
  Q6Q8B3_1-23
augagcgcccccaggcugcucaucuccauuaucauuauggugagugcaagcuccaguagcugcaugggc

SEQ ID NO: 1741 - RNA, 69 nt, Artificial Sequence
  Q07011_1-23
augggcaacagcugcuacaauaucguggccacccugcuccuggucuugaacuucgagaggacucggucc

SEQ ID NO: 1742 - RNA, 69 nt, Artificial Sequence
  Q8NHL6_1-23
augacccccauccugacugugcucauuugccugggcuugagccuggggccaaggacccacguccaggcc

SEQ ID NO: 1743 - RNA, 69 nt, Artificial Sequence
  P36894_1-23
augccccagcuguacaucuauauuaggcuccugggcgccuacuuguucaucauuagccgggugcaaggg

SEQ ID NO: 1744 - RNA, 69 nt, Artificial Sequence
  Q16552_1-23
augacccccggcaagacuagccuggugucccuccuguugcugcucagucuggaggccaucgucaaagca

SEQ ID NO: 1745 - RNA, 69 nt, Artificial Sequence
  P42081_1-23
auggacccccagugcaccaugggccugagcaacauccucuucgugauggccuuucuguuguccggggca

SEQ ID NO: 1746 - RNA, 69 nt, Artificial Sequence
  P43121_1-23
augggccugcccaggcucgugugcgccuuccuguuggcagccuguugcuguugcccacgggucgcgggg

SEQ ID NO: 1747 - RNA, 69 nt, Artificial Sequence
  O00206_1-23
augaugagcgccuccaggcuggcaggcacccucauccccgccauggcguuccugaguugcgugcggcca

SEQ ID NO: 1748 - RNA, 69 nt, Artificial Sequence
  P42701_1-23
auggagccccuggugaccugggucgugccacuccuguucuuguuucugcucagcaggcagggcgccgca

SEQ ID NO: 1749 - RNA, 72 nt, Artificial Sequence
  P06729_1-24
augagcuuccccugcaaguuuguggccuccuuccugcucaucuuuaacgucaguagcaaaggcgcagugucc

SEQ ID NO: 1750 - RNA, 72 nt, Artificial Sequence
  P15328_1-24
auggcccagaggaugaccacucaacugcuccuguugcuggugugggucgcagugguaggcgaggcccagacc

SEQ ID NO: 1751 - RNA, 72 nt, Artificial Sequence
  P05112_1-24
augggccugaccagccagcuccugcccccauuguucuuucugcucgccugcgcagggaacuucgugcacggu

SEQ ID NO: 1752 - RNA, 72 nt, Artificial Sequence
  P06127_1-24
augcccaugggcagccugcagccacucgccacccuguacuugcuggggaugcucguggcauccugccugggu

SEQ ID NO: 1753 - RNA, 72 nt, Artificial Sequence
  P32248_1-24
auggaccugggcaagcccaugaaaagcgugcucgucguggcccuguugguaaucuuccaggugugccugugu

SEQ ID NO: 1754 - RNA, 72 nt, Artificial Sequence
  Q7Z7D3_1-24
auggccagccugggccagauccucuucugguccauuaucaguauuaucauuauccuggcaggggccaucgcg

SEQ ID NO: 1755 - RNA, 72 nt, Artificial Sequence
  P54756_1-24
augaggggcagcgggccccggggugccggccgcaggcggccaccguccgggggcggugacacccccaucacu

SEQ ID NO: 1756 - RNA, 72 nt, Artificial Sequence
  Q92823_1-24
augcagcugaagaucaugcccaaaaagaaaaggcucagcgccggccgggugccacugauuuuguuccugugc

SEQ ID NO: 1757 - RNA, 72 nt, Artificial Sequence
  P19320_1-24
augcccggcaagaugguggucauccugggggccagcaacauucucuggaucauguucgcagccucccaggcg

SEQ ID NO: 1758 - RNA, 72 nt, Artificial Sequence
  Q86UN2_1-24
augcugaggaagggcugcuguguggagcuccuguugcugcucgucgccgcagaacugcccuugggugggggc

SEQ ID NO: 1759 - RNA, 75 nt, Artificial Sequence
  P33151_1-25
augcagaggcugaugaugcuccuggccaccagcggcgcaugcuuggggcugcucgccguggcggccgucgcagcc

SEQ ID NO: 1760 - RNA, 75 nt, Artificial Sequence
  P17813_1-25
auggacaggggcacccugccccucgccguggcacuguugcuggccagcugcucccucaguccaacuagccuggcg

SEQ ID NO: 1761 - RNA, 75 nt, Artificial Sequence
  P25445_1-25
augcugggcaucuggacccuccugcccuuggugcugacuagcgucgccaggcucuccaguaagagcgugaacgca

SEQ ID NO: 1762 - RNA, 75 nt, Artificial Sequence
  P01730_1-25
augaacaggggcgugcccuuccggcaccuccugcuggucuugcagcuggcccuccugccagcagccacccaaggg

SEQ ID NO: 1763 - RNA, 75 nt, Artificial Sequence
  Q685J3_1-25
augcccaggccaggcaccauggcccugugccuccugacuuuggugcugagccuccugccgccccaggcagccgcg

SEQ ID NO: 1764 - RNA, 75 nt, Artificial Sequence
  P17787_1-25
auggccaggcggugcggccccguggcacugcuccugggguucgguuugcugcgccucuguagcggcgucuggggg

SEQ ID NO: 1765 - RNA, 75 nt, Artificial Sequence
  Q6UQ28_1-25
auggccguguuccacgacaugcugcuccagccccugggcauguuuuugugccugagccuccaacuguccagugca

SEQ ID NO: 1766 - RNA, 75 nt, Artificial Sequence
  P13987_1-25
augggcauccagggugggagcgugcuguucggccuccuguugguccuggccguguuuugccacuccgggcauagu

SEQ ID NO: 1767 - RNA, 75 nt, Artificial Sequence
  P10721_1-25
augaggggcgcccgcggggcaugggacuuccugugcgugcuccuguugcugcuccggguccagaccgguagcucc

SEQ ID NO: 1768 - RNA, 75 nt, Artificial Sequence
  P12319_1-25
auggcccccgcaauggagagcccaacccugcucugcguggcccuguuguucuuugcgccggacggcguccuggcc

SEQ ID NO: 1769 - RNA, 78 nt, Artificial Sequence
  Q9BZR6_1-26
augaagagggccagcgcaggcgggucccggcugcucgccugggugcugugguugcaggcguggcaagucgccgcaccc

SEQ ID NO: 1770 - RNA, 78 nt, Artificial Sequence
  P25063_1-26
augggcagggccaugguggcacggcuggggcucggucuguugcugcucgcccuguugcugcccacccagaucuacagc

SEQ ID NO: 1771 - RNA, 78 nt, Artificial Sequence
  Q9NR97_1-26
auggagaacauguuccugcagagcuccaugcugaccugcaucuuucucuugauuaguggcagcugugaacugugcgcc

SEQ ID NO: 1772 - RNA, 78 nt, Artificial Sequence
  Q8N131_1-26
augggccugggggccaggggugcaugggccgcgcuccuguugggcacccuccaggugcuggcccuguugggggcagcc

SEQ ID NO: 1773 - RNA, 78 nt, Artificial Sequence
  P49771_1-26
augaccgugcuggcccccgcauggagcccaacuaccuaccuccuguugcugcuccuguuguccaguggccugagcggg

SEQ ID NO: 1774 - RNA, 78 nt, Artificial Sequence
  P02679_1-26
augagcuggucccugcaccccaggaaccucauccuguacuucuaugccuugcuguuucucagcaguaccugcguggca

SEQ ID NO: 1775 - RNA, 78 nt, Artificial Sequence
  P14784_1-26
auggccgcacccgcccugagcuggaggcucccacuguugauccugcuccugccguuggcgaccuccugggccagugca

SEQ ID NO: 1776 - RNA, 81 nt, Artificial Sequence
  P05362_1-27
auggcccccagcuccccaaggccggcacugcccgcccuccugguguugcugggcgcccucuucccagggcccgguaacgcg

SEQ ID NO: 1777 - RNA, 81 nt, Artificial Sequence
  Q13740_1-27
auggagagcaagggcgccuccaguugcaggcuccuguucugucuguugaucagcgcaaccguguuucggcccgggcugggu

SEQ ID NO: 1778 - RNA, 84 nt, Artificial Sequence
  Q13443_1-28
augggcagcggggccagguuccccuccgguacccugcgggugcgcuggcuccuguugcugggccucgucgggccagugcugggc

SEQ ID NO: 1779 - RNA, 84 nt, Artificial Sequence
  P14151_1-28
augaucuuccccuggaagugccagagcacccaaagggaccuguggaacauuuuuaaacucuggggcuggacuaugcuguguugc

SEQ ID NO: 1780 - RNA, 84 nt, Artificial Sequence
  P56199_1-28
auggcccccaggccacgggcacgcccgggcguggccgucgcgugcuguuggcugcucaccgugguacugaggugcugugugagc

SEQ ID NO: 1781 - RNA, 84 nt, Artificial Sequence
  P11279_1-28
auggccgcacccggcagcgccaggcggccacugcuccuguugcugcuccuguugcugcucgggcugaugcacugcgcguccgcc

SEQ ID NO: 1782 - RNA, 84 nt, Artificial Sequence
  P40259_1-28
auggccaggcuggcacucagccccgugccaucccacuggauggucgcccuguugcugcuccugagugcggagccggugcccgcc

SEQ ID NO: 1783 - RNA, 84 nt, Artificial Sequence
  P43681_1-28
auggagcugggcgggcccggugccccaaggcuccugccgcccuugcugcuccuguugggcaccgggcugcuccgggcaagcucc

SEQ ID NO: 1784 - RNA, 84 nt, Artificial Sequence
  P18627_1-28
augugggaggcccaguuccugggccuccuguuuuugcaaccccuguggguggcaccagucaagccgcuccagcccggggccgaa

SEQ ID NO: 1785 - RNA, 84 nt, Artificial Sequence
  Q5ZPR3_1-28
augcugaggcggcgcggcagccccgggaugggugugcacgucggcgccgcacucggggcccugugguucugcuugaccggcgcg

SEQ ID NO: 1786 - RNA, 84 nt, Artificial Sequence
  P23415_1-28
auguacagcuucaacacccugaggcucuaucugugggagacuaucguguuuuucuccuuggccgcaaguaaggaagccgaggcg

SEQ ID NO: 1787 - RNA, 84 nt, Artificial Sequence
  Q8TD46_1-28
augcugugccccuggaggaccgccaaccucggccuguugcugauccucacuauuuuccugguggcagccagcuccaguuugugu

SEQ ID NO: 1788 - RNA, 87 nt, Artificial Sequence
  P17301_1-29
augggccccgagaggaccggggccgcaccacugccgcuccuguuggugcuggcccucagccaggguauccugaacugcuguuuggcg

SEQ ID NO: 1789 - RNA, 87 nt, Artificial Sequence
  P12821_1-29
augggcgccgcaagcgggaggcggggucccggccugcuccugccauugccgcugcuccuguugcugcccccacagcccgcccucgcg

SEQ ID NO: 1790 - RNA, 87 nt, Artificial Sequence
  Q14118_1-29
augaggaugagcgugggccugucccuccuguugccccugugggggcggaccuuccuccuguugcugagugucgugauggcccagagc

SEQ ID NO: 1791 - RNA, 87 nt, Artificial Sequence
  P05231_1-29
augaacagcuucuccaccagugccuuuggccccguggcauucagccuggggcuccuguugguccugccagccgcguuuccggccccc

SEQ ID NO: 1792 - RNA, 87 nt, Artificial Sequence
  O00602_1-29
auggagcugagcggcgccaccauggcaagggggcucgccgugcuguugguccuguuccuccacaucaagaaccugcccgcgcaggcc

SEQ ID NO: 1793 - RNA, 87 nt, Artificial Sequence
  Q9Y6Q6_1-29
auggcccccagggcacggcgcaggcggccacuguucgcccuccuguugcugugcgcgcuccuggcccgcuugcaaguggcacugcag

SEQ ID NO: 1794 - RNA, 87 nt, Artificial Sequence
  Q9ULI3_1-29
auggccagccccagggcaucccgguggccaccgccccuccuccuguugcugcucccacuguugcugcugcccccagccgcgcccggc

SEQ ID NO: 1795 - RNA, 90 nt, Artificial Sequence
  Q8NBP7_1-30
augggcaccgugagcuccaggcggaguugguggccccugccacuccuguugcugcuccuguugcugcucgggccggccggugcacgcgcc

SEQ ID NO: 1796 - RNA, 90 nt, Artificial Sequence
  P02675_1-30
augaagaggauggugagcugguccuuccacaaacugaagaccaugaaacaucuccuguugcugcuccugugcgucuuuuuggugaagagu

SEQ ID NO: 1797 - RNA, 90 nt, Artificial Sequence
  P06756_1-30
auggccuucccacccaggcggcgccugaggcucggcccgcgggggcugcccuugcugcucagcggucuguugcugccacucugccgcgca

SEQ ID NO: 1798 - RNA, 93 nt, Artificial Sequence
  O60609_1-31
auggugaggccccugaacccacggccgcugcccccagucgugcucauguugcugcuccuguugcccccaagcccccugccacucgccgcaggc

SEQ ID NO: 1799 - RNA, 93 nt, Artificial Sequence
  P50895_1-31
auggagcccccagacgccccggcacaggccaggggcgcgccccggcugcuccuguuggccgugcugcucgcagcccacccagaugcacaagcc

SEQ ID NO: 1800 - RNA, 93 nt, Artificial Sequence
  P28906_1-31
augcuggugaggcggggcgcccgcgcagggcccaggaugccacgggguuggaccgcccucugccuguugagccugcucccguccggcuucaug

SEQ ID NO: 1801 - RNA, 93 nt, Artificial Sequence
  P08514_1-31
auggccagggcacugugcccccuccaggcccugugguugcuggagugggugcuccuguugcugggcccaugugcggccccgcccgcaugggcc

SEQ ID NO: 1802 - RNA, 93 nt, Artificial Sequence
  P00742_1-31
augggcaggccccugcaccucgugcuguugagcgccucccuggcagggcuccuguugcugggugagagucucuucauccggcgcgaacaggcc

SEQ ID NO: 1803 - RNA, 96 nt, Artificial Sequence
  P26006_1-32
augggccccgggccaagcagggccccgcgggcaccccgccugaugcucugcgcccuggcguugaugguggccgccgguggcugugucguguccgca

SEQ ID NO: 1804 - RNA, 96 nt, Artificial Sequence
  P13726_1-32
auggagacccccgccuggccaagggugccgcggcccgaaacugcagucgcccgcacccugcuccugggcuggguguucgcgcagguagccggggca

SEQ ID NO: 1805 - RNA, 96 nt, Artificial Sequence
  P11912_1-32
augcccggcgggccaggugugcugcaggcccucccggcaaccaucuuccuguuguuucugcucagcgccgucuaccugggccccgggugccaagcg

SEQ ID NO: 1806 - RNA, 96 nt, Artificial Sequence
  Q9H6X2_1-32
auggccaccgcagagaggcgggcccugggcaucggguuccaguggcucagccuggcgacuuuggugcugauuugcgccggucaaggcgggcgcagg

SEQ ID NO: 1807 - RNA, 99 nt, Artificial Sequence
  Q8IWK6_1-33
auggagcccccaggcaggcggcgcgggagggcccagccgccccugcuccugccauugagccugcucgcacuguuggcccugcucgguggcgggggcggu

SEQ ID NO: 1808 - RNA, 99 nt, Artificial Sequence
  P58335_1-33
augguggccgagaggagccccgcacgguccccaggcaguuggcuguucccggggcucuggcuguugguccugagcggucccggcgggcuccugcgcgcc

SEQ ID NO: 1809 - RNA, 102 nt, Artificial Sequence
  P06731_1-34
auggagagccccuccgccccaccgcacagguggugcauccccuggcagcggcugcuccugaccgcaaguuugcugacuuucuggaacccacccaccacggcc

SEQ ID NO: 1810 - RNA, 102 nt, Artificial Sequence
  P33681_1-34
augggccacaccaggcggcaggggacuagccccuccaagugcccauaccugaacuucuuucaacuccugguguuggccggucugagucauuucuguagcggc

SEQ ID NO: 1811 - RNA, 105 nt, Artificial Sequence
  P38567_1-35
augggcgugcugaaguucaaacacaucuuuuucaggagcuuugucaaguccaguggggugagccagauuguauucaccuuucuccugauccccugcuguuugacu

SEQ ID NO: 1812 - RNA, 105 nt, Artificial Sequence
  P16410_1-35
auggccugccugggcuuccagaggcacaaggcacaacucaaccuggccacccggacuuggcccuguaccuugcuguuuuuccuccuguuuaucccaguguucugc

SEQ ID NO: 1813 - RNA, 111 nt, Artificial Sequence
  P15814_1-37
augaggcccggcaccgggcaggguggccuggaggccccaggggaaccgggccccaaccuccggcaacgcuggccacuguugcugcucggucuggcaguggucacucacggg

SEQ ID NO: 1814 - RNA, 114 nt, Artificial Sequence
  Q92956_1-38
auggagcccccaggcgacugggggccgcccccauggaggagcacccccaagacugaugugcugcggcucguccuguacuugaccuuccugggugccccaugcuaugcacccgcc

SEQ ID NO: 1815 - RNA, 123 nt, Artificial Sequence
  Q86VB7_1-41
augagcaagcugaggauggugcuccuggaggacuccggcagugccgauuuccggcgccacuuugucaacuugagccccuucaccaucacugugguacugcuccuguccgcaugcuuugugacc

SEQ ID NO: 1816 - RNA, 123 nt, Artificial Sequence
  P08648_1-41
augggcagcaggacccccgaguccccacugcacgccgugcagcuccggugggggccgcgcaggcggcccccacuguugccccugcuccuguugcugcucccacccccaccgcgcgucgguggc

SEQ ID NO: 1817 - RNA, 123 nt, Artificial Sequence
  P16109_1-41
auggccaacugccagaucgcaauucuguaccaaagguuccagcggguggucuuuggcaucagccagcuccuguguuucuccgccuugauuagugagcugaccaaucagaaggaaguggcggcc

SEQ ID NO: 1818 - RNA, 132 nt, Artificial Sequence
  O75326_1-44
augaccccacccccgcccggcagggccgcaccaagcgcgccccgggcccgcgugccagggcccccagccaggcugggucucccgcugcgguugcgccugcuccuguugcugugggcagccgcagccuccgcg

SEQ ID NO: 1819 - RNA, 135 nt, Artificial Sequence
  Q8N2Q7_1-45
auggcccugcccaggugcaccuggccaaacuacguguggcgggcagucauggccugucucgugcaccgcggccugggggcgccguugacucugugcaugcucgguugucuguugcaggccggccauguacugagc

SEQ ID NO: 1820 - RNA, 138 nt, Artificial Sequence
  Q86UN3_1-46
augcugcccggccucaggcggcuguugcaggccccagcaagcgccugccugcuccugauguugcuggcgcucccgcuggccgcacccuccuguccaaugcugugcaccuguuacaguagcccacccacuguguccugc

SEQ ID NO: 1821 - RNA, 540 nt, Artificial Sequence
  A0A5B9
auggaccugaagaacguguuucccccagaggucgccguguucgaaccgagcgaggcagaaaucucccacacccagaaagccacucucguaugccuggcgaccggcuucuaccccgaucauguggaguugaguuggugggucaaugggaaggaagugcacagcgguguguccacggacccacaaccccugaaagagcagccagcccucaacgauaguagguauugucugagcucccgguugcgcgucagcgcaacuuuuuggcagaaucccaggaaccauuuccggugccaggugcaauuuuacggccuguccgagaaugacgaauggacccaggaucgcgccaagccaguaacccagauugugagugcagaggccugggggagggcggacuguggcuucacuagcgaauccuaucagcaagguguccucagcgccaccauccuguacgagauucugcucgggaaagcaacgcuguaugccguguuggugagugcccugguccucauggcaauggugaagcggaaggauucccgcggcuga

SEQ ID NO: 1822 - RNA, 465 nt, Artificial Sequence
  B7Z8K6
augagccagccccacaccaagccauccguguucgucaugaaaaacggcacuaauguggccugccugguaaaggaguuuuacccgaaagacaucaggauuaaccucgugaguagcaagaaaaucaccgaguucgaucccgcaauugucaucuccccaagugggaaguauaaugccgugaagcuggguaaauacgaagacagcaacuccgugacguguagcguccaacaugauaauaagacugugcacuccaccgacuuugaaguaaaaaccgauaguacugaccaugugaagcccaaagagaccgaaaacacgaagcagccaagcaaauccugccacaagcccaaggcgauuguccauacugagaaagugaauaugaugagcuugaccgugcugggccuccggaugcuguucgccaagacugucgcagugaacuuuuugcugaccgccaaacucuucuuucuguga

SEQ ID NO: 1823 - RNA, 645 nt, Artificial Sequence
  B9A064
augaggcccaagaccggccagguggggugcgagacuccagaggaacuggguccgggcccccggcaacgcuggccacuccuguugcuggggcucgccauggucgcacacggccuguugaggcccaugguggccccacagagcggugaccccgauccaggggcguccguaggcaguagccgguccagucugcgcagccucuggggcaggcugcugcuccagccgagcccccagcgggccgacccacgcuguuggcccaggggguucuggagcgaaccacaaucccugugcuacguguuugguaccggcacgaaagucacuguguuggggcagcccaaggcaaacccgaccgugacccuguuucccccaaguagcgaggaacuccaggccaauaaagcaacucuggucugucugaucuccgauuucuaucccggcgccgugaccguagcguggaaggccgacgguagcccagugaaagcaggggucgagacgacuaagcccaguaagcaguccaacaauaaauacgccgccagcuccuauuugagucucaccccagagcaauggaagucccaucgguccuacagcugccaggugacucacgaaggcaguaccguggagaaaaccgucgcaccgacggaauguuccuga

SEQ ID NO: 1824 - RNA, 2520 nt, Artificial Sequence
  O00206
augaugagcgccuccaggcuggcaggcacccucauccccgccauggcguuccugaguugcgugcggccagagagcugggaaccgugugucgaggugguacccaacauuacuuaccagugcauggaauugaauuuuuauaagaucccagacaaccugcccuucuccaccaaaaaucucgaucugaguuuuaacccauugcgccaccuggggagcuacuccuucuuuagcuuccccgagcuccaagugcuggaccuguccaggugugaaauucagacgaucgaggauggugccuaucagagucucagccaucuguccacuuugauucugaccggcaauccaauccagagccucgcacugggggccuuuaguggccuguccagcuugcaaaagcucgucgcaguggagaccaaccuggccucccuggaaaauuucccgaucggucaccucaaaacucugaaggaguugaacguggcgcauaaucugauucagaguuuuaaacuccccgaauacuucagcaaccugaccaaucuggagcacuuggaccucuccagcaacaagauccagaguauuuauugcacggaucugcggguccugcaucagaugccacuccugaauuugucccuggaccucagccugaaccccaugaauuuuauccaaccaggggccuucaaggagauucgccugcacaaauugacucucaggaacaacuucgauagucugaaugugaugaagaccuguauccagggccuggcaggccucgaaguacaccggcugguguugggggaguuucgcaacgaagguaaucuggagaaauucgacaaguccgcccucgaaggccugugcaaccugacuauugaggaguuuagguuggccuaccuggauuauuaccucgacgauaucaucgaccuguucaauugucucaccaacgucagcagcuuuucccuggugagugugaccauugaacgggucaaagauuucagcuacaauuuuggguggcagcauuuggagcuggugaacugcaaguucggccaguuucccacgcucaaacugaagucccugaagcgcuugacuuucaccagcaauaaaggugggaacgcauuuagugaaguagaccugccgucccucgaguuccuggaccucagcaggaauggccuguccuuuaagggcuguugcagucaaagcgauuucgggacuaccuccuugaaauaucuggaccugagcuucaacggugugaucaccaugaguuccaauuuucucggccuggaacaguuggagcaccuggauuuccagcauagcaaccucaagcaaauguccgaguuuagugucuuccugagccuccggaaucugauuuacuuggacaucucccacacucacacgcgcguggccuuuaacgggauuuucaacggccugagcagucuggaagugcucaaaauggcggguaauuccuuucaggagaacuuccugcccgauaucuuuaccgaauugaggaaucugacuuuccucgaccugagccagugccagcuggagcaacucuccccaaccgccuuuaacagccugaguagcuugcagguccugaauaugucccauaacaauuucuucagucucgauaccuuucccuauaagugucugaacagcuugcaagugcuggacuacucccucaaucacaucaugacuagcaagaaacaggaacugcagcauuucccauccagucuggcauuucucaaccugacgcagaaugauuucgccugcaccugugagcaccagagcuuuuugcaguggauuaaggaccaacggcagcugcucguagagguggaacgcauggagugcgcaacucccuccgauaaacagggcaugccaguccugaguuugaacaucaccugucagaugaauaagaccauuaucggggugagcguccuguccgugcucgugguaagcguggucgccgugcuggucuauaaauucuacuuucaucugaugcuccuggccggcugcauuaaguaugggaggggugaaaacaucuacgacgcguucgugaucuacaguucccaagacgaggauugggugcggaaugaguugguaaagaaccuggaagagggcgugccgcccuuucagcucugucugcacuaucgcgacuucauuccaggggucgcaaucgccgccaacauuauccacgaaggcuuucauaaaagcaggaaggugauugucguggugucccagcacuucauccaaagccgguggugcauuuuugaguacgaaaucgcacagacuuggcaguuccugaguuccagggccgguaucauuuucaucguacuccagaaagucgagaagacguugcugcgccaacagguggagcuguaucggcuccugagcaggaauaccuacuuggaaugggaggauagugugcugggccgccauaucuuuuggcggaggcuccgcaaagcgcugcuggacgggaaguccuggaaccccgaaggcacugucgggaccggcuguaauuggcaggaggccacuagcauuuga

SEQ ID NO: 1825 - RNA, 1377 nt, Artificial Sequence
  P01730
augaacaggggcgugcccuuccggcaucugcuccuggucuugcagcuggcccuccugccagcagccacccaagggaagaaagugguauuggguaagaaaggcgacacuguggagcugaccugcacggcgagccagaagaaauccauccaguuucacuggaagaauaguaaccagauuaagauccucgggaaucaaggcagcuuccugacuaaagguccguccaagcugaacgaucgcgccgacaguaggcggagccucugggaucaggggaauuuuccccugauuaucaaaaacuugaagauugaagacuccgauaccuacaucugugaggucgaagaccagaaagaggaagugcagcugcucguguucggccugaccgcaaauagcgauacucaccuguugcaaggccagucccucacccugacgcuggagaguccacccgggagcuccccaagcguccagugccgcagucccagggguaagaacauccagggcgggaaaacucucuccgugagccaacuggaguugcaggacuccggcaccuggacuuguaccguacugcagaaucaaaagaagguggaauuuaaaauugauaucgucgugcucgccuuccagaaggcaaguagcauuguguauaaaaaggagggugaacaggucgaguuuuccuucccacuggccuuuaccguggagaaacugacggggagcggcgaauugugguggcaggcggagcgggccaguuccagcaagaguuggaucacuuucgaccucaagaacaaagaaguauccgugaagcgcgucacccaagauccgaaacugcagaugggcaagaaacugccccuccaucugacuuugccacaggcacugccccaguacgccgggagcgguaaucucacccuggcccuggaggcaaagaccggcaaguugcaccaagaagugaaccucguggucaugagggccacucagcugcagaaaaaucugacgugcgaggugugggggccaaccagccccaagcucaugcuguccuugaaacuggagaacaaggaagcgaaaguaaguaagcgggagaaggccguguggguccucaauccggaagcaggcauguggcagugucugcugagcgacuccggucaaguguugcuggagagcaacauuaaaguccuccccacuuggaguaccccagugcagcccauggcccugaucgugcucggcgggguagcaggccuguugcuguuuauugggcucgguaucuucuucugcgugcgcuguaggcaucggcgcaggcaggccgaacggaugucccagaucaagcgccugcugagcgagaaaaagaccugccaauguccacacagguuucagaaaacuugcucccccauuuga

SEQ ID NO: 1826 - RNA, 537 nt, Artificial Sequence
  P01850
auggaggaccugaacaagguguuucccccagaagucgccguguucgagccgagcgaagcagagaucucccacacccagaaagccacucucguaugccuggcgaccggcuucuuucccgaucauguggaauugaguuggugggucaaugggaaggaggugcacagcgguguguccacggacccacaaccccugaaagagcagccagcccucaacgauaguagguacugucugagcucccgguugcgcgucagcgcaacuuucuggcagaaucccaggaaccauuuucggugccaggugcaauucuauggccuguccgaaaaugacgaguggacccaggaucgcgccaagccaguaacccagauugugagugcagaagccugggggagggcggacuguggcuuuacuagcgucuccuaccagcaaggugugcucagcgccaccauccuguaugagauucugcucgggaaagcaacgcuguacgccguguuggucagugcccuggugcucauggcaaugguaaagcggaaggauuucuga

SEQ ID NO: 1827 - RNA, 624 nt, Artificial Sequence
  P07766
augcagagcggcacccacuggagggugcuggggcucugccuguuguccgucgguguguggggccaagacgggaacgaggaaaugggcgguaucacucagacccccuacaagguaaguauuagcgggacgacugugauccugaccuguccacaguauccgggcuccgagauucucuggcagcauaaugauaaaaacaucggcggggacgaagaugacaagaauauugguagugaugaggaccaccugagcuugaaagaguucuccgaacuggagcaaagcggcuacuaugucugcuacccccggggguccaagccagaagaugccaacuuuuaucucuaccugcgcgcaagggugugugagaauugcauggaaauggacgugaugagugucgccaccaucgugaucguagauauuuguaucacuggcggucugcuccuguugguguauuacuggagcaaaaaccggaaggcgaaggccaaacccgucacccgcggggcaggcgccggcgggaggcagcggggucagaauaaggagcgcccacccccagugccgaaccccgacuacgagccaauuaggaaaggccagcgggaucuguauuccgggcucaaucaacgcaggaucuga

SEQ ID NO: 1828 - RNA, 3915 nt, Artificial Sequence
  P08575
auguaccuguggcucaagcuguuggccuucggcuuugcauuccuggacaccgagguguuugucacugggcagagccccaccccauccccgacgggucucacuaccgccaaaaugcccagugugccacugagcuccgaucccuugccaacccacacuaccgcguucagucccgccagcacguuugaaagggagaacgacuucuccgaaacuaccacuagccuguccccagauaauaccaguacccaaguaagcccggacucccucgauaacgcaagcgccuuuaauacgacuggcgugaguuccguccagacgccccaucugccaacucacgcagacagccagacccccuccgccgggaccgauacucagacguucaguggcagcgcggccaacgcaaagcugaauccaacccccgguuccaacgccaucagcgacgugccgggggagcggaguacugccuccaccuuucccaccgauccagugagcccccucacuacgacccugaguuuggcacaucacuccagcgccgcgcugccagcccgcacuagcaauaccaccauuacugcaaacacguccgacgccuaucucaaugcaagugaaaccacuacccugagccccuccggcagcgccgucaucaguacuaccacgauugccaccacuccauccaaaccgaccugcgaugagaaguacgcgaacaucacuguggacuaucuguacaauaaagagaccaaguuguucacggcaaagcucaacguaaaugaaaacguggaguguggcaauaacacgugcacuaacaaugaaguccauaaccugaccgaguguaaaaaugccagcguguccauuagucacaacagcugcacugcccccgauaagacccugauccucgacgugccacccggggucgagaaauuucaacugcacgacuguacccagguggaaaaggcagauaccacuaucugcuugaaauggaagaauauugagaccuucacuugugacacccagaacaucacguauagguuccagugcgguaauaugauuuuugauaacaaagaaaucaagcuggagaaucucgaaccagagcaugaguacaagugugacuccgaaauucuguauaacaaucacaaauucaccaacgccagcaagaucauuaaaacugauuuuggcagucccggggagccgcaaaucaucuucugccgguccgaagcggcccaucagggcguaauuaccuggaauccaccccagcgcagcuuucacaacuucacucugugcuacaucaaggagaccgaaaaagacuguuugaaucucgauaagaaccugauuaaguacgaccugcagaaccucaaacccuauacuaaguacgugcuguccuugcacgcauauaucauugccaaaguccaaaggaaugguagugcagccaugugccauuuuaccaccaagagcgccccacccucccagguguggaacaugaccgugagcaugacuuccgauaauuccaugcacgucaaaugucggccaccgcgcgacaggaacgggccccaugagcgguaccaccuggagguggaagcaggcaauacccucguacgcaacgagagccauaagaauugcgauuucagggugaaggaccugcaguauuccacugacuacaccuuuaaagccuauuuccacaacggcgauuacccaggggaacccuuuauccugcaccauagcacgaguuacaauagcaaggcguugaucgccuuccucgcauuucugauuaucgucaccuccauugcccugcucgugguccuguauaaaaucuacgacuugcacaagaaacggaguuguaaccuggaugagcaacaggaacucguggagcgcgacgaugagaagcagcugaugaauguggaaccaauucaugccgacauccuguuggagacuuauaagaggaaaaucgcagaugaaggucggcuguuccucgcggaguuccagagcauuccccgcguauuuuccaaguucccgaucaaagaggccaggaagccauuuaaccaaaauaaaaaccgguacguggacauucugcccuaugauuacaaucgcgucgaacucagcgagaucaacggcgacgcaggguccaacuauauuaaugccaguuacaucgauggcuucaaggaaccaaggaaauacauugccgcacaggguccccgggacgagaccguggaugacuuuuggaggaugaucugggaacagaaggccacugucaucgugauggugacccgcugcgaggagggcaaccggaauaagugugcggaauauuggccgagcauggaggaagggacgagggccuucggcgacguaguggucaaaauuaaccagcacaagcgcugccccgauuacaucauucaaaaacugaauaucgugaacaagaaagagaaggcaaccgggcgggaagucacucacauucaguuuaccuccuggccagaccauggugugcccgaggauccacacuugcugcucaagcugaggcgccgggugaaugccuucaguaacuuuuucagcggccccaucguaguccauuguuccgccggggugggcaggacugguaccuauaucggcauugacgcaaugcuggagggguuggaagccgagaauaaaguggaugucuacggcuauguggugaagcugcggcgccagaggugccucaugguacaggucgaagcgcaauacauccugauucaccaggcccucguggaguauaaccaguuuggggaaacggaggugaaucugagcgaguugcauccauaccugcacaacaugaaaaagcgggacccgcccagugaaccaaguccccuggaggcagaguuccagcgccucccaagcuacagguccuggcggacccaacacaucggcaaucaggaagagaacaaaagcaagaaucgcaacaguaacgucauucccuaugauuacaauagggugccgcugaagcaugaauuggagauguccaaagaaagcgagcacgacagugaugaauccagcgacgaugacuccgacagcgaggagcccaguaaguauaucaacgccagcuucaucauguccuacuggaaaccagaaguaaugauugcagcccaggguccccugaaggagacuaucggggauuuuuggcaaaugauuuuccagcggaaagugaaggucaucgugaugcucaccgaacugaaacauggcgaccaggagauuugcgcgcaguauuggggugaaggcaagcaaacuuacggggauaucgagguggaccucaaggauaccgacaaaaguagcacguauacucugagggucuuugaguugcgccacuccaagcggaaagauagcaggaccguguaccaguaccaguauaccaauugguccguagaacagcugccagccgagcccaaggaacugauuaguaugauccaaguggucaaacagaagcucccacagaagaacagcuccgagggcaauaaacaccauaagagcacuccgcuguugauccacugucgcgacgggagucagcaaaccggcauuuucugcgcacugcucaaccugcuggaguccgccgaaacugaggaagugguggauaucuuucaggucgugaaagcccuccggaaggcaaggcccgguaugguaagcaccuucgagcaguaccaauuucuguaugacgugauugccuccacguacccagcgcagaaugggcaggucaaaaagaacaaucaucaggaagauaagaucgaguucgacaacgagguggauaaagugaagcaagacgccaauugugucaaccccuugggcgcaccagaaaaacugcccgaggccaaggaacaggcagagggcagugaaccgaccagcgggacugaggguccagagcacuccgugaauggccccgccagccccgcccucaaccaggggaguuga

SEQ ID NO: 1829 - RNA, 765 nt, Artificial Sequence
  P08637
auguggcagcugcuccugcccaccgccuugcugcuccuggugagcgcaggcaugaggacugaggacuugccaaaggccgucguguuccuggaaccgcaaugguaccggguacucgagaaagauuccgugacccugaagugccagggggcguauagucccgaagacaacagcacgcagugguuucacaaugagucccugaucaguagccaggccuccagcuacuucauugaugcagccacugucgacgauuccggugaauaucgcugucaaaccaaccucaguacccugagcgacccagugcaguuggaggugcauaucggcuggcugcuccugcaggcacccaggugggucuuuaaagaggaagauccaauucaucugcggugccacuccuggaagaauacugccuugcacaaagugaccuaccuccagaacgggaagggccgcaaguauuuccaucacaauagcgacuuuuacauccccaaagcgacgcugaaggauagugguuccuauuucuguagggggcuguuuggcagcaaaaacguauccagugagacugugaauauuaccaucacucaaggccucgccgucagcaccaucuccagcuucuuuccaccgggguaccaggugaguuucugccuggugauggucuugcuguuugcaguggacaccggucucuacuucuccguaaagacgaacauucggagcaguacucgcgauuggaaagaccacaaguucaaauggaggaaggauccccaggacaaguga

SEQ ID NO: 1830 - RNA, 663 nt, Artificial Sequence
  P10747
augcugaggcuccuguuggcccugaaccucuuccccagcauccaggugaccggcaauaagauucuggucaaacaauccccaauguugguggcauacgacaacgccguaaaucugaguugcaaguauagcuacaaccucuuuucccgggaguuccgcgcgagucugcacaaagggcuggauagcgccguggaagucugugugguguaugguaauuacucccagcagcuccaggucuauagcaagacuggcuuuaacugcgacgggaaacugggcaaugaguccgugaccuucuacuugcaaaaccuguauguaaaucagacggauaucuacuuuuguaagauugaagugauguacccgcccccauaucucgacaacgagaagaguaaugguacuaucauucaugucaaagggaagcaccugugccccagcccacuguuccccggcccauccaaaccguuuuggguguugguggucgugggcgggguacucgcauguuacagccugcuggugaccgucgccuucaucaucuuuugggugaggaguaagcggucccgccuccugcauagcgauuauaugaacaugacccccaggcggccaggucccacucgcaaacacuaccagccauaugcacccccgagggacuucgccgcguaccgguccuga

SEQ ID NO: 1831 - RNA, 681 nt, Artificial Sequence
  P11912
augcccggcgggccaggugugcugcaggcccucccggcaaccaucuuccuguuguuucugcucagcgccgucuaccugggccccgggugccaagcguuguggaugcacaaggugccagccucccugaugguaagucucggcgaggacgcacauuuccaguguccccacaacagcuccaauaacgccaaugugacuugguggaggguccugcaugguaacuauaccuggccacccgaauuucuggggccaggcgaggauccgaauggcacgcucauuauccagaacgugaauaaaagucacggggguauuuacgugugccggguccaggaaggcaacgagagcuaucaacaguccugugggacuuaccugcgcgugaggcagcccccaccccggccauucuuggacaugggcgaagguaccaagaaucgcaucauuaccgcagaggggaucauccugcucuuuugcgccguagugcccggcacucugcuguuguucaggaaacgguggcagaacgagaagcucggccuggaugcgggggacgaauaugaggaugaaaaucuguacgagggucucaaccuggacgauuguagcauguaugaggacauuucccgcggcuugcaagggaccuaccaggaugucggcagucugaauaucggugacgugcagcucgaaaaaccguga

SEQ ID NO: 1832 - RNA, 1671 nt, Artificial Sequence
  P15391
augcccccaccgaggcugcuguucuuucuguuguuccugacccccauggaggugcggccagaggaaccccucgucgugaagguagaagagggcgacaacgccgugcugcagugcuugaaagggacuagcgaugguccaacccaacagcugacguggucccgcgaaaguccccucaagccauuucugaaacugagccucggccugccgggguugggcauccacaugaggccccuggcaauuuggcucuuuaucuuuaaugucucccagcagauggguggguucuaccugugucaaccagggcccccaagugagaaggccuggcagcccggcuggacugugaacguggagggcagcggugaacuguuucgguggaaugucuccgacuugggcgggcucggcugcggucugaaaaaccgcagcuccgaggggccgaguagccccuccggcaagcugaugagcccaaagcucuaugugugggcgaaagauaggcccgaaauuugggagggcgagccacccugucugccaccgcgggacaguuugaaucagucccugagccaggaucucaccauggcccccggguccacccuguggcugaguugcgguguaccacccgacagcgugucccgcggcccauugagcuggacucauguccaccccaaggggccgaaaagucuccugucccuggaacucaaggaugacaggccagcacgggauaugugggugauggagaccggccuguugcugccccgcgccacggcacaagacgccgguaaauacuauugucauaggggcaaccucacuaugagcuuccaccuggaaaucaccgcgcggcccgugcuguggcauugguugcuccgcacugggggcuggaaggucagugccgugacccuggcauaccugauuuucugccucuguucccugguagggaucuugcaccuccagagggcccucgugcugcggcgcaaaaggaagcggaugaccgauccaacgcgcagguucuuuaaggucacucccccaccggguagcggcccccagaaucaguaugggaacgugcugagcuugccaacccccacuuccggccugggucgggcccaaaggugggcagccggccucgggggcaccgcgccaaguuacgggaaucccagcuccgacgugcaggccgauggcgcacuggguagccgcaguccgccaggggucggccccgaggaagaggagggugaaggcuaugaggaaccagacuccgaggaagacagcgaguucuacgagaacgauuccaaucucgggcaggaccaacugagucaggauggcagcggguacgaaaaccccgaggacgaaccguugggccccgaggaugaagacuccuucagcaaugccgagaguuaugagaacgaagaugaggaacugacccagccaguggcacggacuauggacuuucucagcccccacgguuccgccugggauccauccagggaggccacgagucuggggagccaguccuacgaggacaugcgcggcauccuguaugcggcaccccaauugcggagcauuaggggccagccagggccgaaucaugaagaggaugccgacaguuacgaaaacauggacaaccccgaugguccagaccccgccuggggcgggggcggucgcauggggaccugguccacucgguga

SEQ ID NO: 1833 - RNA, 672 nt, Artificial Sequence
  P16410
auggccugccugggcuuccagaggcacaaggcacaacucaaccuggccacccggacuuggcccuguaccuugcuguuuuuccuccuguuuaucccaguguucugcaaagcgaugcaugucgcccagccggcagugguauuggccagcucccgcgggauugcaaguuuugugugugaguacgccagccccgguaaggcgacggaagucagggugacugugcugcggcaggccgacucccaggucaccgaggugugcgcagccaccuauaugaugggcaaugaacucacuuuccuggaugacaguaucuguaccgggacgagcuccggcaaccaaguaaaucugacuauucagggucuccgcgccauggauaccgggcuguacaucugcaaaguggaguugauguauccacccccauacuaucugggcauuggcaacgggacucagaucuacgucaucgaccccgaaccauguccggauagcgacuuucuccuguggauucuggcagccguguccagugguuuguucuuuuauagcuuccuccugaccgcggugucccugagcaagaugcucaaaaagaggaguccccugaccacgggcgucuacgugaagaugccacccacugagccagagugcgaaaaacaguuucaacccuacuucaucccgauuaauuga

SEQ ID NO: 1834 - RNA, 1419 nt, Artificial Sequence
  P16671
augggcugcgacaggaacugugggcugaucgccggugcagugauuggcgccguccucgcgguguucgggggcauccugaugcccguaggugauuugcugauucagaagaccaucaaaaagcaagugguccucgaggaagggacuauugccuuuaaaaauugggugaagaccggcacggagguguaccggcaguucuggaucuuugacguccagaacccacaggaagugaugaugaauagcuccaacauccaaguaaaacagcgcggcccguauacuuacagggugcgguuccuggcaaaggagaaugucacccaggaugccgaagacaacaccgugagcuuuuugcagcccaauggggcaauuuucgagccaagucuguccguggguacugaggccgauaacuuuaccguccucaaucuggcgguggccgcagccagucacaucuaucaaaaccaguucguacagaugauucugaauagccucaucaacaaguccaaaagcuccauguuucaggugcgcacgcugagggaauugcuguggggcuaccgggaccccuuccucagucuggucccauaucccgugacuaccacuguggggcuguuuuacccauauaauaacaccgccgauggcgucuacaagguguucaaugguaaagacaacauuagcaagguagcaaucauugauaccuacaaagggaagcgcaacuuguccuauugggagagccauugcgacaugaucaauggcacggaugccgcgaguuucccgcccuuuguggaaaaaucccaaguccuccaguucuuuagcuccgacaucuguaggaguauuuacgccguguucgagagcgaugucaaccugaagggcaucccaguguaucgguuugugcugcccuccaaggcauucgccagcccaguagagaaucccgacaacuacugcuuuuguacugagaaaauuaucaguaagaauugcaccuccuauggggugcucgacauuagcaaauguaaggagggucgcccggucuacaucagucugccccacuucuuguaugcauccccagaugugagcgaacccaucgacggccugaacccaaaugaggaagaacauaggacuuaccucgauauugagcccaucaccggguuuacccugcaguucgccaaacggcugcaagucaacuugcucgugaagccaagcgaaaagauucaggugcugaaaaaucugaagcgcaacuacaucguaccgauucucuggcugaaugagacuggcacgaucggugacgaaaaagccaacauguuuaggucccaggugaccggcaagaucaauuugcuggggcucauugagaugauccugcugagugucggcguggucauguucguggcguuuaugauuagcuauugcgcaugucgguccaaaacuaucaaguga

SEQ ID NO: 1835 - RNA, 651 nt, Artificial Sequence
  P26718
augggcuggaucagggggcggcgcagcaggcacuccugggagaugagugaguuccauaacuacaaucuggaccucaagaaaagcgauuuuuccacccgguggcagaagcaacgcugccccguggucaaaaguaaguguagggaaaacgccagcccauucuuuuucugcuguuuuauugcaguggccauggguauccgguucauuaucaugguagcgauuugguccgccguguuucugaauagcuuguucaaccaggaaguccagaucccgcugacugaguccuauugcggccccuguccaaagaauuggaucugcuacaagaacaauuguuaucaguuuuucgacgaaaguaagaacugguacgagagccaagcauccugcaugagccagaaugccagucuccugaaaguguauuccaaggaggaucaggacuugcugaaacucgugaaaagcuaccacuggauggggcugguccauauucccaccaacggcuccuggcagugggaagaugguaguauccugagcccaaaucuccugacgauuaucgagaugcaaaaaggggacugugcauuguaugccuccagcuuuaagggcuacauugaaaacugcaguacucccaauaccuacaucugcaugcagcgcaccguguga

SEQ ID NO: 1836 - RNA, 261 nt, Artificial Sequence
  P30273
augauccccgccgugguccugcuccuguugcugcucguggagcaggcagccgcgcugggcgaaccacaauugugcuacauucuggacgccauccucuuccuguaugggauuguacugacccuccuguacuguagguugaagauccaggugcggaaagcagccauuacuagcuaugagaaguccgauggugucuacaccggccugaguacgcgcaaccaggaaacuuaugagacccucaaacacgaaaagccgccccaguag

SEQ ID NO: 1837 - RNA, 1137 nt, Artificial Sequence
  P32248
auggaccugggcaagcccaugaaaagcgugcucgucguggcccuguugguaaucuuccaggugugccugugucaagaugaggucaccgacgauuacauuggggacaacacuaccguggauuauacgcucuuugaaucccugugcaguaagaaagacgugaggaauuucaaggcaugguuuuugccaaucauguacagcauuaucuguuucgucggucugcucggcaacgggcuggugguacugacuuauauuuacuuuaaacggcucaagaccaugaccgauacuuaucuguugaaucuggccguggcggacauccucuuccugcugaccuugccguuuugggccuacuccgcagccaagaguugggucuucggcgugcacuuuugcaaacucaucuucgcaauuuauaagaugagcuuuuucuccgguaugcugcugcuccuguguaucagcauugaucgcuacguggccaucguccaggcgguguccgcccauaggcaccgggcacgcguauugcugauuaguaaacucagcugcguggggaucuggauucuggccacgguccuguccauccccgaguugcucuacagcgaccugcagaggaguuccagcgaacaggccaugcgguguucccugaucacugagcauguggaagcauucauuaccauccaaguggcccagauggucauuggcuuucucgugccacuguuggcgaugaguuucugcuaucugguaaucauucgcacucuccugcaggccaggaacuuugagcggaauaaggcaaucaaagugaucauugccgucguggucguguucaucguguuucagcugcccuacaacggcguaguguuggcacaaaccgucgccaauuucaacauuaccagcuccacgugugagcucagcaagcagcugaauaucgccuaugaugugacuuacagucuggcgugcguccgcugcugugugaacccauuucucuaugcauucauuggggugaaauuuaggaaugaccuguucaaguuguuuaaggaucuggguugccucucccaggaacagcugcggcaauggagcaguugucgccacaucaggcgguccagcaugagcguagaggccgaaaccacuaccaccuucucccccuga

SEQ ID NO: 1838 - RNA, 690 nt, Artificial Sequence
  P40259
auggccaggcuggcacucagccccgugccaucccacuggauggucgcccuguugcugcuccugagugcggagccggugcccgccgcacggagcgaagaccgcuacaggaacccaaagggcuccgccugcagucggaucuggcagagcccccgcuucauugcaaggaaacggggguuuaccguaaagaugcauuguuauaugaacuccgccagcgguaauguguccugguuguggaaacaagagauggaugaaaauccacagcagcugaagcucgagaaaggccgcauggaagagagucagaacgagagccuggcgacucugaccauccaagggauuagguucgaagacaauggcaucuacuuuugccagcagaaguguaacaauacguccgaggucuaucaggguugcgggacugaacuccgggugaugggcuucagcacccuggcccaauugaagcagcgcaacacccugaaagauggcauuaucaugauccagacucuccugauuauccuguuuauuaucgugcccauuuucuugcuccuggacaaggaugacaguaaagcagggauggaggaggaucacaccuacgaaggucuggacaucgaucagacggccacuuaugaggacauugucacccucaggacuggcgaagugaagugguccguaggggagcauccaggccaagaauga

SEQ ID NO: 1839 - RNA, 990 nt, Artificial Sequence
  P42081
auggacccccagugcaccaugggccugagcaacauccucuucgugauggccuuucuguuguccggggcagccccacugaagauucaagcguacuucaaugagacugccgaucucccgugucaguuugcaaacagucagaaucagagccuguccgaauuggucguguucuggcaagaccaggagaaccugguacucaaugaaguguaucuggguaaagagaaguuugauaguguccacagcaaauacaugggcaggaccuccuucgacagcgauuccuggacgcugcggcuccauaaccugcagaucaaggacaaaggguuguaucagugcauuauccaccauaagaagcccacuggcaugauucgcauccaccaaaugaauagugaacugagcgugcucgccaacuuuucccagccagagaucgugcccauuagcaauaucaccgagaacgucuacauuaaucugaccuguaguuccauccaugguuauccagaacccaaaaagaugagcgugcuguugaggacuaaaaacuccaccauugaguacgaugggguaaugcagaagagucaggacaaugugacggaacucuaugaugucagcaucucccugagcgugaguuucccagacgugacuuccaacaugaccaucuuuugcauucuggagacugauaaaacccggcuccugagcaguccguucuccaucgaguuggaagacccccaaccacccccagaucacauucccuggaucaccgcaguccugccgacggugauuaucuguguaaugguguuuugccucauucuguggaaguggaaaaagaagaaacgccccaggaauagcuacaaguguggcacuaacaccauggagcgggaagagagcgaacagacuaaaaagcgcgagaaaauccacaucccagagagguccgacgaagcccagcgggucuucaagaguagcaagaccuccagcugcgacaaaagugauaccuguuucuga

SEQ ID NO: 1840 - RNA, 1011 nt, Artificial Sequence
  Q15762
auggacuaccccacccugcuccuggccuugcugcacguguauagggcacucugcgaggaaguccuguggcauacuagcgugccauucgccgagaacauguccuuggaauguguauacccgaguaugggcauccugacccagguggagugguuuaagauugggacgcaacaggauagcaucgcgauuuucucccccacucacgguauggucauccggaaaccauaugccgaacgcguguacuuucucaauaguaccauggcaagcaacaauaugacccuguucuuuaggaacgccuccgaggacgaugugggcuauuacagcugcucccuguauacuuacccccaggggaccuggcagaaggucauucaagugguacagagugacagcuucgaggcagccgugccauccaauagccauaucgucagugaacccggcaaaaacgugacgcucacuugucagccacagaugaccuggccggugcaagcgguccggugggagaagauccagccccgccagauugaucuguugacuuacugcaaucuggugcacgguaggaacuuuaccuccaaauucccacggcagaucguaagcaauuguucccaugggcgcuggagugugauugucauccccgacgugaccgugagcgauuccggccucuauaggugcuaccugcaagccagcgcaggcgaaaacgagacguuugucaugcggcugacuguggccgaggggaagaccgacaaucaguauacuuuguucguagccgguggcaccgugcuccugcugcucuuugucauuaguaucaccacuauuaucgugaucuuccugaaccgcaggcggcgcagggaacggcgcgauuuguucacggaguccugggacacccagaaggcaccaaauaacuacaggagccccauuaguacuucccaaccgaccaaucagagcauggaugacacccgggaagauaucuaugucaacuaccccacuuuuagccgcaggccaaaaacgcggguguga

SEQ ID NO: 1841 - RNA, 13482 nt, Artificial Sequence
  Q685J3
augcccaggccaggcacuauggcccugugccuccugacuuuggugcugucccuccugccgccccaggcagccgcggagcaagacuuguccgucaaccgggccgugugggauggggguggcuguaucagucagggggacguacugaaucgccagugccagcaacucagccagcacgugaggacuggcuccgcagccaacaccgcaacugguacuacuagcacuaaugucguggaaccacggauguaccugagcuguuccacuaaccccgagaugaccagcauugaauccagugugacuagcgauacuccaggggucuccagcacucgcaugacucccaccgagaguaggacgacuuccgaaagcaccuccgacaguacuacccuguucccaagcuccaccgaggauacuagcaguccgacgacccccgagggcacugacgugccaauguccacccccagcgaagagaguaucuccagcaccauggccuuuguaagcacugcgccacuccccuccuucgaagccuauacgagucugaccuacaagguggauaugagcacuccguugaccaccuccacucaggcaagcaguucccccacgaccccagagagcacuaccauucccaaauccacuaauagugagggcagcaccccacugacguccaugcccgccagcaccaugaaggucgccaguuccgaagcaaucacucuccugaccacuccaguggagauuagcaccccggugacgaucuccgcccaggcgaguagcucccccaccacugccgaagggccaagccugaguaacuccgcacccagcgguggcuccaccccauugacucggaugccccucagcgucaugcuggugguaaguagcgaggccuccacccugaguacgaccccggcagccacuaauaucccagugauuaccagcacugaagccuccagcucccccaccacggcggaggggaccaguauccccacuagcaccuauacugagggcuccaccccacucaccagcacccccgcaagcacgaugccagucgccaccuccgaaaugagcacucugaguauuaccccgguggacacuuccaccuuggugacgaccagcacugagcccuccagccugccaaccacugccgaagcaaccaguaugcucacguccacccugagcgaggguaguacuccccugaccaacaugccagucuccacuaucuugguggccagcuccgaagcgagcaccacgaguaccauucccguagauagcaaaacuuuugugaccacugccuccgaggcaaguagcuccccgaccacggccgaggacacuagcaucgcaaccuccaccccaagugaagggagcacuccccucaccuccaugccagucagcacuacccccguggccaguuccgaggccagcaaucuguccacgaccccggucgauaguaagacucaagugaccacuagcaccgaagcauccagcagucccccaacggccgaggugaacuccaugcccaccagcacuccauccgaaggcagcacuccccugaccaguauguccguaagcaccaugccaguggcgaguagcgaggccuccacgcucagcacuaccccggucgacaccuccacucccgugaccacgaguagcgaggcauccaguagcuccacuaccccagaaggcaccagcauucccaccaguaccccauccgaggggagcacgccccugacuaauaugccggucuccacccgcuugguggugagcagugaagccuccaccacuagcaccacgcccgccgauaguaacacuuucguaaccaccuccagcgaggcauccagcaguuccacuaccgcggaggguacuagcaugccaacgaguaccuacagcgaaaggggcacuaccaucaccuccaugagcguguccacuacgcuggucgccaguagcgaggcauccacccucagcacuacccccguggacaguaauaccccagucacuacguccaccgaagccacuagcuccaguaccaccgccgaggggacuagcaugcccacguccaccuauacugaaggcagcaccccacugaccaguaugccggugaacaccacgcugguggcauccagcgaggccuccaccuugaguacuacccccguagacacuagcaccccagucacgaccuccacugaggcgagcaguagccccaccacugccgauggugcauccaugccaaccaguacccccagcgaaggcuccacuccgcucacgagcaugccaguguccaaaacccugcugaccaguagcgaggccuccacccucagcacuacuccccuggacacgaguacccauaucacuaccuccacugaagccagcugcucccccaccacgaccgaggggaccaguaugccaauuagcacccccuccgaaggcagcccauugcugaccaguaucccgguguccauuacccccgucacgagcccagaggcauccacccucagcacuacccccguggauaguaauuccccagugacuaccagcacggagguaaguagcucccccaccccggccgaagggacuagcaugccaaccuccacuuacagugagggucggacuccccugacgagcaugccagucuccaccacucugguggcgaccagugccaucagcacuuuguccaccacgcccguggacacuagcaccccggucaccaacuccacugaagcacgcaguagccccaccacuuccgagggcaccagcaugccaacgaguacccccggggaaggcuccacuccacugaccagcaugcccgauaguacuaccccagugguauccagcgaggccaggacgcucuccgcaaccccgguggacacuagcacccccgucacuaccaguacggaggccaccuccagcccaacuaccgcggaagguaccaguauucccaccagcacgccauccgagggcacuacuccccugaccagcacuccggugucccacacccucguggccaacagugaagcaagcacgcuguccacuaccccagucgauagcaauacccccuugacuaccaguacugaggccuccagucccccacccacggccgaggggaccuccaugcccaccaguacuccgagcgaaggcuccacuccccugacucggaugccagugagcaccacgaugguagcaaguuccgagacuagcacccucuccaccacucccgccgacaccagcacgccagugacuaccuauagucaggcguccagcaguuccaccacugccgaugggaccagcaugcccacgagcacuuacuccgaaggcaguaccccgcugaccagcgucccaguguccacucgccugguggucaguagcgaggcauccaccuugagcacgacucccguggacaccuccaucccaguaacuaccaguaccgaagccagcuccagucccacgacugcagaggguaccagcaucccgacuagcccacccagcgaggggaccacuccccuggccaguaugcccguguccacuacgcucgucgugagcuccgaagccaacacccugagcacuacccccguggauaguaagacccaggucgcaacuuccacggaggcgagcaguccacccccgaccgccgaagugacuuccaugccaaccagcacccccggcgagaggagcacuccacucacguccaugcccguacggcauaccccgguggccaguagcgaagcauccacucugaguaccagcccagucgacacuuccacccccgugacgaccagcgccgagacuuccaguagccccaccacugcagaggguaccuccuugccaacgagcaccaccagugaaggcuccacccugcugacuagcauucccguguccaccacgcucgucaccaguccagaggccagcacucuguugaccacuccgguggacaccaaggggcccguagugacguccaaugaagucagcaguuccccaacccccgcggagggcacuagcaugccaaccuccacuuacagcgaggggcgcacuccccugaccaguaucccggugaacaccacgcucguggccagcuccgcaauuaguauccugagcaccacuccagucgauaauuccacccccgugacuaccagcacggaagccuguuccaguccaaccacuagcgagggcaccuccaugcccaacaguaaucccagcgaagguacuaccccacucacguccauuccgguaagcaccacucccguggucaguuccgaggccagcacccuguccgcaacuccaguggacaccagcacgcccgggaccaccagugccgaagcgaccuccagcccaacuaccgccgagggcaucaguauccccacguccacuccgagcgagggcaaaaccccauugaaguccauucccgucagcaacaccccaguggcaaauagugaagccagcacucuguccaccacucccguggauaguaacagcccagucgugaccuccacggcaguaagcuccagucccaccccggccgaggggacuagcaucgcgauuuccacccccagcgaagguaguacugcccugaccuccaucccagugagcacgaccacugucgcauccagugagauuaauagccucuccaccacucccgccgugaccagcacgccagugaccacuuauagucaggccuccagcagucccaccacugcagacggcaccuccaugcaaacgagcacuuacuccgaagggagcaccccgcugaccaguuugccagucagcacuaugcuggugguauccagcgaggccaacacccucaguacgacucccaucgauuccaaaacccaggugaccgcgagcacugaggccuccaguagcaccacggcagaaggcuccagcaugacuauuaguaccccauccgaggguagcccccugcugaccuccaucccagucaguacuacccccguggccagcccggaagcauccacucucagcacgaccccaguggacaguaauucccccgucaucacuagcaccgagguguccagcagucccaccccagccgaagggacuuccaugccgacgagcaccuauacugagggcaggaccccacugaccaguauuacuguacggacgaccccaguggccagcuccgcgaucagcacuuuguccaccacccccgucgauaacaguacuccagugacgaccagcacugaggcacgcuccagucccaccacuagcgaaggcaccuccaugccaaauagcaccccguccgaggggacgacuccccugaccaguauuccagugagcacuacccccguccucuccagcgaagccaguacccuguccgccacuccaaucgacacgagcacccccgugacuaccaguaccgaggcaacuuccagcccgacgaccgccgaggguacuuccauucccaccagcaccuugagugaaggcaugacuccacugacguccacccccguaagccacacucucguggcgaacagugaggccagcacccuguccacuaccccagucgauagcaacucccccguggugacgaguaccgcagucagcuccagcccgacuccagccgaagggaccaguaucgccacuuccacccccagcgagggcuccacggcacugaccaguaucccagugagcacuaccacuguagccuccagcgaaaccaauacgcucaguaccacucccgcagugaccuccacuccagucaccacguacgcccaggugagcuccagccccaccacugcggacgguaguuccaugccgaccagcacucccagggaggggcggccaccccugaccaguauuccagugagcacuaccacggucgccuccagcgagaucaacaccuuguccacuacccuggcagauacuaggacccccgugacgaccuauagucaagccagcuccaguccgacuaccgccgacggcacuagcaugccaacccccgcauacuccgaaggcagcacgccacucaccuccaugccccugaguacuaccuugguagugagcuccgaggcgagcacucugaguaccacgccagucgauaccuccacucccgccaccacuagcaccgaagggaguuccagcccgacgacugccgguggcaccuccauucagaccagcacuccaagugagcgcaccacgccccucgcagggaugcccguguccacuacccugguggucagcagugaaggcaauacccugagcacuaccccaguggacuccaagacucagguaaccaacagcacggaggccuccaguagcgcaaccgccgaggguuccaguaugacuaucagcgcgccguccgaagggagcccccuccugaccuccauuccauugaguacuacccccguggccagcccagaggcauccacgcugagcacuacccccgucgacaguaauuccccagugaucaccagcacugaagucuccaguagcccgauccccaccgagggcacguccaugcagacuagcaccuauagugaucggaggaccccacucacuuccaugcccgugagcaccacgguaguggccaguagcgccauuuccacucugagcaccaccccaguggacacuuccacccccgucacgaacaguacugaagcacgcagcuccccgaccaccagcgagggcaccaguaugcccaccuccacuccaagcgagggguccacgcccuuuaccaguaugccagugagcacuaugcccgucgugaccuccgaagccagcacccugagugcgacuccaguagauacguccaccccggugacuaccagcaccgaggccacuuccagccccacgaccgcagaagguaccaguaucccaaccuccacccucagcgagggcacuacgcccuugaccaguauuccagugucccauacucuggucgccaauagcgaggugagcacccuguccacuacccccgucgacaguaacacgccguucaccacuagcaccgaagcauccaguccaccacccacugccgaggggaccagcaugccaacguccaccagcuccgaaggcaauacuccgcucacccggaugcccgugaguacuaccaugguagcgagcuuugagacguccacccugagcacuaccccagccgauaccaguacccccgugacuaccuacucccaagcagguagcuccccaacgaccgccgacgauaccaguaugcccacuagcacuuacuccgaaggcagcaccccauugacgaguguccccguguccaccaugccgguggucagcagugaggccuccacucacagcaccacuccaguggacaccagcacgcccguaaccacuuccaccgaggcaaguagcuccccaacuaccgccgaagggacgagcauccccaccaguccgcccuccgagggcacuaccccacuggcgagcaugcccguguccacuaccccagucgugaguagcgaagccgggacgcucuccaccacucccguggauaccagcacuccaaugaccacgaguacugaggcauccagcuccccgaccaccgccgaagacauugucgugcccaucaguacugcaagcgaggguuccacccugcugacuagcauuccaguaaguaccacgcccguggccuccccagaggccagcacccucuccacuacccccgucgauagcaacaguccgguggugacuagcaccgaaaucuccaguagcgcaacguccgcggagggcaccagcaugccaacuuccaccuauagugaagggagcacucccuugagguccaugcccgucaguaccaaaccacuggccagcuccgaggccagcacgcugaguaccacucccguggacaccuccaucccaguaacuaccagcacggagacuuccagcaguccgaccaccgcaaaggacacuuccaugcccauuagcaccccaagugaaguguccacgagccucacuuccauccuggucagcaccaugcccguggccaguagcgaggcauccaccuugaguacuaccccaguggauacucgcacgcuggucaccaccagcacuggcaccuccagcucccccacuacggccgaagguaguagcaugccgaccuccacuccaggcgagcggagcacucccuugaccaauauucuggugaguacuacgcugcucgcgaacuccgaagccagcaccuuguccacuaccccaguagacaccaguacucccgugaccacgagcgcagaggccuccagcaguccgacuaccgccgaggggaccuccaugaggaucagcacucccuccgauggcagcaccccacugacgaguauucuggucuccacucuccccguggcaagcagugaagccagcaccguguccacuaccgcggucgacaccagcaucccagugacgacuuccaccgaggccaguagcucccccacuaccgcagaaguaaccaguaugccaacuagcacgcccuccgagaccagcacuccgcugaccaguaugccagugaaucacacccccgucgccuccagcgaagcagggacuuuguccacgaccccaguggauacuagcacccccgugaccaccaguacgaaagccuccagcaguccgaccacugcggaggguaucgucgugccaauuuccaccgccagcgagggcuccacucugcucaccagcauccccguaaguacgacccccguggcauccagcgaagccaguacucugagcaccacuccagucgacaccuccauucccgugacgaccagcacugagggguccaguagcccaaccacugccgaaggcaccuccaugccgaucaguacgcccagcgagguguccaccccacugacuagcauucucgucuccaccgugcccguagcagguagugaagccagcacuuuguccaccacgccaguggauacccggacucccgucaccacuagcgcggaggccaguuccagcccgaccacugcagagggcaccuccaugccaaucaguacgcccggggaacgcaggaccccacugacuagcauguccgugagcaccaugcccgucgccaguuccgaggccagcacucugagucggacccccgcagacacgagcaccccagugacuaccuccacugaagccagcuccaguccgaccacggcggagggcaccgggauccccauuagcacuccauccgagggcagcacuccccucaccaguaucccaguguccaccacgcccguagcaauuccggaagccagcacccuguccacuaccccaguggauaguaacagccccgucgugacuuccaccgaggucagcaguuccccaacgcccgccgaagguacuagcaugccgaucuccaccuacagcgaggggaguacccccuugacuggcgugccaguguccaccacgcccguaacuagcagugcaauuuccacccugagcaccacuccagucgacaccagcacucccgugaccacguccaccgaagcccauaguagcccaacuaccuccgaggguaccaguaugcccaccagcacgccguccgagggcagcaccccacucacuuauaugcccguguccaccaugcuggucgugaguagcgaagauuccacucugagcgcgaccccaguggacacgaguacucccguaaccaccuccacugaggccaccagcaguacgacugcagaagggaccuccaucccgaccagcacuccauccgagggcaugacuccccucacgagcguccccgugaguaauacuccaguggccuccagcgaagccaguauccugagcaccacccccgucgauuccaacacuccauugaccacuagcacggaggcauccaguagcccgcccaccgccgaggggacuuccaugccaaccagcacccccagugaaggcuccacuccacugacgagcaugcccguguccaccacuaccguggcaaguagcgagaccuccacucucagcacgaccccggccgacaccaguaccccaguaaccacuuacucccaggcgagcuccagucccccaauugccgacgguacgagcaugcccaccuccacuuauagcgaagggaguacuccccugacuaacauguccuucagcaccacgccagucguguccagcgaggcaaguaccuugagcacuaccccgguggauacuuccacccccgucacgaccaguacugaggccagccuguccccaaccacugccgaaggcaccagcauccccaccuccaguccaagcgagggcacuacgccccucgcauccaugccggugaguaccacuccaguggucagcuccgaaguaaauacccugagcaccacucccguggacaguaacacgcuggugaccacuuccaccgaggcgagcuccagcccaacuauugccgaagggaccagucuccccacguccaccacuagcgaggguaguaccccacuguccaucaugcccuugagcacuaccccggucgccuccagcgaggcaaguacgcugagcaccacucccguggauaccuccacuccagugaccacgaguagccccaccaauuccagcccaacuaccgccgaagucacuuccaugcccaccaguacggcaggcgaggggagcaccccgcucacuaacaugccaguauccaccacucccguggccagcagugaagcguccacccugagcacgaccccaguggacuccaauacuuuugucaccaguagcucccaggccagcaguucccccgcaacucuccaggugaccacuaugcgcaugagcaccccauccgagggcagcaguagccugacgaccaugcuccuguccaguacuuacgugaccagcuccgaagccagcacucccuccaccccgagugucgauaggagcacgccaguaaccacuuccacccaaaguaacagcacucccacgcccccagaggugauuacgcugccgauguccacccccagcgaggugaguacuccacucaccaucaugcccgucuccacuaccagcgugacgauuuccgaagccgguacugcaagcacccugccaguagacaccaguacucccgugaucaccuccacgcaggucagcaguuccccagugacuccggaggggaccaccaugcccaucuggacuccaagcgaaggcuccacccccuugacuacgaugccagugagcaccacccgggucaccaguagcgagggcuccacccugaguacucccagcguggucaccuccacgccggugacuaccagcaccgaagccauuuccaguagcgcgacucucgauuccaccacgaugagcguaaguaugcccauggagaucuccacucuggggaccaccauucuggugagcacuaccccagugacgcgcuuccccgaguccaguacuccaagcauccccuccgucuauaccagcaugaguaugaccacugccuccgaagguagcaguuccccaaccacguuggagggcacuaccaccaugccgaugagcacuaccuccgaaaggagcacgcuccugacuaccgugcugauuagucccaucagcgucauguccccaagugaggcaagcacucucuccacgcccccaggggacaccagcacuccccuguugacguccaccaaggccggcaguuuuagcaucccggcagaggugacuaccauucggaucuccauuaccagcgaaaggaguacuccacugacgacccuccugguauccacuacccugcccaccagcuuccccggugccuccaucgcgaguacuccaccguuggauacgagcaccacuuucacccccuccacugacaccgccagcacgccaaccauucccguggcaacuaccaucagugucuccgugaucacugaggggagcaccccaggcacgaccauuuuuauccccuccacuccagugaccagcaguacugccgaugucuuccccgccaccacgggcgcaguguccaccccgguaauuacuagcaccgaacucaauacuccaaguaccagcuccagcuccacgaccaccaguuuuagcaccacuaaggaguucaccacucccgccaugaccacggcggccccacugaccuacgugacuauguccaccgcacccaguacuccgcgcaccacgagccgggggugcaccacuuccgccagcacccuguccgcaaccaguacuccccacacgagcaccuccgucacuaccaggccagugacucccagcagugaauccagccgcccaaguaccaucacgucccauaccauucccccaacuuuuccgcccgcccacagcuccaccccacccacuaccagcgccaguuccacgacugugaacccagaggcggucaccaccaugacuacccggacuaaacccagcaccaggacgaccaguuucccgacugugaccacuaccgcaguaccaacgaauaccacuaucaagagcaaccccaccuccacucccaccgugccacgcacgaccacuuguuuuggugacggcugccagaauaccgccagccgguguaaaaacgggggcacuugggacggucucaagugccagugccccaaucuguacuauggggaguugugugaagaggucguguccaguauugauaucggcccaccggaaaccaucagcgcccaaauggagcugacggugacugucaccuccgugaaauucaccgaagaacucaagaaccacagcagucaggaguuucaggaguucaagcagacuuuuaccgagcaaaugaauauuguauacuccggcauccccgaauaugugggggucaacauuacgaaacugaggcuggguagcgugguggucgagcaugacguguugcugcgcacuaaguacaccccagaauauaaaaccguacucgauaacgcaacugagguggucaaggagaaaaucaccaaggugacgacucagcagauuaugaucaaugacaucugcuccgauaugauguguuucaacaccaccggcacucaagugcagaauauuaccgucacucaguacgaccccgaagaggauugccggaagauggccaaagaauauggggacuacuuugugguagaguacagggaucagaagccauauuguaucagucccugcgagccgggcuucagcguguccaaaaacuguaaucuggguaagugccaaaugagccucaguggcccacagugucugugcgucacgaccgaaacucacugguacuccggggagaccugcaaccagggcacccagaaaaguuugguguaugggcuggugggugcgggcgucgugcucaugcugauuauccugguagccuugcugaugcucguguuccgcuccaagcgggaagucaagaggcaaaaauaccgccugagucagcucuauaaguggcaggaggaagacagcgggcccgcaccaggcacuuuucagaauauugguuucgauaucugucaagacgaugacuccauccaucuggagagcauuuacaguaacuuucagcccuccuugcggcacaucgacccggagacgaaaauuaggauccagcgcccccaagugaugaccacuagcuucuga

SEQ ID NO: 1842 - RNA, 1215 nt, Artificial Sequence
  Q9NNX6
augagcgacuccaaggagcccaggcugcagcaacucggccuguuggaagaggaacagcugcgggggcucgguuuccgccagaccaggggcuacaaaagucuggccgggugcuugggccacgguccacuggugcuccagcugcugagcuuuacucuccuggcaggguugcugguccaaguguccaagguaccgaguagcaucucccaggagcagagccggcaggaugccauuuaucaaaaccucacccagcugaaagcggccgugggcgaacuguccgagaagaguaaauugcaggagaucuaccaggaacucacgcaacugaaggcagccgucggcgagcugcccgaaaagagcaaacuccaggagauuuaucaggagcugacucgcuugaaggcagccgugggggaacugccagagaaauccaagcuccaagaaaucuaccaggagcugaccuggcugaaagcggccgugggugaauugcccgaaaagagcaaaaugcaggagauuuaucaggaacucaccaggcugaaggcagccgucggcgagcugccagaaaagaguaaacaacaggagaucuaccaggaacucacucggcugaaggccgcagugggggaguugcccgagaaauccaagcagcaagaaaucuaucaggagcugacccgccucaaagccgcgguaggcgaacugccagaaaagagcaagcagcaggaaauuuaccaagagcugacgcaguugaaagccgcaguggagaggcucugucauccgugccccugggaauggacuuucuuucaggguaauuguuacuucauguccaacagucagcggaauuggcacgacagcaucaccgccugcaaggaggucggggcacaacugguggugauuaaauccgccgaggagcagaacuuucugcagcuccaaagcagucgcuccaauagguucacuuggaugggccugagcgauuugaaccaggagggcaccuggcagugggucgacgggaguccacugcuccccuccuuuaagcaguauuggaaucggggugaaccaaacaaugugggcgaggaagauugugccgaguucagcgggaacggcuggaaugacgauaaaugcaaccuggcgaaguuuuggaucuguaagaaaagcgcagccuccugcagucgcgacgaggagcaauuccugagccccgccccggcaacccccaauccacccccagccuga

SEQ ID NO: 1843 - RNA, 3126 nt, Artificial Sequence
  Q9NR97
auggagaacauguuccugcagagcuccaugcugaccugcaucuuucuguugauuaguggcagcugugaacugugcgccgaggaaaauuucuccaggaguuaccccugugacgagaagaaacaaaacgauagcgugaucgcagaaugcuccaaucggcgccuccaggaggucccacagacuguggggaaguauguaaccgagcuggacuugagcgauaacuuuauuacgcacaucacuaaugaauccuuccagggucugcaaaaccucaccaaaauuaaucugaaccauaauccgaacgugcagcaccagaauggcaaccccgggauccagaguaauggccugaacaucaccgacggugccuuucucaaucugaagaacuugagggagcugcuccuggaagauaaccaacugccacagauucccagcggguugccagagucccucacugagcugagccugauccagaauaacauuuacaauaucaccaaagaaggcauuagucggcucaucaaccugaagaauuuguaucuggcguggaacuguuacuucaauaaggucugcgagaaaacgaacauugaagacggcguguuugagacucucaccaaucuggaacuguugucccucagcuucaacucccugagucaugugcccccaaagcugccgagcucccuccgcaaacuguuuuugagcaauacucagaucaaguauaucagugaggaggauuucaaagggcugauuaaccucacccugcuggacuuguccgguaauugucccaggugcuuuaacgccccauuccccugugucccaugcgauggcggggcaagcaucaauauugaccgguucgccuuucaaaaccucacccagcugcgcuaccugaaccucaguuccacgagccugaggaagaucaaugcagccugguucaaaaacaugccccacuugaaggugcuggaucucgaauuuaauuaucugguaggcgagauugcgagcggugccuuccugacuauguugccgcggcuggaaauccucgaccuguccuuuaacuacaucaaggggaguuacccccagcauauuaauaucagccgcaacuucuccaaacuccugagcuugagggcacugcaccuccggggcuauguguuucaagagcugcgcgaagaugacuuccagccacugaugcaguugcccaaucugaguaccauuaaccucggcaucaauuuuauuaagcagaucgacuucaaacuguuucaaaacuucuccaaucucgagaucauuuaccugagcgagaacaggaucuccccauuggucaaggauacucggcagaguuaugccaauagcuccagcuuucagcgccacauuaggaaacggcgcaguaccgacuucgaauuugauccccauuccaacuuuuaccacuucaccaggccacugaucaagccgcagugcgccgcauaugggaaggcccuggaccucagccucaauuccauuuucuucaucggucccaaccaauuugagaacuugccagauauugcgugucugaaucucagugccaacagcaaugcacaggugcuguccggcacugaguucagcgccaucccccaugugaaauaccucgaccugacgaacaaucgguuggauuuugacaacgcaagugcccugaccgaacuguccgaucucgaaguccuggacuugagcuauaauucccacuacuucaggaucgccggggugacucaccaucuggaguuuauucagaacuucaccaaucucaagguacugaaccugagccacaauaacaucuacacccucacugauaaauauaaucuggagaguaagagcuugguggaacuggucuuuuccggcaaccgccucgacauucuguggaaugacgaugacaaccgguacaucaguauuuucaaagguuugaagaaccugacgaggcucgaucugagccugaaucgccucaagcauaucccaaacgaggcguuccugaauuugcccgcaucccugaccgaacuccacaucaacgacaauaugcugaaauuuuucaacuggacuuugcugcagcaauuuccgcggcucgagcugcuggaucucaggggcaauaagcuguuguuccugaccgacagccucuccgauuuuaccaguagccugcgcacucugcucuugucccauaaccggauuagucaucugccaagcggguuccuguccgaggugagcagucucaaacaccuggacuuguccagcaaucugcucaagacgaucaacaaauccgcccuggaaaccaagacuaccacuaagcugagcaugcucgaguugcacggcaaucccuuugaaugcaccugugauauuggggacuucaggcgguggauggaugagcaccugaacgugaaaaucccccgccuggucgacgugauuugcgccaguccaggugaucagaggggcaaguccaucguaagccucgaacugacgaccugugugagugacgucacugcagugaucuuguuuuucuuuaccuucuuuauuacuaccauggucaugcuggccgcgcucgcccaucaccuguucuauugggacgugugguucaucuacaaugugugccuggcaaaaguaaagggguaucggucccucagcacgucccagaccuuuuacgaugccuauauuagcuacgacacuaaagaugcaagugugaccgacugggucaucaacgaguugcgcuaccaccuggaggaaagcagggauaagaaugugcugcucugucuggaggaacgggacugggaucccggcuuggccauuaucgacaaccugaugcaguccauuaaccaaaguaaaaagacugucuucgugcucaccaagaaauaugccaagagcuggaauuuuaaaacggcauucuaccuggcccugcagcgccucauggaugagaacauggacgugaucaucuuuauuuugcuggaaccaguacugcagcauucccaauaucucaggcugcggcagaggaucugcaagagcuccauuuugcaguggccggauaaucccaaagcggagggucuguucuggcagacccuccgcaacgugguccugacugagaaugacagucgguacaacaauauguauguggacagcaucaagcaauacuga

SEQ ID NO: 1844 - RNA, 66 nt, Artificial Sequence
  P16671_TM_1_8-29
ggccugaucgccggggcagugauuggugccguccucgcgguguucggcgggauccugaugcccgua

SEQ ID NO: 1845 - RNA, 81 nt, Artificial Sequence
  P32248_TM_1_60-86
uuccugcccaucauguacagcauuaucugcuuugugggccuccuggggaacgguuuggucgugcugaccuauauuuacuuc

SEQ ID NO: 1846 - RNA, 66 nt, Artificial Sequence
  P16671_TM_2_440-461
cugcucggccugaucgagaugauuuugcugagcgugggggucgugauguucguagccuuuaugauc

SEQ ID NO: 1847 - RNA, 63 nt, Artificial Sequence
  P32248_TM_2_96-116
uaccugcucaaccuggccguggcagacaucuuguuccugcucacccugcccuuuugggccuau

SEQ ID NO: 1848 - RNA, 66 nt, Artificial Sequence
  P32248_TM_3_131-152
cugaucuucgccauuuacaagaugagcuuuuucuccggcaugcuccuguugcugugcaucaguauu

SEQ ID NO: 1849 - RNA, 63 nt, Artificial Sequence
  P32248_TM_4_171-191
gugcugcucaucagcaagcuguccugcgucggcauuuggaucuuggccaccgugcugaguauu

SEQ ID NO: 1850 - RNA, 84 nt, Artificial Sequence
  P32248_TM_5_220-247
uucaucaccauucagguggcccaaauggucaucggcuuucuggugccccuccuggcaaugagcuucugcuacuugguaauuauc

SEQ ID NO: 1851 - RNA, 78 nt, Artificial Sequence
  P32248_TM_6_264-289
gugaucauugccgucgugguaguguucaucgucuuucagcugcccuacaacggcguggugcucgcacaaaccgucgcc

SEQ ID NO: 1852 - RNA, 54 nt, Artificial Sequence
  P32248_TM_7_314-331
cuggccugcgugagguguugcgucaaccccuuccucuacgcauuuaucggcgug

SEQ ID NO: 1853 - RNA, 69 nt, Artificial Sequence
  A0A5B9_TM_145-167
accauccuguacgagauucuccugggcaaggccacuuuguaugcagugcuggucagcgcccucgugcug

SEQ ID NO: 1854 - RNA, 69 nt, Artificial Sequence
  B7Z8K6_TM_130-152
cugggccucaggaugcuguucgccaagaccguggcagucaacuuuuugcugacugccaaacucuucuuu

SEQ ID NO: 1855 - RNA, 63 nt, Artificial Sequence
  O00206_TM_632-652
accaucauuggcgugagcguccuguccgugcucguagugagugucguggccgugcuggucuac

SEQ ID NO: 1856 - RNA, 66 nt, Artificial Sequence
  P01730_TM_397-418
auggcccugaucgugcucggcggggucgcaggucuguugcuguucauuggccucgggaucuuuuuc

SEQ ID NO: 1857 - RNA, 63 nt, Artificial Sequence
  P01850_TM_151-171
auccugcucggcaaggccacccuguacgcaguguuggucagcgcccuggugcucauggcgaug

SEQ ID NO: 1858 - RNA, 78 nt, Artificial Sequence
  P07766_TM_127-152
gugaugagcgucgccaccaucgugauuguagacaucugcauuacuggcgggcugcuccuguugguguacuauuggucc

SEQ ID NO: 1859 - RNA, 66 nt, Artificial Sequence
  P08575_TM_576-597
gcccugaucgcauuccucgccuuucugauuaucgugaccagcauugcguugcuggucgugcucuac

SEQ ID NO: 1860 - RNA, 63 nt, Artificial Sequence
  P08637_TM_209-229
gugagcuucugccuggucauggugcuccuguuugccguagacaccggcuuguacuucuccgug

SEQ ID NO: 1861 - RNA, 81 nt, Artificial Sequence
  P10747_TM_153-179
uucugggugcuggucgugguaggcggggugcucgccugcuacagccuguuggucaccguggcauuuaucauuuucugggug

SEQ ID NO: 1862 - RNA, 66 nt, Artificial Sequence
  P11912_TM_144-165
aucauuaccgccgagggcaucauucuccuguucugcgcagugguccccgggacucuguugcuguuu

SEQ ID NO: 1863 - RNA, 66 nt, Artificial Sequence
  P15391_TM_292-313
gugagcgccgucacccuggcauaccucaucuucugccuguguuccuuggugggcauucugcaccuc

SEQ ID NO: 1864 - RNA, 63 nt, Artificial Sequence
  P16410_TM_162-182
uuccugcucuggauccuggccgcagugagcuccggcuuguuuuucuacaguuuucugcucacc

SEQ ID NO: 1865 - RNA, 63 nt, Artificial Sequence
  P26718_TM_52-72
cccuucuuuuucugcuguuuuaucgccguggcaaugggcauuagguucaucauuauggucgcc

SEQ ID NO: 1866 - RNA, 63 nt, Artificial Sequence
  P30273_TM_24-44
cugugcuacauccucgacgccauucuguucuuguauggcaucgugcugacccuccuguacugu

SEQ ID NO: 1867 - RNA, 63 nt, Artificial Sequence
  P40259_TM_160-180
ggcaucauuaugauccagacccugcucauuauccuguucauuaucgugcccaucuuuuugcug

SEQ ID NO: 1868 - RNA, 63 nt, Artificial Sequence
  P42081_TM_248-268
uggaucaccgccgugcugcccacugucauuaucugcgugaugguauucugucucauucugugg

SEQ ID NO: 1869 - RNA, 63 nt, Artificial Sequence
  Q15762_TM_255-275
ggcgggaccgugcugcuccuguuguucgucaucagcauuacuaccaucauugugaucuuucug

SEQ ID NO: 1870 - RNA, 63 nt, Artificial Sequence
  Q685J3_TM_4394-4414
cuggugggcgccggggucgugcucaugcugaucauuuugguagcacugcucaugcugguguuc

SEQ ID NO: 1871 - RNA, 63 nt, Artificial Sequence
  Q9NNX6_TM_38-58
cugggccacgggccccucgugcugcaguugcugagcuucacccuccuggccgguuugcugguc

SEQ ID NO: 1872 - RNA, 63 nt, Artificial Sequence
  Q9NR97_TM_828-848
gccgugauccuguucuuuuucaccuuuuucauuacuaccauggucaugcucgcagcccuggcg

SEQ ID NO: 1873 - RNA, 48 nt, Artificial Sequence
  P14207_1-16
auggucuggaaauggaugccccuacuccuccuccucgucugcgucgcc

SEQ ID NO: 1874 - RNA, 48 nt, Artificial Sequence
  O75787_1-16
auggcgguguuugugguguuguuggcguugguggcggggguguugggg

SEQ ID NO: 1875 - RNA, 48 nt, Artificial Sequence
  P07359_1-16
augccccuccuccuccuccuucuccuucuccccuccccucuccacccc

SEQ ID NO: 1876 - RNA, 48 nt, Artificial Sequence
  P08637_1-16
auguggcaacuccuccuccccaccgcccuccuucuccucgucuccgcc

SEQ ID NO: 1877 - RNA, 51 nt, Artificial Sequence
  P07237_1-17
augcucaggcgcgcgcucuuaugcuuggcuguggccgcgcucgugcgcgcg

SEQ ID NO: 1878 - RNA, 51 nt, Artificial Sequence
  O60911_1-17
augaaccucucccucguccuagccgccuucugccucggaaucgccuccgcc

SEQ ID NO: 1879 - RNA, 51 nt, Artificial Sequence
  P20138_1-17
augcccuuacuccuccuccucccccuccuuugggccggcgcccuagccaug

SEQ ID NO: 1880 - RNA, 51 nt, Artificial Sequence
  P27797_1-17
augcuccuauccguaccccuacuccucggccuccucggccucgccgucgcc

SEQ ID NO: 1881 - RNA, 54 nt, Artificial Sequence
  P10747_1-18
augcuacgccuccuucucgcccucaaccucuuccccuccauccaagucaccggc

SEQ ID NO: 1882 - RNA, 54 nt, Artificial Sequence
  O75487_1-18
auggcccgcuucggccuacccgcccuccucugcacacucgcaguccuauccgcc

SEQ ID NO: 1883 - RNA, 54 nt, Artificial Sequence
  P07996_1-18
augggcuuggccuggggcuugggcgugcucuuucucaugcacgugugcgggacc

SEQ ID NO: 1884 - RNA, 54 nt, Artificial Sequence
  P22748_1-18
augcgcaugcuuuuggcuuuacucgcgcucucggccgcgcgcccgagcgcgagu

SEQ ID NO: 1885 - RNA, 54 nt, Artificial Sequence
  Q15762_1-18
auggacuaccccacccuccuccuugcccucuuacacgucuaccgagcucucugc

SEQ ID NO: 1886 - RNA, 54 nt, Artificial Sequence
  P30273_1-18
augauacccgccgucguccuccuccuccuccuccucgucgaacaagccgccgcc

SEQ ID NO: 1887 - RNA, 54 nt, Artificial Sequence
  P38570_1-18
auguggcuauuccacacccuacucugcaucgccucccucgcccuccucgccgcc

SEQ ID NO: 1888 - RNA, 54 nt, Artificial Sequence
  Q01638_1-18
auggguuucuggauccuugccauccucaccauccucauguacuccaccgcagcc

SEQ ID NO: 1889 - RNA, 54 nt, Artificial Sequence
  Q9NZQ7_1-18
augcgcaucuuugcugucuuuaucuucaugaccuacuggcaccuucuuaacgcc

SEQ ID NO: 1890 - RNA, 57 nt, Artificial Sequence
  P13591_1-19
augcuccaaaccaaagaccuaaucuggacccucuucuuccucggcaccgccgucucc

SEQ ID NO: 1891 - RNA, 57 nt, Artificial Sequence
  P26842_1-19
auggcgcgaccgcacccgugguggcucugugucuugggcacgcuagugggcuugagc

SEQ ID NO: 1892 - RNA, 57 nt, Artificial Sequence
  P15391_1-19
augcccccuccccgccuccucuucuuccuccucuuccuuacucccauggaaguccgu

SEQ ID NO: 1893 - RNA, 57 nt, Artificial Sequence
  Q8NI17_1-19
augauguggaccugggccuuguggaugcucccgagcuugugcaaguucucgcucgcg

SEQ ID NO: 1894 - RNA, 57 nt, Artificial Sequence
  P08571_1-19
auggaacgcgcuuccugccuccuccuacuccuccucccacucguccacgucuccgcc

SEQ ID NO: 1895 - RNA, 57 nt, Artificial Sequence
  P05154_1-19
augcaacuauuccuccuccucugccucguccuccucuccccccaaggcgccucccuc

SEQ ID NO: 1896 - RNA, 57 nt, Artificial Sequence
  P02787_1-19
augagauuggccgugggcgcgcuauuggucugugccgugcucgggcucugucucgcg

SEQ ID NO: 1897 - RNA, 57 nt, Artificial Sequence
  P02671_1-19
auguucucgaugaggaucgugugcuuggucuugaguguggucgggaccgcguggacg

SEQ ID NO: 1898 - RNA, 57 nt, Artificial Sequence
  P04216_1-19
augaaccucgcuauaucuaucgcccuccuccucaccguccuccaagucucccguggc

SEQ ID NO: 1899 - RNA, 57 nt, Artificial Sequence
  P00747_1-19
auggaacacaaagaagucguccuccuccuccuccucuuccucaaauccggccaaggc

SEQ ID NO: 1900 - RNA, 57 nt, Artificial Sequence
  P01764_1-19
auggaauucggccugagcuggcucuuccucguggccauacucaaaggcgugcaaugc

SEQ ID NO: 1901 - RNA, 57 nt, Artificial Sequence
  P16150_1-19
auggccacccuacuacuccuccucggcguccucgucgucucacccgacgcccucggc

SEQ ID NO: 1902 - RNA, 57 nt, Artificial Sequence
  Q6DN72_1-19
augcuauuguggacggccgugcucuuguucgugcccugugucgggaaaacggucugg

SEQ ID NO: 1903 - RNA, 57 nt, Artificial Sequence
  Q01151_1-19
augagcaggggcuugcaauugcucuugcucucgugcgcguacucgcucgcgcccgcg

SEQ ID NO: 1904 - RNA, 57 nt, Artificial Sequence
  P07093_1-19
augaacuggcaccucccccucuuccuccucgccuccgucacccuacccucaaucugc

SEQ ID NO: 1905 - RNA, 57 nt, Artificial Sequence
  Q8WWQ8_1-19
augaugcuccaacaccucguaaucuucugccucggacucgucguccaaaauuucugc

SEQ ID NO: 1906 - RNA, 60 nt, Artificial Sequence
  Q13291_1-20
auggaccccaaaggccuccucucccucaccuucguucucuuccucucccucgccuucggc

SEQ ID NO: 1907 - RNA, 60 nt, Artificial Sequence
  P35225_1-20
auggcccuccuccucacaaccgucaucgcccuaaccugccucggcggcuucgcauccccc

SEQ ID NO: 1908 - RNA, 60 nt, Artificial Sequence
  P25942_1-20
augguacgacuaccccuccaaugcguccuauggggcugccuccucacagccguccacccc

SEQ ID NO: 1909 - RNA, 60 nt, Artificial Sequence
  P52803_1-20
augcuccacgucgaaaugcucacccucgucuuccucguccuauggaugugcguauucucc

SEQ ID NO: 1910 - RNA, 60 nt, Artificial Sequence
  Q15116_1-20
augcagauaccgcaggcgccguggccgguggugugggcgguauugcaguuaggguggagg

SEQ ID NO: 1911 - RNA, 60 nt, Artificial Sequence
  P05556_1-20
augaaccuccaacccaucuucuggaucggccucaucuccuccguuugcugcgucuuugcc

SEQ ID NO: 1912 - RNA, 60 nt, Artificial Sequence
  Q12891_1-20
augagggcagggccagggccaacgguaacgcuagcgcuagugcuagcgguagcgugggcg

SEQ ID NO: 1913 - RNA, 60 nt, Artificial Sequence
  Q8IV16_1-20
augaaggcguugggggcgguguuguuggcguuguuguugugugggaggccggggaggggg

SEQ ID NO: 1914 - RNA, 60 nt, Artificial Sequence
  Q03167_1-20
augaccucacacuacgucaucgccaucuucgcccucauguccucaugccuagccacagcc

SEQ ID NO: 1915 - RNA, 60 nt, Artificial Sequence
  Q14246_1-20
augaggggguuuaauuuguuguuguuuuggggguguugugugaugcauaguugggagggg

SEQ ID NO: 1916 - RNA, 60 nt, Artificial Sequence
  P16871_1-20
augaccauacucggcaccaccuucggcauggucuucucccuccuccaagucgucucagga

SEQ ID NO: 1917 - RNA, 60 nt, Artificial Sequence
  P61769_1-20
augagcaggagcguggccuuggcagugcucgcgcucuugagcuugagcgggcucgaggcc

SEQ ID NO: 1918 - RNA, 60 nt, Artificial Sequence
  Q9Y6W8_1-20
augaaaucaggccuaugguacuucuuccucuucugccuccgcaucaaaguccucaccggu

SEQ ID NO: 1919 - RNA, 63 nt, Artificial Sequence
  P10966_1-21
augcgcccacgccuauggcuacuccuagccgcacaacuaaccguacuccacggcaacuccgua

SEQ ID NO: 1920 - RNA, 63 nt, Artificial Sequence
  Q9BZW8_1-21
augcucggccaagucgucacccucauacuccuccuccuccucaaagucuaccaaggcaaaggc

SEQ ID NO: 1921 - RNA, 63 nt, Artificial Sequence
  P02778_1-21
augaaccaaaccgcaauccucaucugcugccucaucuuccuaacccucucaggcauacaaggc

SEQ ID NO: 1922 - RNA, 63 nt, Artificial Sequence
  P18564_1-21
augggcauagaacuccucugccucuucuuccuauuccuaggccgcaacgaccacguccaaggc

SEQ ID NO: 1923 - RNA, 63 nt, Artificial Sequence
  O14525_1-21
auggccuuggccgggcucugugccuugcuagcgugcuguugggggccagcggcagugcuagcg

SEQ ID NO: 1924 - RNA, 63 nt, Artificial Sequence
  P01130_1-21
auggggccguggggguggaaguugagguggacgguggcguuguuguuggcggcggcagggacg

SEQ ID NO: 1925 - RNA, 63 nt, Artificial Sequence
  P01732_1-21
auggccuuacccgucaccgcacuccuacucccccucgcacuccuccuccaugccgcccguccc

SEQ ID NO: 1926 - RNA, 63 nt, Artificial Sequence
  P48061_1-21
augaacgccaaagucgucgucguccucguccucguccucaccgcccuaugccuauccgacggc

SEQ ID NO: 1927 - RNA, 63 nt, Artificial Sequence
  P01589_1-21
auggacucguacuugcucaugugggggcuccugaccuuuaucauggucccgggcugucaagcg

SEQ ID NO: 1928 - RNA, 63 nt, Artificial Sequence
  Q86T13_1-21
augaggccggcguuugcguuguguuuguuguggcaggcguuguggccggggccgggggggggg

SEQ ID NO: 1929 - RNA, 63 nt, Artificial Sequence
  Q5DID0_1-21
augcucagaaccuccggccucgcccuacucgcccucgucucagccgucggccccucccaagcc

SEQ ID NO: 1930 - RNA, 66 nt, Artificial Sequence
  P40189_1-22
augcucacccuccaaaccuggcucguccaagcccuauucaucuuccucaccaccgaauccacaggc

SEQ ID NO: 1931 - RNA, 66 nt, Artificial Sequence
  Q86YL7_1-22
auguggaaagugagcgcgcucuuguucgugcucgggagcgcgagcuugugggugcucgcggaaggg

SEQ ID NO: 1932 - RNA, 66 nt, Artificial Sequence
  P55075_1-22
augggcucuccccgcucugcccucucuugccuccuucuccaucuccucguccucugccuccaagcu

SEQ ID NO: 1933 - RNA, 66 nt, Artificial Sequence
  Q30201_1-22
augggcccccgcgcccgcccagcccuacuccuacucaugcuccuacaaacagccguccuccaaggc

SEQ ID NO: 1934 - RNA, 66 nt, Artificial Sequence
  P07766_1-22
augcaaucgggaacgcacuggcgcgugcucgggcuaugucucuugagcgugggcgugugggggcaa

SEQ ID NO: 1935 - RNA, 66 nt, Artificial Sequence
  P18827_1-22
augagacgcgccgcccucuggcucuggcucugcgcacuagcccucucccuccaacccgcccuaccc

SEQ ID NO: 1936 - RNA, 66 nt, Artificial Sequence
  P55290_1-22
augcaaccccgcaccccacucguccucugcguccuucucucccaaguccuccucuuaaccuccgcu

SEQ ID NO: 1937 - RNA, 66 nt, Artificial Sequence
  P37173_1-22
auggggcgcgggcucuugcgcgggcucuggcccuugcacauagucuuguggacgagaauagccucg

SEQ ID NO: 1938 - RNA, 66 nt, Artificial Sequence
  Q07325_1-22
augaagaaaucgggcgugcucuuucucuugggcauaaucuugcucgugcucauaggcgugcaaggg

SEQ ID NO: 1939 - RNA, 66 nt, Artificial Sequence
  P04156_1-22
auggcgaacuugggcuguuggaugcuagugcucuuugucgcgaccuggagcgaucucgggcucugu

SEQ ID NO: 1940 - RNA, 66 nt, Artificial Sequence
  P31785_1-22
augcucaaacccucccuccccuucaccucccuacucuuccuccaacucccccuucucggcgucggc

SEQ ID NO: 1941 - RNA, 69 nt, Artificial Sequence
  P01579_1-23
augaaauacaccuccuacauccucgccuuccaacucugcaucguccuaggcucacucggcugcuacugc

SEQ ID NO: 1942 - RNA, 69 nt, Artificial Sequence
  P23229_1-23
auggccgccgccggccaacucugccuccuauaucucuccgccggccuccucucccgacuaggcgcagcc

SEQ ID NO: 1943 - RNA, 69 nt, Artificial Sequence
  O60494_1-23
augaugaacaugucccucccauuccucuggucccuccuaacccuccucaucuucgccgaagucaacggc

SEQ ID NO: 1944 - RNA, 69 nt, Artificial Sequence
  P08575_1-23
auguacuugugguugaaauugcucgcguucggguucgcguucuuggacacggaaguguucgugaccggg

SEQ ID NO: 1945 - RNA, 69 nt, Artificial Sequence
  Q8IWY4_1-23
augggggcggcggcggugagguggcauuuguguguguuguuggcguuggggacgagggggagguuggcg

SEQ ID NO: 1946 - RNA, 69 nt, Artificial Sequence
  Q08431_1-23
augccacgaccccgccuacuagccgcccucugcggcgcccuccuaugcgcccccucacuccuagucgcc

SEQ ID NO: 1947 - RNA, 69 nt, Artificial Sequence
  Q99665_1-23
auggcccacacuuuucgcggaugcucacucgccuucauguucaucaucaccuggcuacucaucaaagcc

SEQ ID NO: 1948 - RNA, 69 nt, Artificial Sequence
  Q6Q8B3_1-23
auguccgccccccgccuacucauauccauaaucauaauggucuccgccucuucaucuuccugcaugggc

SEQ ID NO: 1949 - RNA, 69 nt, Artificial Sequence
  Q07011_1-23
augggcaauagcuguuacaauaucguggccacgcucuugcucgugcucaauuucgagcgcacgcgcucg

SEQ ID NO: 1950 - RNA, 69 nt, Artificial Sequence
  Q8NHL6_1-23
augaccccgaucuugaccgugcucauaugcuugggcuugagcuugggcccgcgcacgcacgugcaagcg

SEQ ID NO: 1951 - RNA, 69 nt, Artificial Sequence
  P36894_1-23
augccccaacucuacaucuacaucagacuccucggcgccuaccucuucaucauaucccgaguacaaggc

SEQ ID NO: 1952 - RNA, 69 nt, Artificial Sequence
  Q16552_1-23
augacccccggcaaaaccucccucgucucccuacuccuccuccuaucccucgaagccaucgucaaagcc

SEQ ID NO: 1953 - RNA, 69 nt, Artificial Sequence
  P42081_1-23
auggacccccaaugcaccaugggccucuccaauauccuauucgucauggccuuccuccucuccggcgcc

SEQ ID NO: 1954 - RNA, 69 nt, Artificial Sequence
  P43121_1-23
augggcuugcccaggcuugugugcgcguucuugcucgcggccuguugcuguugcccgcguguggccggg

SEQ ID NO: 1955 - RNA, 69 nt, Artificial Sequence
  O00206_1-23
augauguccgccucccgacucgccggcacacuaauaccagccauggccuuccucuccugcguccgcccc

SEQ ID NO: 1956 - RNA, 69 nt, Artificial Sequence
  P42701_1-23
auggaaccccuagucaccugggucgucccacuccucuuccucuuccuccucucaagacaaggcgccgcc

SEQ ID NO: 1957 - RNA, 72 nt, Artificial Sequence
  P06729_1-24
auguccuuucccugcaaauucgucgccuccuuccuccuuauuuucaacguuuccuccaaaggcgccgucucc

SEQ ID NO: 1958 - RNA, 72 nt, Artificial Sequence
  P15328_1-24
auggcccaacgcaugaccacacaacuacuccuacuccucgucugggucgccgucgucggcgaagcccaaacc

SEQ ID NO: 1959 - RNA, 72 nt, Artificial Sequence
  P05112_1-24
augggacucaccucccaacuccuccccccccucuucuuccuccuugccugcgccggcaauuucguacacggc

SEQ ID NO: 1960 - RNA, 72 nt, Artificial Sequence
  P06127_1-24
augcccaugggcucacuccaaccccucgccacacucuaccuccuaggcaugcucgucgccuccugccucggc

SEQ ID NO: 1961 - RNA, 72 nt, Artificial Sequence
  P32248_1-24
auggaccucggcaaacccaugaaauccguccuagucgucgcccuacucgucaucuuccaagucugccucugc

SEQ ID NO: 1962 - RNA, 72 nt, Artificial Sequence
  Q7Z7D3_1-24
auggccucccucggccaaauccuauucugguccaucaucucaaucauaaucauacucgccggcgccaucgcc

SEQ ID NO: 1963 - RNA, 72 nt, Artificial Sequence
  P54756_1-24
augagggggagugggccgaggggggcggggaggaggaggccgccgaguggggggggggauacgccgauaacg

SEQ ID NO: 1964 - RNA, 72 nt, Artificial Sequence
  Q92823_1-24
augcaacucaaaaucaugcccaaaaaaaaacgccucucagccggccgcgucccccucauccucuuccuaugc

SEQ ID NO: 1965 - RNA, 72 nt, Artificial Sequence
  P19320_1-24
augccgggcaagaugguggucauacucggggccucgaacauacucuggaucauguucgcggccucgcaagcg

SEQ ID NO: 1966 - RNA, 72 nt, Artificial Sequence
  Q86UN2_1-24
auguugagaaagggcuguugcguggaauugcucuugcucuuggucgcggccgagcucccgcucgggggcggg

SEQ ID NO: 1967 - RNA, 75 nt, Artificial Sequence
  P33151_1-25
augcaaaggcucaugauguugcucgcgaccucgggcgcgugcuugggcuugcucgcggucgcggccguggccgcg

SEQ ID NO: 1968 - RNA, 75 nt, Artificial Sequence
  P17813_1-25
auggaccgaggcacacucccacucgccgucgcacuccuacucgccuccugcucccucucccccacuucacucgcc

SEQ ID NO: 1969 - RNA, 75 nt, Artificial Sequence
  P25445_1-25
augcucggcaucuggacccuacucccccuaguccucaccuccgucgcccgccucucaucaaaauccguaaacgca

SEQ ID NO: 1970 - RNA, 75 nt, Artificial Sequence
  P01730_1-25
augaaccgaggcguccccuuccgccaccuccuacucguccuccaacucgcccuccuacccgccgccacacaaggc

SEQ ID NO: 1971 - RNA, 75 nt, Artificial Sequence
  Q685J3_1-25
augccccgacccggcaccauggcccucugccuccucacacucguccucucacuccuacccccacaagccgccgcc

SEQ ID NO: 1972 - RNA, 75 nt, Artificial Sequence
  P17787_1-25
auggcgaggaggugugggccgguggcguuguuguugggguuuggguuguugagguuguguagugggguguggggg

SEQ ID NO: 1973 - RNA, 75 nt, Artificial Sequence
  Q6UQ28_1-25
auggccgucuuccacgacaugcuacuccaaccccucggcauguuccucugccucucccuacaacucucuuccgcc

SEQ ID NO: 1974 - RNA, 75 nt, Artificial Sequence
  P13987_1-25
augggcauacaagggggcucggucuuguucgggcucuugcucgugcucgcggucuuuugccauagcgggcacucg

SEQ ID NO: 1975 - RNA, 75 nt, Artificial Sequence
  P10721_1-25
augaggggggcgaggggggcgugggauuuuuuguguguguuguuguuguuguugagggugcagacggggaguagu

SEQ ID NO: 1976 - RNA, 75 nt, Artificial Sequence
  P12319_1-25
auggccccagccauggaaucacccacccuccucugcguagcccuccucuucuucgcccccgacggcguacucgcc

SEQ ID NO: 1977 - RNA, 78 nt, Artificial Sequence
  Q9BZR6_1-26
augaagagggcgagugcgggggggaguagguuguuggcguggguguugugguugcaggcguggcagguggcggcgccg

SEQ ID NO: 1978 - RNA, 78 nt, Artificial Sequence
  P25063_1-26
augggccgagccauggucgcccgccucggccucggccuccuccuccucgcccuacuacucccaacccaaaucuauucc

SEQ ID NO: 1979 - RNA, 78 nt, Artificial Sequence
  Q9NR97_1-26
auggaaaacauguuccuacaauccuccaugcuaaccugcauauuccuccucaucuccggcuccugcgaacucugcgcc

SEQ ID NO: 1980 - RNA, 78 nt, Artificial Sequence
  Q8N131_1-26
augggguugggggcgaggggggcgugggcggcguuguuguuggggacguugcagguguuggcguuguugggggcggcg

SEQ ID NO: 1981 - RNA, 78 nt, Artificial Sequence
  P49771_1-26
augaccguccucgcucccgccuggucccccacuacuuaucuccuucuccuucuccuccucuccuccggccucuccggc

SEQ ID NO: 1982 - RNA, 78 nt, Artificial Sequence
  P02679_1-26
auguccuggucccuucacccccguaaccucauucucuacuucuaugcccuccuuuuccucuccucuacuugcgucgcc

SEQ ID NO: 1983 - RNA, 78 nt, Artificial Sequence
  P14784_1-26
auggccgccccugcccucuccuggcgccucccccuucucauucuccuucuuccucucgccaccuccugggcuucugcc

SEQ ID NO: 1984 - RNA, 81 nt, Artificial Sequence
  P05362_1-27
auggccccauccucccccagacccgcccucccagcccuacucguccuacucggcgcacucuuccccggccccggcaacgca

SEQ ID NO: 1985 - RNA, 81 nt, Artificial Sequence
  Q13740_1-27
auggaaucaaaaggcgccucauccugccgccuccuauucugccuacucauauccgccaccgucuuccgacccggccucggc

SEQ ID NO: 1986 - RNA, 84 nt, Artificial Sequence
  Q13443_1-28
auggggaguggggcgagguuuccgagugggacguugagggugaggugguuguuguuguugggguugguggggccgguguugggg

SEQ ID NO: 1987 - RNA, 84 nt, Artificial Sequence
  P14151_1-28
augauauucccguggaagugccagagcacgcaaagggacuuauggaauaucuucaaacuguggggauggacgaugcugugcugc

SEQ ID NO: 1988 - RNA, 84 nt, Artificial Sequence
  P56199_1-28
auggccccgcgcccgcgcgcacgcccgggcguagcuguggccuguugcuggcucuugaccguagucuugcgcuguugcguaagc

SEQ ID NO: 1989 - RNA, 84 nt, Artificial Sequence
  P11279_1-28
auggccgcacccggcucagcccgccgcccacuccuacuacuacuccuccuccuccuccucggccucaugcacugcgccucagcc

SEQ ID NO: 1990 - RNA, 84 nt, Artificial Sequence
  P40259_1-28
auggcccgccuagcccuaucccccgucccaucccacuggauggucgcccuccuacuccuacucuccgccgaaccaguccccgca

SEQ ID NO: 1991 - RNA, 84 nt, Artificial Sequence
  P43681_1-28
auggaacucggcggccccggcgcaccccgccuacuacccccacuccuccuccuccucggcaccggccuccuacgcgccucaucc

SEQ ID NO: 1992 - RNA, 84 nt, Artificial Sequence
  P18627_1-28
augugggaagcccaauuccucggccuccucuuccuccaaccccucugggucgcccccgucaaaccccuccaacccggcgccgaa

SEQ ID NO: 1993 - RNA, 84 nt, Artificial Sequence
  Q5ZPR3_1-28
auguugagaaggcgcgggagcccgggaaugggcgugcacgugggagcggcauugggcgcgcucugguucugucuaacgggcgcg

SEQ ID NO: 1994 - RNA, 84 nt, Artificial Sequence
  P23415_1-28
auguacucauucaacacacuacgccucuaccucugggaaaccauagucuucuucucacucgccgccuccaaagaagccgaagcc

SEQ ID NO: 1995 - RNA, 84 nt, Artificial Sequence
  Q8TD46_1-28
augcucugccccuggcguacugccaaucucggccuccuccucauccucacuauuuuccucguugccgccucuuccuccuuaugc

SEQ ID NO: 1996 - RNA, 87 nt, Artificial Sequence
  P17301_1-29
auggggccagagcgcacgggcgcggccccgcucccgcucuugcuagugcucgcgcuaucgcaagggaucuugaacuguugcuuggcc

SEQ ID NO: 1997 - RNA, 87 nt, Artificial Sequence
  P12821_1-29
augggagccgccuccggccgccgcggccccggccuccuacuaccccucccccuccuacuccuccuaccaccccaacccgcacucgcc

SEQ ID NO: 1998 - RNA, 87 nt, Artificial Sequence
  Q14118_1-29
augcgcaugagcgugggcuugagcuugcucuugcccuugugggggcgcacguucuugcucuugcucucggucgugauggcgcaaucg

SEQ ID NO: 1999 - RNA, 87 nt, Artificial Sequence
  P05231_1-29
augaacucuuucuccacauccgccuucggccccgucgccuucucccucggccuacuucuaguccuacccgccgccuucccugccccc

SEQ ID NO: 2000 - RNA, 87 nt, Artificial Sequence
  O00602_1-29
auggaacucuccggcgccaccauggcccgcggccucgccguccuccucguccucuuccuccacaucaaaaaccuacccgcccaagca

SEQ ID NO: 2001 - RNA, 87 nt, Artificial Sequence
  Q9Y6Q6_1-29
auggccccacgagcccgccgccgccgaccccuauucgcccuccuacuccuaugcgcccuccuagcccgacuccaagucgcccuccaa

SEQ ID NO: 2002 - RNA, 87 nt, Artificial Sequence
  Q9ULI3_1-29
auggcuucuccccgcgccucccgcuggcccccuccccuucuucuccuccuccuccccuuacuccuccucccucccgccgcccccggc

SEQ ID NO: 2003 - RNA, 90 nt, Artificial Sequence
  Q8NBP7_1-30
augggcaccgucuccucacgccgauccugguggccacucccacuccuacuccuacuccuccuccuacucggacccgccggcgcccgcgcc

SEQ ID NO: 2004 - RNA, 90 nt, Artificial Sequence
  P02675_1-30
augaaacgaaugguauccugguccuuccacaaacucaaaaccaugaaacaccuccuccuccuacuccucugcguauuccuagucaaaucc

SEQ ID NO: 2005 - RNA, 90 nt, Artificial Sequence
  P06756_1-30
auggccuucccaccccgccgccgccuacgucuaggcccccgcggacucccacuccuacucuccggccuacuccucccccucugcagagcc

SEQ ID NO: 2006 - RNA, 93 nt, Artificial Sequence
  O60609_1-31
augguccgcccccucaauccccgcccccuucccccugucguccuuaugcuccuucuucuucucccucccucuccccuuccccucgccgccggc

SEQ ID NO: 2007 - RNA, 93 nt, Artificial Sequence
  P50895_1-31
auggaacccccagacgcccccgcccaagcccgcggcgcaccccgccuacuccuacuagccguacuacucgccgcccaccccgacgcccaagcc

SEQ ID NO: 2008 - RNA, 93 nt, Artificial Sequence
  P28906_1-31
augcuagugcgcaggggcgcgcgcgcgggaccgcgcaugccaaggggcuggaccgcgcucugucucuugagcuugcucccgagcggguucaug

SEQ ID NO: 2009 - RNA, 93 nt, Artificial Sequence
  P08514_1-31
auggccagagcccuaugcccacuccaagcccuauggcuacucgaauggguacuccuacuccuaggcccaugcgcagccccacccgccugggcc

SEQ ID NO: 2010 - RNA, 93 nt, Artificial Sequence
  P00742_1-31
augggccgaccccuccaccucguccuccucuccgccucacucgccggccuccuacuccucggcgaaucacuauucauccgccgcgaacaagcc

SEQ ID NO: 2011 - RNA, 96 nt, Artificial Sequence
  P26006_1-32
auggggccagggcccucgagagcgccaagggccccgagauugauguugugcgcgcucgcgcuaauggucgcggccgggggcuguguagugagcgcg

SEQ ID NO: 2012 - RNA, 96 nt, Artificial Sequence
  P13726_1-32
auggaaacgcccgcguggccgcgagugcccaggcccgagaccgcggucgcgcgcacgcuauuacucggguggguauucgcgcaaguggccggggcc

SEQ ID NO: 2013 - RNA, 96 nt, Artificial Sequence
  P11912_1-32
augcccggcggcccaggcguccuccaagcccuccccgccaccaucuuccuccucuuccuccuauccgccgucuaccuaggacccggcugccaagcc

SEQ ID NO: 2014 - RNA, 96 nt, Artificial Sequence
  Q9H6X2_1-32
auggcgacagcggaaaggcgagcgcucgggaucggguuccagugguugagcuuggccacgcuagugcuaauaugcgcgggccagggagggcgcagg

SEQ ID NO: 2015 - RNA, 99 nt, Artificial Sequence
  Q8IWK6_1-33
auggaaccgcccgggcgcaggcgcgggcgcgcgcaaccgccauugcuauugcccuugagcuugcucgcgcucuuggccuugcucgggggcgggggcggg

SEQ ID NO: 2016 - RNA, 99 nt, Artificial Sequence
  P58335_1-33
auggucgcggaaaggagcccggccaggagcccgggcucgugguuguucccgggcuugugguugcucgugcucucgggcccgggcgggcucuugcgcgcg

SEQ ID NO: 2017 - RNA, 102 nt, Artificial Sequence
  P06731_1-34
auggaaucacccucagcacccccccaccgauggugcauccccuggcaacgccuccuccucaccgccucccuccucacauucuggaacccacccaccaccgcc

SEQ ID NO: 2018 - RNA, 102 nt, Artificial Sequence
  P33681_1-34
augggccacacccgccgccaaggcacauccccauccaaaugccccuaccucaauuucuuccaacuccuaguccuagccggacucucacacuucugcucaggc

SEQ ID NO: 2019 - RNA, 105 nt, Artificial Sequence
  P38567_1-35
augggcguccucaaauucaaacacauauucuuccguucauuugucaaaucauccggcgucucacaaauagucuucaccuuccuccucauccccugcugccucaca

SEQ ID NO: 2020 - RNA, 105 nt, Artificial Sequence
  P16410_1-35
auggccugccucggcuuccaacgccacaaagcccaacuaaaccuagccacccguaccuggcccugcacacuccucuucuuccuccucuucauacccguauuuugc

SEQ ID NO: 2021 - RNA, 111 nt, Artificial Sequence
  P15814_1-37
augagaccgggaacaggacaaggcggacuagaagccccaggcgagcccgggccaaaccucagacaaagauggccacuacugcuacugggacuggcaguaguaacacacgga

SEQ ID NO: 2022 - RNA, 114 nt, Artificial Sequence
  Q92956_1-38
auggaaccccccggcgacuggggccccccacccuggcgcucaacccccaaaacagacguccuccgacucguacucuaccucacauuccuaggcgccccaugcuacgcacccgcc

SEQ ID NO: 2023 - RNA, 123 nt, Artificial Sequence
  Q86VB7_1-41
augucaaaacuccgcaugguccuacucgaagacuccggcuccgccgacuuccgccgacacuucgucaaccucucaccauucaccauaaccguaguacuccuccucuccgccugcuucgucacc

SEQ ID NO: 2024 - RNA, 123 nt, Artificial Sequence
  P08648_1-41
augggcucccgcacacccgaauccccacuccacgccguccaacuccgcuggggcccccgccgccgcccaccccuccucccccuccuacucuuacuccuacccccaccaccccgcgucggcggc

SEQ ID NO: 2025 - RNA, 123 nt, Artificial Sequence
  P16109_1-41
auggccaacugccaaaucgccauccucuaccaacgcuuccaacgcguagucuucggcaucucccaacuccuaugcuucuccgcccucauaucagaacucaccaaccaaaaagaagucgcagca

SEQ ID NO: 2026 - RNA, 132 nt, Artificial Sequence
  O75326_1-44
augaccccacccccaccaggccgagccgcccccuccgcccccagagcccgaguccccggcccacccgcccgccuaggccuaccccuccgccuacgccuacuccuacuccucugggcagccgccgccucagcc

SEQ ID NO: 2027 - RNA, 135 nt, Artificial Sequence
  Q8N2Q7_1-45
auggcccugcccagaugcacauggccaaacuacgucuggcgcgcagucauggccugccucguacacagaggccuaggcgcaccccugacccuaugcaugcucggaugccuacuccaggccggacacguacucuca

SEQ ID NO: 2028 - RNA, 138 nt, Artificial Sequence
  Q86UN3_1-46
augcucccaggccuccgccgccuccuacaagcccccgccuccgccugccuccucuuaaugcuccucgcacucccacucgcagcccccuccugccccaugcucugcacuugcuacucauccccacccacagucucaugc

SEQ ID NO: 2029 - RNA, 540 nt, Artificial Sequence
  A0A5B9
auggaccucaaaaacguauucccacccgaaguagccgucuucgaacccucagaagcagaaauaucccacacccaaaaagcaacccucgucugccuagccaccggauucuaccccgaccacgucgaacucuccuggugggucaacggcaaagaaguccacuccggcgucagcaccgacccccaaccccucaaagaacaaccagcacucaacgacucacgauacugccucuccucccgccuacgagucuccgccaccuucuggcaaaacccacgaaaccacuuccgcugccaaguacaauucuacggccucucagaaaacgacgaauggacccaagaccgagcaaaacccgucacccaaaucguauccgccgaagccuggggccgcgccgacugcggcuucaccagcgaaucauaccaacaaggaguccucuccgcaacaauccuauacgaaauccuccucggcaaagccacccuauacgccguacucgucuccgcccuaguccucauggccauggucaaacgcaaagacucccgagguuaa

SEQ ID NO: 2030 - RNA, 465 nt, Artificial Sequence
  B7Z8K6
augucacaaccccacaccaaacccucagucuucgucaugaaaaacggcaccaacguagccugccucgucaaagaauucuaccccaaagacauacgcaucaaccucgucucaucaaaaaaaaucaccgaauucgacccagccaucguaauaucccccuccgguaaauacaacgccgucaaacucggcaaauacgaagacuccaacuccgucaccugcuccguccaacacgacaacaaaaccguccacuccaccgacuucgaaguaaaaaccgacuccaccgaccaugucaaaccaaaagaaacagaaaacaccaaacaacccuccaaauccugccacaaaccaaaagccauaguccacaccgaaaaagucaacaugaugucacucaccguccucggccucagaaugcucuucgccaaaaccguagccgucaacuuccuacuaaccgccaaacucuucuuccuauaa

SEQ ID NO: 2031 - RNA, 645 nt, Artificial Sequence
  B9A064
augcgcccaaaaaccggccaagucggaugcgaaacacccgaagaacucggacccggcccccgccaacgauggccccuccuacuccucggccucgccauggucgcacacggacuacuccgccccaugguagcaccccaaucaggcgaccccgaccccggagccucagucggauccucccgcuccucccuccgaucacucuggggacgccuccuccuccaacccucaccccaacgagccgacccccgcugcuggccccgcggcuucuggucagaaccccaaucacucugcuacgucuucggcaccggcaccaaagucaccguccuaggccaacccaaagcuaaccccaccguaacccucuucccacccucauccgaagaacuacaagccaacaaagccacccucgucugccucaucucagauuucuaccccggcgcaguaaccgucgccuggaaagccgacggcucccccgucaaagccggcgucgaaacaacaaaaccauccaaacaauccaacaacaaauacgcagccucauccuaccucucccucacacccgaacaauggaaaucccaccgauccuacuccugccaagucacccacgaaggcuccaccgucgagaaaaccguagcccccaccgaaugcuccuga

SEQ ID NO: 2032 - RNA, 2520 nt, Artificial Sequence
  O00206
augaugucagcaucaagacucgccggcacccucauaccagccauggcguuccucuccugcguccgcccugagucuugggagccaugcgucgaaguaguccccaacaucaccuaccaaugcauggagcucaacuucuacaaaaucccagacaaucucccauuuuccaccaaaaaccucgaccucucuuucaauccccuccgccaccucgguucauacaguuucuucuccuuccccgaacuccaagugcuugaccucucccgaugcgaaauacaaacgaucgaggacggagcauaccaauccuuaucccaucucuccacccuuauccuuaccggcaacccaauucaaucgcucgcccucggcgccuucagcggucuguccucucuacaaaaacucgucgcaguagaaaccaaccuugcaagccucgagaacuuccccauugggcaucucaaaacucucaaagaauuaaacgucgcccacaaccuuauccaauccuucaagcuccccgaauacuucagcaaccucaccaaccucgaacaccuugaccuaucaagcaacaaaauccagagcauauacugcacagaccuaagaguccuccaccaaaugccacuccugaaccucagccuagaccuaucccuuaaccccaugaacuucauccaacccggagccuucaaagaaauacggcuacacaaauuaacacuucguaacaauuucgacagccucaacgucaugaaaaccuguauccaaggccuggccggguuggagguccaccgccucguacuaggcgaguuccgaaacgaaggcaaccucgaaaaauucgacaagucugcccucgaaggccugugcaaccucaccauagaagaguuccgccucgccuaccuagauuacuaccuagacgacauuauagaccuuuucaacugccuaaccaacgucucuucuuucucucucgucuccgucaccaucgaacgcgucaaagauuuuuccuacaauuucggauggcagcaccuugaacucgucaacugcaaauucggccaguuccccacacugaaacucaaaucccuuaaacgacuuacauucaccucaaacaaaggcggaaacgccuucuccgaagucgaccucccuucccucgaauuucucgaucucucgcgcaacggccuuagcuucaaaggcugcugcucccagagcgacuucggcacaaccucacucaaauaccuagaccuuagcuucaauggcgucauuaccaugucaucuaauuuccuagggcuagaacaauuagaacaccuugauuuccaacacucaaaccucaaacagauguccgaguucuccguauucuuaagccuacgcaaucucauuuaucucgacaucucccauacccacacccgcgucgccuucaacggcaucuucaacggccucuccucccuugaaguccuuaaaauggccggcaacuccuuccaagaaaacuuccucccagacaucuucacggaacuucgaaacuuaaccuuuuuagaccucucacaaugucagcuugaacagcucucuccaaccgccuucaacucucucuccagccugcaaguccucaauaugucacacaacaacuucuucucccuugauacuuuccccuacaagugccuaaauucacuucaaguccucgacuacucacucaaccacaucaugacgagcaagaaacaagaacuucaacacuucccguccucacuagcuuuccuaaaccuuacccaaaaugauuucgccuguaccugcgaacaccaaucuuuccuccaguggauaaaagaucagcgccaacuucuuguugaaguagaacgcauggaaugcgcuacccccagcgacaaacaaggcaugccaguccuuucgcuaaacauuaccugccaaaugaacaaaaccaucaucggggucuccguucugagcguccucgucgucuccgucgucgccgugcuggucuacaaauucuauuuucaccucaugcuccuggccggcugcaucaaguauggacgcggcgaaaacauuuaugacgcuuucgucaucuauuccucccaagacgaagacuggguacgcaacgagcuagucaaaaaccuagaagaaggaguuccuccuuuucaacuaugccuacacuaccgcgacuucaucccaggagucgccauagcugcaaacaucauccaugaaggcuuccacaaaucucgcaaggucauagucguagucucccaacacuucauccaauccagauggugcauauucgaauacgaaaucgcccaaaccuggcaauuccucucaucacgcgccgggaucaucuucaucguccuucaaaaagucgaaaagacacuacuacgucaacaggucgaacuauaccgucuccucucacgaaacaccuaccuugaaugggaagacuccguacucggucgccacauuuucuggcgccgccugcgaaaagcccuccucgacggcaaauccuggaaccccgaaggcaccgucggaaccggcugcaauuggcaggaagccaccuccauuuga

SEQ ID NO: 2033 - RNA, 1377 nt, Artificial Sequence
  P01730
augaaccgcggcguccccuuccgacaccuucuacuaguacuccaacucgcccuccuacccgccgcaacccaaggcaaaaaaguaguccuaggaaaaaaaggcgacaccgucgaacucacaugcacggcaucccaaaaaaagagcauccaauuccacuggaaaaacuccaaccaaaucaaaauccucggcaaccaaggcucuuuucucacaaaaggcccauccaaacuuaacgaccgcgccgacucccgccgcagccucugggaccagggcaacuucccccucaucaucaagaaccuaaaaaucgaggacuccgacaccuacaucugcgaaguagaagaccaaaaggaagaggugcaacuccucguauucggccucaccgcuaacuccgauacccaccuccuccaaggccagagccucacccuaacccuugaaucaccccccggguccucccccuccguacaaugccgcuccccccgcggcaaaaacauacaaggaggaaaaacccucuccguaucccaacucgaacuccaagacagcggcacguggacuugcacaguucuacaaaaccaaaaaaaagucgaguuuaaaauagacauaguaguccucgccuuccaaaaagccagcucaaucgucuauaaaaaagaaggcgaacaagucgaauucucuuucccccucgcauucacagucgaaaaacuuaccggcuccggcgaacucugguggcaagccgaacgcgccuccuccuccaaauccuggaucaccuucgaccucaaaaacaaagaagucagcgucaaacgcgucacccaagaccccaaauuacaaaugggcaaaaaacucccccuccaccuaacccucccacaagcccucccacaauacgcgggaagcgguaaccucacacucgcccucgaagccaaaacuggaaaacuccaccaagaagucaaccucgucgucaugcgcgccacccaacuccaaaaaaaccucaccugcgaagucuggggcccaaccucccccaagcucaugcucucccucaaacuggaaaacaaagaagcaaaaguaucaaagcgagaaaaagccguauggguccucaaccccgaagccggaauguggcaaugccuauuaucagacuccggccaaguccuccuagaaagcaacaucaaaguccuccccacaugguccaccccaguacagcccauggcucucaucguccucgguggagucgccggccuccugcuauucaucggccucggaaucuucuucugcguccgaugcagacaccgccgccgccaagccgaacgcaugucccaaaucaaaagacucuugagcgaaaaaaaaacaugccaaugcccacaccgcuuccaaaaaacaugcagccccaucuga

SEQ ID NO: 2034 - RNA, 537 nt, Artificial Sequence
  P01850
auggaagaccucaacaaagucuucccacccgaagucgccguauucgaacccuccgaagccgaaauaucacacacccaaaaagccacccucgucugccucgccaccggcuucuuccccgaccacguagaacucucauggugggucaacggcaaagaaguccacucaggcguauccacugacccccaaccccucaaagaacaacccgcacucaacgacucccgcuacugccuauccucacgacuacgcguaagcgcaacauucuggcaaaacccacgaaaccacuuccgcugccaaguccaauucuacggacucucagaaaacgacgaauggacccaagaccgcgccaaacccgucacccaaaucgucuccgccgaagccuggggccgcgccgacugcggcuucaccuccgucuccuaccaacaaggcguccuaucagccacaauccucuacgaaauccuacucggcaaagccacacucuacgcaguccuagucucagcccuaguccuaauggccauggucaaacgcaaagacuucuaa

SEQ ID NO: 2035 - RNA, 624 nt, Artificial Sequence
  P07766
augcagucagggacccacuggagaguccugggacugugccugcucucggucggggucuggggacaggacggaaacgaggaaaugggcggaaucacacaaacgccauacaaagucagcauaagcgggacaacggucauacucacgugcccgcaauaucccgggagcgaaaucuuauggcaacacaacgacaaaaacauaggcggggacgaagacgauaaaaauaucgggagcgacgaagaucaccugagccugaaagaguucucggaauuggaacagagcggguacuacgucugcuauccgcgcggaagcaagccagaggacgcgaacuucuaccuguaccuacgcgcgcgagugugcgaaaacuguauggagauggaugucaugagcguggccacaaucgugauaguagacauaugcauaaccgggggccugcuccugcucguguacuacuggaguaaaaaucgaaaggcaaaggccaagcccgugaccagaggcgcgggcgcgggagggcgccagcgagggcaaaauaaagaacgcccgccaccaguaccgaacccagacuaugaaccgaucagaaaaggacaaagggaccuauacucaggcuuaaaccagcgacggauauga

SEQ ID NO: 2036 - RNA, 3915 nt, Artificial Sequence
  P08575
auguaccuauggcuaaaacuccuggcuuucggauucgccuucuuggacaccgaagucuucguaaccggucaaucucccaccccgucgccaacgggacuaacgaccgcaaaaaugccuuccgucccacuaucauccgacccccuacccacgcacaccacggcauucucuccggccuccacauucgagcgagaaaacgacuuuucagaaacuaccaccagcuugucucccgacaacacauccacccaagucagccccgacucacuagacaacgcguccgccuucaacaccaccggagucuccuccguccaaacaccacaccuaccaacucacgcagacucccaaacgcccucggccggcaccgacacccagaccuucucaggaucggcagcaaacgccaagcuaaauccaacgcccggcuccaacgccauaagcgacguaccuggagagcggucaaccgccucuacguuccccacagaccccguauccccacucacgaccacccugucacucgcccaucauagcagugcagcccuuccagcucgaaccuccaacacaaccaucacggccaacaccucagacgcguaucuaaaugccagcgaaacgacaacgcucagccccucggggucagcuguuauaagcacgacaacaaucgccaccaccccauccaaacccacaugcgacgaaaaauacgcaaacaucacuguagacuaccucuacaacaaagaaaccaaacucuucaccgcaaaacucaacguaaacgaaaacguagaaugcggcaacaauaccugcacaaacaacgaaguccacaaccuaacagagugcaaaaacgccagcguauccaucagccacaacuccugcacagcccccgacaaaacacucauccuagacgucccucccggcguggaaaaauuccaacugcacgauugcacucaagucgaaaaagccgacaccaccaucugccucaaauggaagaauauagaaacuuucacaugcgacacgcaaaauaucaccuaccgcuuucagugcggaaacaugaucuuugacaacaaggaaauaaaacuagaaaaccuagagcccgaacacgaauauaaaugcgacuccgagauacucuacaacaaucacaaauucaccaacgccuccaagauaaucaagaccgauuucggaucgccgggagagccccaaaucaucuucugcagaagcgaagccgcccaccaaggagucauaaccuggaacccgccgcaacgcuccuuccacaacuucacccugugcuauaucaaagaaaccgagaaggacugucucaaucucgacaaaaaccucauuaaauaugaccuccaaaaccugaaacccuacacuaaauacgugcuuaguuuacacgcauacaucaucgccaaaguccaacgaaauggguccgcagcaaugugccacuucaccacaaagagcgccccacccucccagguauggaacaugacagucuccaugacgagcgacaacagcaugcacguaaagugccgcccaccccgagaccguaacgggccccacgagcguuaccacuuagaaguagaagcuggaaacacacugguucgaaacgagucccacaagaacugugacuuccgagucaaggaccuucaguacagcacagacuauaccuucaaagcauauuuucacaacggcgacuacccaggggaaccauucauucugcaucacucuaccagcuacaacucgaaagcgcugauagccuuucuagcauuccuaaucaucgucacaucaaucgcacucuuaguaguccuauacaaaaucuacgaccuucauaagaaacgaucauguaaccuggacgaacagcaggaguugguugaacgcgacgacgagaaacaacuaaugaacguagaacccauacacgccgacauacuacuagaaacauacaagcgcaaaauugccgacgaaggccggcucuuucuagccgaauuucaaucuauuccacgggucuucagcaaguuccccauuaaggaagccaggaaacccuuuaaccagaacaaaaacagauacgucgacauacugccuuacgauuauaaccgaguagaacuaagugagaucaauggcgacgccggguccaacuacaucaacgccucauacauagacggauucaaggaaccgcgcaaauacauagccgcacaaggcccuagagacgagacaguagacgacuucuggagaaugaucugggagcaaaaagcaacagucaucgucauggucacccgaugugaagagggaaaccgcaacaaaugcgccgaauauuggcccucaauggaagaaggcacacgagcauucggagacguagucguaaagauuaaccaacacaaacgcugcccagacuacauaauucaaaaauuaaacauuguaaacaaaaaggagaaagccacaggcagagaggucacacauauccaauucaccuccuggccagaccacggagucccugaagacccucaccuccugcucaaauuacgaaggcgagucaacgcauucuccaacuucuucagcggacccauugucguccauugcagugccggaguagggcgcaccggcaccuacauuggcaucgacgcgaugcuggaaggauuagaggcagaaaauaaaguggacgucuauggcuacguagugaaacugcgcaggcagagaugccuuaugguacaaguagaagcacaauacauacuaauccaccaagccuugguagaauacaaccaauucggcgaaacagagguaaaccucagcgaacuccauccuuaucuacacaacaugaagaaacgugacccacccuccgaacccuccccucuagaagccgaguuccagcgccugccauccuacagaucauggcggacgcaacacauaggaaaccaagaagaaaacaaguccaagaacaggaacuccaacgucaucccuuaugauuacaaccgagucccucucaaacacgaguuggaaaugucgaaggaauccgagcacgacuccgacgagagcuccgacgacgacucagauagcgaggaaccuuccaaguacaucaaugccuccuuuaucauguccuacuggaagccagaaguaaugaucgccgcccaaggaccgcucaaggaaacaaucggcgauuucuggcaaaugaucuuccagcgcaaagucaagguaaucgucaugcuaaccgaguuaaaacacggagaccaggaaaucugcgcacaauacuggggcgaaggcaaacaaacguauggggacauagagguagaccugaaagauacagacaaaucuuccaccuacacacucagaguauuugaacuacgccacucaaaacgcaaagacagcagaacgguuuaccaauaccaauacacaaacuggucagucgagcaacuacccgcagagccaaaggagcugauauccaugauacaaguggucaaacaaaaacucccacagaaaaacuccagcgaaggcaacaaacaccauaagucaacaccauugcucauucacugccgcgacggaagccaacaaaccggaaucuuuugcgcacucuuaaaccucuuagaauccgcggagacagaagaagucgucgacaucuuucaaguagucaaagcccuacgaaaggcccgcccagggauggucuccacauucgaacaauaccaauuucuuuacgacguaauagcuucuaccuaccccgcacaaaauggccaagucaagaagaacaaccaccaagaagacaagauugaguucgauaacgaaguggacaaagucaaacaagacgcaaacugcguuaauccgcucggcgcuccggaaaaacuuccagaagcuaaggaacaagcugaaggcuccgaacccaccagcggcaccgaaggacccgaacacucagucaacggcccagcaagccccgcgcuaaaccaaggcagcuaa

SEQ ID NO: 2037 - RNA, 765 nt, Artificial Sequence
  P08637
auguggcaacuccuccuccccaccgcccuccuccuccuagucucagccggaaugcgcacagaagaccucccaaaagccgucgucuuccucgaaccacaaugguaucgcguccucgaaaaagauuccguaacccuaaaaugccaaggcgcauacucaccagaagacaacucaacccaaugguuccacaacgaaucccuaaucuccucccaagccuccucuuacuucaucgacgccgccaccgucgacgacucaggcgaauaccgcugccaaaccaaccucuccacucucucugaccccguccaacucgaaguacacauaggcuggcuccuccuacaagcuccccgcugggucuucaaagaagaagacccaauccaccuccgcugccacuccuggaaaaacaccgcccuccacaaagucacauaccuccaaaacggaaaaggacgcaaauacuuccaucacaacuccgacuucuacauucccaaagccacccucaaagacucaggcuccuauuucugccgaggccucuucggauccaaaaacgucucaucagaaaccgucaacaucaccaucacccaaggccucgcaguauccaccauauccucauucuucccacccggcuaccaagucuccuuuugccucgucaugguccuacucuucgccgucgacaccggccucuacuucuccgucaaaaccaacauacgcucaucaacacgcgauuggaaagaccacaaauucaaauggcgcaaagacccccaagacaaauga

SEQ ID NO: 2038 - RNA, 663 nt, Artificial Sequence
  P10747
augcuacgacuacuucucgcacucaaccucuuccccucaauacaagucacaggcaacaaaauucuaguaaaacaaucccccaugcuagucgccuaugacaacgccguuaaccucuccugcaaauacucauacaaccucuucucacgcgaauuccgcgcaucccuccacaaaggacuagacuccgccgucgaagucugcgucgucuacggcaacuacucccaacaacuccaagucuacucaaaaaccggcuucaacugcgacggcaaacucggcaacgaauccguaaccuucuaccuccaaaaccuuuacgucaaccaaaccgacaucuacuucugcaaaaucgaaguaauguaccccccccccuaccucgacaacgaaaaauccaacggaacaauaauacacgucaaagguaaacaccucugccccuccccacucuuccccggacccuccaaacccuucuggguccucgucgucgucggcggaguccucgcaugcuacucacuucucguaacaguagccuucaucaucuucuggguucgcucuaaacgcucccgacuacuucacucagacuacaugaauaugaccccccgccgcccaggccccacacgcaaacacuaucaacccuacgcacccccccgcgacuucgccgccuaccgaucauga

SEQ ID NO: 2039 - RNA, 681 nt, Artificial Sequence
  P11912
augccagguggccccggcguacuccaagcccuacccgcaaccaucuuccuacuauuccuacuuuccgccgucuaccucggacccggcugccaagcccucuggaugcacaaaguccccgccucccuaauggucucacuaggagaagacgcccacuuccaaugcccucacaacuccuccaacaacgcuaacgucaccugguggcgcguccuucacggaaacuacacauggcccccagaauuccucggacccggcgaagaccccaacggcacccucaucauacaaaacguaaacaaaucccacggcggaauauacguaugccgcguacaagaaggcaacgaaagcuaccaacaauccugcggcacauaccuacgcguccgacaaccccccccacgcccauuccucgacaugggcgaaggcaccaaaaaccgcauaauaacagccgaaggcaucauccuacucuucugcgccgucguacccggcacccuccuccuauuccgaaaacgcuggcaaaacgaaaaacucggccucgacgccggcgacgaauacgaagacgaaaaccucuacgaaggccucaaccucgacgacugcuccauguacgaagacauaucccgcggacuccaaggcaccuaccaagacguaggcucccuuaauaucggcgacguacaacucgaaaaaccauga

SEQ ID NO: 2040 - RNA, 1671 nt, Artificial Sequence
  P15391
augccacccccacgccuacucuucuuccuauuauuccucacccccauggaagucagacccgaggaaccacucgucgucaaagucgaagaaggagacaacgcaguccuccaaugccucaaaggcacguccgacggccccacccaacaacuaaccuggucucgcgaaagcccccuaaaacccuuccucaaacuaucccugggacuccccggccuuggcauucacaugagaccccucgcgauauggcuguucaucuuuaauguaagccaacaaauggguggauucuaccugugccaaccuggcccgccaagcgaaaaagcauggcaacccggauggaccgucaacgucgaaggcuccggcgaacuauuccgcuggaacguaucagaccucgggggucuaggaugcggucugaaaaaccgcagcucagaaggacccuccucaccaucaggcaaacucaugucacccaaacucuacgucugggccaaagaccgucccgaaauaugggagggcgaaccacccugccucccucccagagacucccucaaccaaucccuaucacaagaccucaccauggcucccggcuccacccucuggcuaucuugcggcguacccccagacagcgucucacgcgguccacucucauggacccacguccacccaaaaggccccaaaucacuacucagccuugaacucaaagacgaccgacccgcacgagacaugugggucauggaaacaggauuacuccucccccgagcuaccgcacaagacgccggcaaauacuacugccaccgcgguaaccucaccaugagcuuccaccuagaaauaaccgcacgacccguccucuggcauuggcuccuccgcaccggcggcuggaaagucuccgcaguaacacuugcauaccucauauucugccuuugcucccuaguaggaauccuccaccuccaacgggcucucguacuccgacgcaagcgcaaacgaaugacagaccccacacgccgguucuucaaaguaacacccccacccggcucaggcccccaaaaccaguacggcaacguccucucccuaccaacacccaccuccggacucggcagagcacaacgcugggccgcuggccucggcggcacagcaccauccuacggcaaccccucauccgacguacaagccgacggcgcccucggcucccgaagcccaccaggcguaggucccgaggaagaagaaggagaaggcuacgaagaaccagacucagaagaagacagcgaguucuacgaaaacgacucuaaucucggccaagaccagcucucacaagacggaucaggcuacgaaaaccccgaagaugagccccuaggucccgaagacgaagacucauucagcaacgcagagagcuaugaaaaugaagacgaagaacuaacacaacccgucgcccgaacuauggacuuccucucaccacacggcuccgccugggauccaucacgcgaagccaccucacucgguagccaaucguacgaagacaugcggggaauccucuacgcagcaccacaacuccgauccauacgcgggcagccaggaccaaaccacgaagaagaugccgacucauacgaaaacauggacaaccccgacggaccugaccccgccuggggcggcggcggccgaaugggcaccuggucaacccgcuaa

SEQ ID NO: 2041 - RNA, 672 nt, Artificial Sequence
  P16410
auggccugccuaggcuuccaaaggcacaaagcccaacuaaaccucgccacacgcaccuggcccugcacccuacucuucuuccuccucuucaucccagucuucugcaaagcaaugcacguagcacaaccagccguaguccuagccuccucacgcggcaucgccuccuucgucugcgaauacgcaucacccggcaaagccacagaaguccgcgucaccguccuccgccaagccgacucacaagucacagaagucugcgccgccacuuacaugaugggcaacgaacucacauuccuagacgacucaaucugcacaggcaccuccuccggcaaccaagucaaccucacaauccaaggccuccgcgccauggacacaggccuauacaucugcaaaguagaacucauguaccccccacccuacuaccucggcaucggaaacggaacccaaaucuacgucauagaucccgaacccugcccagacucagacuuccuccucuggauacuagcagccgucucaucaggacucuucuucuacuccuuccuacucacagccgucucacucuccaaaaugcucaaaaaacgcucaccccucacaaccggcgucuacgucaaaaugcccccaaccgaaccagaaugcgaaaaacaauuucaacccuacuucauccccaucaacuga

SEQ ID NO: 2042 - RNA, 1419 nt, Artificial Sequence
  P16671
augggcugcgaccgcaacuguggacuaauagccggagccguaaucggcgccguccucgccguauucggaggcauccucaugcccgucggcgaccuacuuauccagaaaaccauaaagaaacaagucguccucgaagaaggcaccauagccuucaaaaacugggucaaaaccggaaccgaagucuaccgccaauucuggauauucgacguccaaaacccacaagaagucaugaugaacucgucaaacauccaaguuaaacaacgcggacccuacacauaccgcguacgcuuccuagccaaagaaaacguuacccaagacgcagaagacaacaccgucagcuuccugcaaccaaacggcgcaaucuucgaacccucccuuucugucggcacagaggccgacaacuucaccguacucaaccucgccguugccgccgcgucucacaucuaccaaaaccaauucguacaaaugauccuaaacagccucaucaacaaaucuaaaagcaguauguuccaagucagaacccuccgcgaacuccucuggggcuacagagaccccuuccugucacucguucccuaccccguaacaacuaccguggggcuguucuacccauacaacaacacggcagacggcguauacaaagucuucaauggcaaagacaacaucuccaaaguagcaauaauugacaccuacaaaggcaaacgcaaccuauccuacugggaaucacacugcgacaugaucaacggcacggacgccgcaucauucccacccuucgucgaaaaaucccaaguccuacaauucuucuccucggacauaugccgcuccauauacgccguauucgaguccgaugucaaccucaaaggcaucccaguauaccgcuucguccuccccucaaaagccuucgccucaccagucgaaaacccagacaacuacugcuucugcaccgagaaaaucauauccaaaaacugcaccucauacggcgugcuggacaucuccaaaugcaaggaaggucgcccagucuacaucucccucccccacuuccuauacgcaagcccagacguauccgaaccaaucgauggccucaacccaaacgaagaagaacaccgcaccuaccuagacauagaaccaaucaccggcuucacccuacaauucgccaaacgccugcaagucaaccuucuaguuaaacccucagagaaaauccaaguccucaaaaaccucaagcgcaauuacaucguuccaauccucuggcucaacgaaaccggcaccaucggcgacgaaaaagccaacauguuccgcucucaagucacagguaaaaucaaccuccuaggacugauagaaaugauccuacuaaguguaggaguaguaauguucgucgccuucaugauauccuacugcgcaugccgcagcaaaacaauaaaauga

SEQ ID NO: 2043 - RNA, 651 nt, Artificial Sequence
  P26718
augggcuggauccgaggccgcagaucccgccacucaugggaaauguccgaauuccacaacuacaaccucgaccucaaaaaaucagacuucuccacccgcuggcaaaaacaaagaugcccagucguaaaaucaaaaugccgcgaaaacgccuccccauucuucuucugcugcuucaucgcagucgcaaugggcauccgauucaucauaauggucgccaucugguccgccguauuccucaacucccucuucaaucaagaaguccaaaucccacucaccgaaucuuacugcggccccugccccaaaaacuggaucugcuauaaaaauaacugcuaccaauucuucgacgaauccaaaaacugguacgaaucccaagccuccugcaugagccaaaacgcaucccucuuaaaaguauacuccaaagaagaccaagaccuccuaaaacuagucaaauccuaccacuggaugggacuuguacacauccccaccaacggaucauggcaaugggaagacggcucaauacucuccccaaaccuacucaccaucaucgaaaugcaaaaaggcgacugcgcccuauacgccuccuccuucaaaggcuacaucgaaaacugcuccacaccaaacaccuacauaugcaugcaacgaaccgucuaa

SEQ ID NO: 2044 - RNA, 261 nt, Artificial Sequence
  P30273
augauacccgcagucgugcucuuacucuugcuccuggucgaacaagcggccgcgcucggagaaccgcaauugugcuacauccuggacgcgaucuuauucuuguacgggaucgugcucacgcucuuguacugccgcuugaaaauacaagugcgcaaggccgcgaucacgagcuaugaaaagagcgacggcguguacacgggccugagcacgcgcaaucaagagaccuaugaaacgcucaagcacgaaaaaccgccccaguag

SEQ ID NO: 2045 - RNA, 1137 nt, Artificial Sequence
  P32248
auggaucuaggcaaacccaugaaaucaguucuaguaguagcccuccucgucauauuccaagucugccuuugccaggaugaagucaccgacgacuacaucggagacaacaccaccgucgacuacacucucuucgaaucccuaugcuccaagaaagacguacgcaacuucaaagccugguuucucccaaucauguacuccaucaucugcuucgucggccuucuaggaaacggucucgucguccucaccuacaucuacuucaaacgccuaaaaacuaugaccgacaccuaccuccucaaccucgcagucgccgacauccucuuccuacucaccuuacccuuuugggcauacuccgccgccaaauccuggguauucggcguccacuucuguaaacucaucuucgccaucuacaaaaugucauuuuucuccgguaugcuccuacuccucugcaucucuaucgaccgcuacgucgcuaucguccaagcuguaucugcccaccgccaccgagcccgcguucuacuaaucucaaaacuauccugcgucggaaucuggauccucgccacgguccuaucaauccccgaacuccuauacucagaccuacaacggucaucauccgaacaagcaaugcgcugcucucucauaaccgaacacgucgaagccuucaucacuauacaagucgcccaaauggucaucgguuuccucgucccccuacuagccaugucauucugcuaucucgucaucauccgcacccuccuccaagcccgaaacuucgaacgaaacaaagcuaucaaagucauaaucgccgucguagucguguucaucgucuuccaacuacccuacaacggcgucguacucgcucaaaccgucgcuaacuucaacauuaccuccuccaccugugagcucucuaaacagcucaacauagccuacgauguaaccuacucccuagccuguguccgaugcugcguaaaccccuucuuauacgccuucaucggcgucaaauuccgcaacgaccuauucaaacucuuuaaggaccuaggcugccuuucccaagaacagcuacgucaaugguccuccugccgccacauccgacgcucaucaauguccgucgaagccgaaaccaccaccacauucucacccuga

SEQ ID NO: 2046 - RNA, 690 nt, Artificial Sequence
  P40259
auggcccgccuagcccugagccccgucccaagccacuggauggucgcccuccuccuccuacuauccgccgaaccaguaccagcggcccgaagcgaagaccgauaccgaaaccccaaaggcagcgcgugcucgcgcaucuggcaaagcccccgcuucaucgcacgaaaacgcggauucacagucaaaaugcacugcuacaugaacucagcaagcggaaacgucagcuggcucuggaaacaagaaauggacgaaaacccacaacaacucaaacucgaaaaaggccgcauggaagaaagccaaaacgaaagccucgcaacacucacaauccaaggcauaagauucgaagacaacggcauauacuucugccaacaaaaaugcaacaacaccucagaagucuaccaaggcugcggaaccgaacugcgcgucaugggauucuccacccuagcccaacucaagcaaagaaacacacuaaaagacggcaucauaaugauccaaacacuccuaaucauacuauucaucauaguccccaucuuccuccuccucgacaaagacgacucaaaagccggcauggaagaagaccacacauacgaaggccucgacaucgaccaaacagcaacauacgaagacauagucacacuccgaaccggcgaagucaaauggagcgucggcgaacaccccggccaggaauga

SEQ ID NO: 2047 - RNA, 990 nt, Artificial Sequence
  P42081
auggacccucaaugcaccaugggccucuccaacauccuauucgucauggccuuccuccucuccggcgccgccccccucaaaauccaagccuacuucaaugaaacagccgaccuaccuugccaauucgcaaacucccaaaaccaaucucucuccgaacuuguaguauucuggcaagaccaagaaaaccucguccuaaacgaagucuaccucggcaaagagaaauucgacuccguacacuccaaauacaugggcagaaccucauucgacuccgacuccuggacccuacgcuuacacaaccuccaaaucaaagacaagggccuuuaccaaugcaucauacaccacaaaaaaccuacaggaaugauccgcauccaucaaaugaacuccgaacucuccguccuagccaacuucucccaacccgaaauaguccccaucuccaacaucaccgaaaacguuuacauaaaccucaccugcuccuccauccacggcuaccccgaacccaaaaaaauguccguccuccuccgcacaaaaaacucuacaaucgaauacgacggcgucaugcaaaaaucccaagacaacgucaccgaacucuacgacgucagcauaucccuuagcgucuccuuccccgacgucaccuccaacaugaccauauucugcauccucgaaacagacaaaacccgacuccucuccagcccuuucuccaucgaacucgaagauccucaacccccccccgaccauaucccauggaucaccgcaguccuaccaaccgucaucaucugcguuaugguauucugccuaauucuauggaaauggaaaaaaaaaaaacgcccccgaaacuccuacaaauguggcaccaacaccauggaaagagaagaauccgaacaaaccaagaaacgagaaaaaauacacauccccgagcgauccgacgaagcccaacgcgucuucaaaagcuccaaaaccucuuccugcgacaaaucagacaccugcuucuga

SEQ ID NO: 2048 - RNA, 1011 nt, Artificial Sequence
  Q15762
auggacuacccaacccuccuccucgcccuacuucacguauaccgcgcauuaugcgaagaagucuuauggcacaccuccguccccuuugccgaaaacaugucacucgaaugcgucuauccuagcaugggaauacucacccaagucgaaugguucaaaaucggcacccaacaagacuccaucgcaauauucuccccaacacacggcaugguaauacgcaaacccuacgccgaacgagucuacuuccucaacucaaccauggccuccaacaauaugacccucuucuuccgaaacgccuccgaagacgacguaggcuacuacuccugcucccuauacacauacccccaaggcaccuggcaaaaaguaauccaagucguacaaucagauuccuucgaagccgccguccccucaaacucucacaucgucagcgaaccaggcaaaaacgucacccucacaugccaaccacaaaugaccuggcccguacaagccguccgaugggaaaagauccaaccucgccaaauagaccuacuaaccuacugcaaccuaguccacggccgcaacuucaccuccaaauuccccagacaaauugucuccaauugcucccacggacgcugguccgucaucguuaucccagaugucaccgucuccgacucaggacucuaccgaugcuaccuccaggcuuccgccggcgaaaacgaaaccuucgucaugcgccucaccguagccgaaggaaaaaccgacaaccaauacacccucuucgucgccggcggaacaguacuucuucugcuuuucgucaucucaaucaccaccauaaucguaaucuuccuaaaccgacgccgccgccgagaacgacgagaccucuucaccgaauccugggacacccaaaaagcccccaacaacuaccgauccccgaucuccacaucccaacccacaaaccaaucaauggacgacacccgagaagacaucuauguaaacuacccuaccuucucccgccgccccaaaacccgcgucuga

SEQ ID NO: 2049 - RNA, 13482 nt, Artificial Sequence; identical to SEQ ID NO: 1425
  Q685J3

SEQ ID NO: 2050 - RNA, 1215 nt, Artificial Sequence
  Q9NNX6
auguccgacagcaaagaaccacgcuuacaacaacucggccuccucgaagaagaacaacuccgcggccuaggcuucagacaaacacgcggcuacaaaucccuggcaggcugccucggacacggcccccuagugcuccaacuucucagcuucacacuacucgcagggcuucucguccaagucuccaaagucccauccucaauaucacaagaacagucccgacaagacgccaucuaccaaaaccucacccaacucaaagccgccgucggcgaacuaucggaaaaauccaaacuacaagaaaucuaccaagaacucacccaacucaaagccgccgucggagaacuucccgaaaaaucaaaacuacaagaaaucuaccaagaacuaacccgacuaaaagccgccgucggcgaacuacccgaaaaaucaaaacuacaagaaauauaccaagaacucacauggcugaaagccgcaguuggcgaacuccccgaaaaauccaaaaugcaggaaauauaccaagaacuaacccggcucaaagccgccguaggagaacuccccgaaaagagcaaacaacaagaaaucuaccaagaacuaacccgacucaaagcagccgucggcgaacuccccgaaaaauccaaacaacaagaaaucuaccaagaacuaacccgacucaaagccgccguaggagaacuccccgagaaaagcaagcaacaggaaauauaccaagaacucacucaacucaaagccgccgucgaacgccucugccaccccugcccaugggaauggaccuucuuccaaggcaacugcuacuucaugucaaacucccaacgcaacuggcacgacucaaucaccgcaugcaaagaagucggcgcacaacucgucguaaucaaauccgccgaagaacagaacuuccuccaacuccaauccagccgcucaaaccgcuucaccuggaugggccucuccgaccucaaccaagaaggcaccuggcaauggguugacggaagcccacuccucccauccuucaagcaauacuggaaccgaggcgaaccaaacaaugucggagaagaagacugcgcagaguucagcggcaacggauggaacgacgacaaaugcaaccuagccaaauucuggaucugcaagaaauccgccgcauccugcucccgcgacgaagaacaauuccuaucccccgcccccgccacacccaacccaccacccgccuga

SEQ ID NO: 2051 - RNA, 3126 nt, Artificial Sequence
  Q9NR97
auggaaaacauguuucuucaauccuccaugcucaccuguauauuccuccucaucucaggaucaugugaacucugcgcagaagaaaacuucucccgcuccuaccccugugacgagaagaaacagaacgacucugucaucgcagaaugcucgaaccgucgccuccaggagguaccccaaacggugggcaaguacguaaccgaacucgaucuuucagacaauuucaucacccacaucaccaaugaaucauuccaaggccuucaaaacuuaaccaaaaucaaccucaaccacaaccccaauguacaacaccaaaauggcaaccccggaauccaauccaacggacucaauauaaccgacggagcauuccuaaaccuaaagaaccuccgcgaauuacuucucgaggacaaccagcucccacaaaucccauccggacugcccgagucgcucaccgaacucucacucauacagaauaacaucuauaacaucaccaaggagggcauuucacgccucauaaaucucaaaaaccuguaccucgcauggaacuguuacuucaacaaagucugcgagaaaaccaacaucgaagacggagucuucgaaacccucaccaaccuagagcuccuaucccucuccuuuaacucccuaucacacguaccucccaaacuucccagcucccuccggaaacuguuccucuccaacacccagauaaaauacauaagcgaagaagacuucaaaggccucaucaaucuaacccuccucgaccucucugggaacuguccccguugcuucaacgcccccuuccccugcgucccgugcgacggcggcgcuucaaucaacaucgaccgcuuugccuuccagaaccugacucaacuccgauaccucaaccucucaagcaccuccuuacgcaaaauaaacgccgccugguuuaaaaacaugccccaccuaaaagucuuagaucucgaguucaacuaccucguuggagaaauagccucgggcgccuuucuuacaaugcuaccucgacucgaaauccucgaccuauccuuuaacuacauaaaaggaucguacccccagcacauaaacaucucccggaauuucucgaaacuccuuucgcuccgcgcacuucaccuaagaggguacgucuuccaagaacuacgugaagacgauuuccaaccccuaaugcagcuaccaaaccucucuacgaucaacuuaggaaucaacuucaucaaacagaucgacuucaaacuguuucaaaacuucuccaaccuggaaaucaucuaccucucugagaaccgaaucucaccacucguaaaagacacccgccaaucauacgcgaacucauccuccuuucaacgucacauacgaaagcgucguuccacggauuuugaguucgacccccacucuaauuucuaccacuucacacgaccgcuuauuaagccccagugcgcggcauacggaaaagcccuggaccucucacucaacuccaucuucuucaucggaccaaaucaauucgaaaacuugccagacauagccugccucaaccuauccgccaacuccaacgcgcagguauuaagcggcacagaguucucagccauuccucaugugaaauaccucgaccuaacgaacaaccgacuggacuucgacaacgccagugcccucacggaacucuccgacuuagaaguacuugacuuaucauacaacucacauuacuucaggauugccggaguaacccaccaccucgaguucauccaaaacuucaccaaccuuaagguccucaaccuuucacacaacaacaucuacacucuuacagacaaauacaaccucgaauccaaaucucucgucgaacucgucuucagcggcaacagauuagacauacuuuggaacgacgaugacaaccgguacaucucaauauucaaaggccucaaaaaccuaacccgccuagaucuauccuugaaccgacucaaacauauacccaacgaagccuuccuuaaccucccggccucccucaccgagcuccacauaaacgacaacaugcuaaaauucuucaacuggacccuauuacagcaauucccucgccuugaacuccuugaccugcgcggaaacaagcuccuuuuccucaccgacucccuauccgacuucaccucaucccugagaacucuacuacuaucccacaaucgaauaucccaccuucccucaggcuuccucuccgaagucucgucccuuaagcaccucgaucuaucuuccaaccuacucaaaacaauuaacaaaucggcacuagaaacgaaaacaaccaccaaacucuccaugcucgaacuccaugguaacccuuucgaauguacgugcgacaucggugacuucagacgcuggauggacgaacaucugaaugucaagauaccacgccuaguggacgucauaugugcuucgcccggcgaccaacgcggcaaauccaucgugucccuugagcucacaaccugcgucuccgaugucaccgccgucauucuauuuuucuucaccuucuucauuaccacgauggucaugcucgcagcccuagcccaccacuuauucuacugggacguaugguucaucuauaacgucugccucgcaaagguuaaaggcuaccguucccucucaaccucccagacauucuacgacgccuacaucucguacgacaccaaagacgccucagugaccgacuggguuaucaaugagcugcgcuaucaccuagaggaaucccgagauaagaacguacuucucugccucgaagaacgagacugggaccccggucucgccauaaucgacaaccuuaugcaaucuaucaaccaauccaagaaaaccgucuucgugcuaaccaagaaauacgccaaauccuggaacuuuaaaaccgcauucuaccucgcgcuccagcgacucauggacgagaauauggacgucauuauuuucaucuuacucgagcccguacuucagcacucccaauaccuucgccuacgccagcgcauaugcaaauccaguauccugcaauggccagacaacccaaaagcggaaggccuguuuuggcagaccuugcgcaacgucguccuuacugaaaacgacucacgcuacaacaacauguacgucgacuccauaaagcaauauuag

SEQ ID NO: 2052 - RNA, 66 nt, Artificial Sequence
  P16671_TM_1_8-29
ggguugauagcgggggcggugauaggggcgguguuggcgguguuuggggggauauugaugccggug

SEQ ID NO: 2053 - RNA, 81 nt, Artificial Sequence
  P32248_TM_1_60-86
uuccucccaauuauguacucaaucaucugcuucgucggccuccuagguaacggccucgucguccuuacauacaucuacuuc

SEQ ID NO: 2054 - RNA, 66 nt, Artificial Sequence
  P16671_TM_2_440-461
cucuugggcuugaucgagaugauacucuugagcgugggcguggucauguucguggccuuuaugaua

SEQ ID NO: 2055 - RNA, 63 nt, Artificial Sequence
  P32248_TM_2_96-116
uaccuccuuaaccucgccgucgccgacauccucuuccuucucacucuccccuucugggccuau

SEQ ID NO: 2056 - RNA, 66 nt, Artificial Sequence
  P32248_TM_3_131-152
cucauauucgccaucuacaaaauguccuucuucuccggcaugcuccuacuccucugcauauccaua

SEQ ID NO: 2057 - RNA, 63 nt, Artificial Sequence
  P32248_TM_4_171-191
gucuugcucauaagcaagcucucaugcgugggcauauggauacucgcgaccgugcucucgauc

SEQ ID NO: 2058 - RNA, 84 nt, Artificial Sequence
  P32248_TM_5_220-247
uucauaacuauccaagucgcccaaaugguaaucggcuuccucgucccccuccuagccauguccuucugcuaccucgucaucaua

SEQ ID NO: 2059 - RNA, 78 nt, Artificial Sequence
  P32248_TM_6_264-289
gucauaaucgccguagucgucgucuucauagucuuccaacuccccuacaacggcgucguacucgcccaaaccgucgcc

SEQ ID NO: 2060 - RNA, 54 nt, Artificial Sequence
  P32248_TM_7_314-331
cucgcaugcgugcguuguugcgugaacccguucuuguacgcauucauaggcgug

SEQ ID NO: 2061 - RNA, 69 nt, Artificial Sequence
  A0A5B9_TM_145-167
accauacucuacgaaauccuccuaggcaaagccacccucuacgccguccuagucucagcccucguccuc

SEQ ID NO: 2062 - RNA, 69 nt, Artificial Sequence
  B7Z8K6_TM_130-152
cucggccuacgcaugcuauucgcuaaaaccguagccguaaacuuucuccucaccgccaaacucuucuuc

SEQ ID NO: 2063 - RNA, 63 nt, Artificial Sequence
  O00206_TM_632-652
accaucaucggcgucuccguccucuccguccuagucgucuccguaguugccguccuagucuac

SEQ ID NO: 2064 - RNA, 66 nt, Artificial Sequence
  P01730_TM_397-418
auggcccucaucguacucggcggcgucgccggacuacuacucuucaucggccucggcauauucuuc

SEQ ID NO: 2065 - RNA, 63 nt, Artificial Sequence
  P01850_TM_151-171
auacucuugggcaaggccacgcucuaugccgugcucgugagcgcgcucgugcucauggccaug

SEQ ID NO: 2066 - RNA, 78 nt, Artificial Sequence
  P07766_TM_127-152
gucauguccgucgccaccaucgucaucgucgacauaugcaucaccggcggccuacuucuacucguauacuacugguca

SEQ ID NO: 2067 - RNA, 66 nt, Artificial Sequence
  P08575_TM_576-597
gcccucaucgccuuccucgccuuccucauuaucguuaccucuaucgcucuacucgucguccucuau

SEQ ID NO: 2068 - RNA, 63 nt, Artificial Sequence
  P08637_TM_209-229
gucuccuucugccucgucaugguccuacucuucgccgucgacaccggccuauacuucucuguc

SEQ ID NO: 2069 - RNA, 81 nt, Artificial Sequence
  P10747_TM_153-179
uucugggucuuagucgucgucggcggcguccucgccugcuauucccuccucgucacugucgccuuuauuaucuucuggguc

SEQ ID NO: 2070 - RNA, 66 nt, Artificial Sequence
  P11912_TM_144-165
auaaucaccgccgaaggcaucauucuacucuucugcgccgucguccccggcacccuacuccuauuc

SEQ ID NO: 2071 - RNA, 66 nt, Artificial Sequence
  P15391_TM_292-313
gugagcgcggucacgcucgcguacuugaucuuuugcuugugcucgcucgugggcauacuccaucuc

SEQ ID NO: 2072 - RNA, 63 nt, Artificial Sequence
  P16410_TM_162-182
uuccuucucuggauccucgccgccgucuccuccggucucuucuucuacucuuuccuccuuacu

SEQ ID NO: 2073 - RNA, 63 nt, Artificial Sequence
  P26718_TM_52-72
cccuuuuucuuuugcugcuuuaucgccguagccaugggaauacguuucauuaucauggucgcu

SEQ ID NO: 2074 - RNA, 63 nt, Artificial Sequence
  P30273_TM_24-44
cucugcuacauccucgacgccauccuauuucucuacggcaucguccuuacacuccucuacugc

SEQ ID NO: 2075 - RNA, 63 nt, Artificial Sequence
  P40259_TM_160-180
ggcaucaucaugauccaaacucuccucaucauccucuucaucaucguccccauauuccuacuu

SEQ ID NO: 2076 - RNA, 63 nt, Artificial Sequence
  P42081_TM_248-268
uggaucacugccguucuucccaccguuaucaucugcgucauggucuucugucucauccucugg

SEQ ID NO: 2077 - RNA, 63 nt, Artificial Sequence
  Q15762_TM_255-275
ggcgguaccguccuccuccucuuauucgucaucuccaucaccacuauuaucguuaucuuccuc

SEQ ID NO: 2078 - RNA, 63 nt, Artificial Sequence
  Q685J3_TM_4394-4414
cucgugggcgcgggcguggucuugauguugaucauacucguggccuugcucaugcucguguuc

SEQ ID NO: 2079 - RNA, 63 nt, Artificial Sequence
  Q9NNX6_TM_38-58
cucggccacggcccccucguccuccaacuucucuccuucacucuccucgccggccuccucguc

SEQ ID NO: 2080 - RNA, 63 nt, Artificial Sequence
  Q9NR97_TM_828-848
gccgucauucuuuucuucuuuacuuucuucaucacuaccauggucaugcucgccgcccucgcc

SEQ ID NO: 2081 - RNA, 48 nt, Artificial Sequence
  P14207_1-16
augguguggaaguggaugcccuugcucuugcucuuggucugugucgcg

SEQ ID NO: 2082 - RNA, 48 nt, Artificial Sequence
  O75787_1-16
auggccguauucguaguccuacucgcccucguagccggcguccuaggc

SEQ ID NO: 2083 - RNA, 48 nt, Artificial Sequence
  P07359_1-16
augccccuccuccuucuccuccuccuccucccuucuccccuccacccc

SEQ ID NO: 2084 - RNA, 48 nt, Artificial Sequence; identical to SEQ ID NO: 1876
  P08637_1-16

SEQ ID NO: 2085 - RNA, 51 nt, Artificial Sequence
  P07237_1-17
augcucaggcgcgcgcucuugugcuuggccguggccgcgcucgugcgcgcg

SEQ ID NO: 2086 - RNA, 51 nt, Artificial Sequence
  O60911_1-17
augaaucucucccucguccuagccgccuucugccucggcaucgccuccgcc

SEQ ID NO: 2087 - RNA, 51 nt, Artificial Sequence
  P20138_1-17
augccucuacuucuccuccucccccuccucugggccggcgcccuagccaug

SEQ ID NO: 2088 - RNA, 51 nt, Artificial Sequence
  P27797_1-17
augcucuugagcgugcccuugcucuugggcuugcucgggcucgcggucgcg

SEQ ID NO: 2089 - RNA, 54 nt, Artificial Sequence
  P10747_1-18
augcuccgccuccuccuagcccucaaccucuuccccuccauccaagucaccggc

SEQ ID NO: 2090 - RNA, 54 nt, Artificial Sequence
  O75487_1-18
auggcgcgcuuuggcuugcccgcgcucuugugcacgcucgcggucuugagcgcg

SEQ ID NO: 2091 - RNA, 54 nt, Artificial Sequence; identical to SEQ ID NO: 1883
  P07996_1-18

SEQ ID NO: 2092 - RNA, 54 nt, Artificial Sequence
  P22748_1-18
augcgcaugcucuuggccuugcucgcgcuaucggccgcgcgcccaagcgcgagc

SEQ ID NO: 2093 - RNA, 54 nt, Artificial Sequence
  Q15762_1-18
auggacuacccuacacuucuccucgcccuccuccacgucuaccgagcccucugc

SEQ ID NO: 2094 - RNA, 54 nt, Artificial Sequence
  P30273_1-18
augauccccgccgucguccuccuccuccuccuccucgucgaacaagccgccgcc

SEQ ID NO: 2095 - RNA, 54 nt, Artificial Sequence
  P38570_1-18
auguggcuauuccacacccuccucugcaucgccucacucgcccuccucgccgcc

SEQ ID NO: 2096 - RNA, 54 nt, Artificial Sequence
  Q01638_1-18
augggcuucuggauacucgccauccugaccauacucauguacucaaccgcagcc

SEQ ID NO: 2097 - RNA, 54 nt, Artificial Sequence
  Q9NZQ7_1-18
augcgcauauucgccguuuucaucuucaugaccuacuggcaccuccuuaacgcu

SEQ ID NO: 2098 - RNA, 57 nt, Artificial Sequence; identical to SEQ ID NO: 1890
  P13591_1-19

SEQ ID NO: 2099 - RNA, 57 nt, Artificial Sequence; identical to SEQ ID NO: 1891
  P26842_1-19

SEQ ID NO: 2100 - RNA, 57 nt, Artificial Sequence
  P15391_1-19
augcccccuccccgccuccucuucuuccuccuuuuccucacccccauggaaguccgu

SEQ ID NO: 2101 - RNA, 57 nt, Artificial Sequence
  Q8NI17_1-19
augauguggaccugggcccucuggaugcuccccucccuaugcaaauucucccucgcc

SEQ ID NO: 2102 - RNA, 57 nt, Artificial Sequence
  P08571_1-19
auggaacgcgccucaugccuccuccuccuccuccuuccccucguccacgucuccgcc

SEQ ID NO: 2103 - RNA, 57 nt, Artificial Sequence
  P05154_1-19
augcaacucuuccuccuucucugccucguccuccucuccccccaaggcgccucccuc

SEQ ID NO: 2104 - RNA, 57 nt, Artificial Sequence
  P02787_1-19
augagguuggcggugggggcguuguuggugugugcgguguugggguuguguuuggcg

SEQ ID NO: 2105 - RNA, 57 nt, Artificial Sequence
  P02671_1-19
auguucucgaugaggaucgugugcuuggucuugagcguggucgggaccgcguggacg

SEQ ID NO: 2106 - RNA, 57 nt, Artificial Sequence
  P04216_1-19
augaaccucgccaucucaauagcccuccuccucaccguccuccaagucucccgcgga

SEQ ID NO: 2107 - RNA, 57 nt, Artificial Sequence; identical to SEQ ID NO: 1899
  P00747_1-19

SEQ ID NO: 2108 - RNA, 57 nt, Artificial Sequence
  P01764_1-19
auggaguucgggcucucgugguuguucuuggucgcgaucuugaaagggguccagugc

SEQ ID NO: 2109 - RNA, 57 nt, Artificial Sequence
  P16150_1-19
auggccacacuccuccuccuccucggcguccucgucgucucccccgacgcccuuggc

SEQ ID NO: 2110 - RNA, 57 nt, Artificial Sequence
  Q6DN72_1-19
auguugcucuggaccgcggucuugcucuuugucccgugcgugggcaagaccgugugg

SEQ ID NO: 2111 - RNA, 57 nt, Artificial Sequence; identical to SEQ ID NO: 1903
  Q01151_1-19

SEQ ID NO: 2112 - RNA, 57 nt, Artificial Sequence
  P07093_1-19
augaacuggcaccucccccuauuccuccucgccuccgucacccuacccuccaucugc

SEQ ID NO: 2113 - RNA, 57 nt, Artificial Sequence
  Q8WWQ8_1-19
augaugcuccaacaccucgucaucuuuugccucggccuagucguccaaaacuucugc

SEQ ID NO: 2114 - RNA, 60 nt, Artificial Sequence
  Q13291_1-20
auggaccccaaaggccuccucucccucaccuucguccuauuccucucccucgccuucggc

SEQ ID NO: 2115 - RNA, 60 nt, Artificial Sequence
  P35225_1-20
auggcacucuugcucacgaccgugaucgcgcucacgugcuugggcggguucgcgagcccg

SEQ ID NO: 2116 - RNA, 60 nt, Artificial Sequence
  P25942_1-20
augguccgccuaccccuccaaugcguccuauggggcugccuccuuaccgccguccacccc

SEQ ID NO: 2117 - RNA, 60 nt, Artificial Sequence
  P52803_1-20
auguugcacguggaaaugcucacgcucguguucuuggucuuguggaugugcguguucucg

SEQ ID NO: 2118 - RNA, 60 nt, Artificial Sequence
  Q15116_1-20
augcaaauaccccaggccccguggccggucgugugggcggucuugcaauugggcuggcgc

SEQ ID NO: 2119 - RNA, 60 nt, Artificial Sequence
  P05556_1-20
augaaccuacaacccaucuucuggaucggccucaucuccuccgucugcugcgucuucgcu

SEQ ID NO: 2120 - RNA, 60 nt, Artificial Sequence; identical to SEQ ID NO: 1912
  Q12891_1-20

SEQ ID NO: 2121 - RNA, 60 nt, Artificial Sequence
  Q8IV16_1-20
augaaagcgcucggggccgugcucuuggccuugcucuugugcgggcgcccgggcaggggc

SEQ ID NO: 2122 - RNA, 60 nt, Artificial Sequence
  Q03167_1-20
augaccucccacuauguuaucgccaucuuugcccucauguccucaugccucgccaccgcc

SEQ ID NO: 2123 - RNA, 60 nt, Artificial Sequence
  Q14246_1-20
augcgcggguucaaucucuugcucuuuugggggugcugugucaugcacucgugggagggc

SEQ ID NO: 2124 - RNA, 60 nt, Artificial Sequence
  P16871_1-20
augaccauccucggcaccaccuucggcaugguauucucccuacuccaagucgucuccggc

SEQ ID NO: 2125 - RNA, 60 nt, Artificial Sequence
  P61769_1-20
augucgcgcucggucgcgcucgcggucuuggccuugcuaucgcuaucgggcuuggaagcg

SEQ ID NO: 2126 - RNA, 60 nt, Artificial Sequence
  Q9Y6W8_1-20
augaaaucaggccucugguacuucuuccucuucugccuacgcaucaaaguccucaccggc

SEQ ID NO: 2127 - RNA, 63 nt, Artificial Sequence; identical to SEQ ID NO: 1919
  P10966_1-21

SEQ ID NO: 2128 - RNA, 63 nt, Artificial Sequence
  Q9BZW8_1-21
augcucggccaagucgucacccucauccuccuccuccuccucaaagucuaccaaggcaaaggc

SEQ ID NO: 2129 - RNA, 63 nt, Artificial Sequence
  P02778_1-21
augaaccaaaccgccauccuaaucuguugccucauauuccucacccucucaggcauccaaggc

SEQ ID NO: 2130 - RNA, 63 nt, Artificial Sequence
  P18564_1-21
augggcaucgaacuacucugccucuucuuccuauuccucggccgcaacgaccacguccaaggc

SEQ ID NO: 2131 - RNA, 63 nt, Artificial Sequence
  O14525_1-21
auggcgcuagcgggauugugcgcgcuauuggccuguugcuggggcccggcagcggucuuggcc

SEQ ID NO: 2132 - RNA, 63 nt, Artificial Sequence
  P01130_1-21
augggaccguggggguggaagcuaagguggacggucgcgcuauugcuagcggccgcgggaacg

SEQ ID NO: 2133 - RNA, 63 nt, Artificial Sequence
  P01732_1-21
auggcccuccccgucaccgcccuccuccuuccccuugcccuucuccuccacgccgcccgucca

SEQ ID NO: 2134 - RNA, 63 nt, Artificial Sequence
  P48061_1-21
augaaugccaaggucguggucgugcucgugcucgugcucacggccuugugcuugagcgauggc

SEQ ID NO: 2135 - RNA, 63 nt, Artificial Sequence
  P01589_1-21
auggacuccuaccuccucauguggggccuccucaccuucaucaugguccccggcugccaagcc

SEQ ID NO: 2136 - RNA, 63 nt, Artificial Sequence
  Q86T13_1-21
augaggccagcguucgcgcuaugucuauuguggcaggcauuguggccgggaccgggcgggggc

SEQ ID NO: 2137 - RNA, 63 nt, Artificial Sequence
  Q5DID0_1-21
augcuccgcacauccggccuagcccuacucgcccucgucuccgccgucggccccucccaagcc

SEQ ID NO: 2138 - RNA, 66 nt, Artificial Sequence
  P40189_1-22
augcucacgcuccagaccuggcucgugcaagcacucuuuaucuuucucacgaccgagagcacaggc

SEQ ID NO: 2139 - RNA, 66 nt, Artificial Sequence; identical to SEQ ID NO: 1931
  Q86YL7_1-22

SEQ ID NO: 2140 - RNA, 66 nt, Artificial Sequence
  P55075_1-22
augggcuccccccgcuccgcacuuuccugccuacuccuccaccuacucguccuuugccuccaagcc

SEQ ID NO: 2141 - RNA, 66 nt, Artificial Sequence; identical to SEQ ID NO: 1933
  Q30201_1-22

SEQ ID NO: 2142 - RNA, 66 nt, Artificial Sequence
  P07766_1-22
augcaaucgggcacgcacuggcgcgugcucgggcucugucucuugagcgugggcgugugggggcaa

SEQ ID NO: 2143 - RNA, 66 nt, Artificial Sequence
  P18827_1-22
augaggcgcgcggccuugugguugugguugugcgcgcucgcgcucucgcuccagcccgcgcucccg

SEQ ID NO: 2144 - RNA, 66 nt, Artificial Sequence
  P55290_1-22
augcaaccccgcacaccccucguccucugcguccuccucucucaaguccuccuccuaaccuccgcc

SEQ ID NO: 2145 - RNA, 66 nt, Artificial Sequence
  P37173_1-22
augggccgaggccuccuccgcggccuauggccccuccacaucguacucuggacccgaaucgccucc

SEQ ID NO: 2146 - RNA, 66 nt, Artificial Sequence; identical to SEQ ID NO: 1938
  Q07325_1-22

SEQ ID NO: 2147 - RNA, 66 nt, Artificial Sequence
  P04156_1-22
auggccaaucucgggugcuggauguuggucuuguucguggccacguggucggacuugggcuugugc

SEQ ID NO: 2148 - RNA, 66 nt, Artificial Sequence
  P31785_1-22
augcucaaacccucacuccccuucaccucccuccucuuccuccaacucccacuccucggcgucggc

SEQ ID NO: 2149 - RNA, 69 nt, Artificial Sequence
  P01579_1-23
augaaauacaccucauacauacucgccuuccaacucugcaucguccucggcucccucggcugcuacugc

SEQ ID NO: 2150 - RNA, 69 nt, Artificial Sequence
  P23229_1-23
auggcggccgcgggccagcucugucucuuguacuugagcgcgggcuugcucucgcgcuugggcgcggcc

SEQ ID NO: 2151 - RNA, 69 nt, Artificial Sequence
  O60494_1-23
augaugaacaugucccucccauuccucuggucccuccucacccuccucauauucgccgaagucaacggc

SEQ ID NO: 2152 - RNA, 69 nt, Artificial Sequence; identical to SEQ ID NO: 1944
  P08575_1-23

SEQ ID NO: 2153 - RNA, 69 nt, Artificial Sequence
  Q8IWY4_1-23
augggggccgcggccgugcgcuggcacuugugcgugcucuuggccuugggcacgcgcgggcgauuggcc

SEQ ID NO: 2154 - RNA, 69 nt, Artificial Sequence
  Q08431_1-23
augccccgcccccgacuacuagccgcccucugcggcgcacuacucugcgcccccucccuccucgucgcc

SEQ ID NO: 2155 - RNA, 69 nt, Artificial Sequence
  Q99665_1-23
auggcccacaccuuccgcggcugcucccucgccuucauguucauaaucacauggcuacucauaaaagcc

SEQ ID NO: 2156 - RNA, 69 nt, Artificial Sequence
  Q6Q8B3_1-23
augucagccccccgccuccuuaucuccauaaucauaauggucuccgccucuuccucuuccugcaugggc

SEQ ID NO: 2157 - RNA, 69 nt, Artificial Sequence
  Q07011_1-23
augggcaacuccugcuacaacaucguagccacacuccuccucguacucaacuucgaacgcacccgcucc

SEQ ID NO: 2158 - RNA, 69 nt, Artificial Sequence; identical to SEQ ID NO: 1950
  Q8NHL6_1-23

SEQ ID NO: 2159 - RNA, 69 nt, Artificial Sequence
  P36894_1-23
augccccaacucuauauauacauccgccuccucggcgcuuaccucuucauuaucucccgcguccaaggc

SEQ ID NO: 2160 - RNA, 69 nt, Artificial Sequence
  Q16552_1-23
augacccccggcaaaaccucccucgucucccuccuccuccucuuaucccucgaagccaucgucaaagcc

SEQ ID NO: 2161 - RNA, 69 nt, Artificial Sequence
  P42081_1-23
auggacccccaaugcaccaugggccuauccaacauccucuucgucauggccuuccuccuauccggcgcc

SEQ ID NO: 2162 - RNA, 69 nt, Artificial Sequence
  P43121_1-23
augggcuugcccaggcucgugugcgcguuuuugcucgcggccuguugcuguugcccgcgcguggccggg

SEQ ID NO: 2163 - RNA, 69 nt, Artificial Sequence
  O00206_1-23
augaugucagccucccgccuagccggcacccucauccccgccauggccuuccuauccugcguccgaccc

SEQ ID NO: 2164 - RNA, 69 nt, Artificial Sequence
  P42701_1-23
auggaaccccuagucaccugggucgucccccuccucuuccucuuccuacuuucccgccaaggcgccgcc

SEQ ID NO: 2165 - RNA, 72 nt, Artificial Sequence
  P06729_1-24
augucauuccccugcaaauucgucgccuccuuccuccucaucuucaacguuuccuccaaaggcgccgucuca

SEQ ID NO: 2166 - RNA, 72 nt, Artificial Sequence
  P15328_1-24
auggcgcaaaggaugacgacacagcuauugcuauugcucguguggguggccguggucggggaagcgcaaacg

SEQ ID NO: 2167 - RNA, 72 nt, Artificial Sequence
  P05112_1-24
augggccucacaucccaacuccuacccccacucuucuuccuccucgccugcgccggcaacuucguacacggc

SEQ ID NO: 2168 - RNA, 72 nt, Artificial Sequence
  P06127_1-24
augcccaugggcucacuccaaccccucgccacccucuaccuccucggcaugcucguagccucaugccucggc

SEQ ID NO: 2169 - RNA, 72 nt, Artificial Sequence; identical to SEQ ID NO: 1961
  P32248_1-24

SEQ ID NO: 2170 - RNA, 72 nt, Artificial Sequence
  Q7Z7D3_1-24
auggcgagcuugggccagaucuuguucuggagcauaaucucgaucauaaucauacucgcgggcgcgaucgcg

SEQ ID NO: 2171 - RNA, 72 nt, Artificial Sequence
  P54756_1-24
augagagggagcgggccaaggggagcgggaaggagaaggccgccgagcgggggaggggacacgccaauaaca

SEQ ID NO: 2172 - RNA, 72 nt, Artificial Sequence
  Q92823_1-24
augcaacuaaaaaucaugcccaaaaaaaaacgccucuccgccggccgcgucccccucauccucuuccucugc

SEQ ID NO: 2173 - RNA, 72 nt, Artificial Sequence
  P19320_1-24
augcccggcaaaauggucgucauccucggcgccuccaacauccucuggaucauguucgccgccucccaagcc

SEQ ID NO: 2174 - RNA, 72 nt, Artificial Sequence
  Q86UN2_1-24
auguugaggaagggguguuguguggaguuguuguuguuguugguggcggcggaguugccguugggggggggg

SEQ ID NO: 2175 - RNA, 75 nt, Artificial Sequence; identical to SEQ ID NO: 1967
  P33151_1-25

SEQ ID NO: 2176 - RNA, 75 nt, Artificial Sequence
  P17813_1-25
auggaccgcggcacacucccacucgccgucgcacuccuccucgccuccugcucacucucccccacaucccuagcc

SEQ ID NO: 2177 - RNA, 75 nt, Artificial Sequence
  P25445_1-25
augcucggaaucuggaccuugcucccgcucgugcucacaagcguggccagacucucgagcaagagcgugaacgcg

SEQ ID NO: 2178 - RNA, 75 nt, Artificial Sequence
  P01730_1-25
augaaccgaggcguccccuuccgccaccuccuccucguccuccaacucgcacuccuacccgccgccacccaaggc

SEQ ID NO: 2179 - RNA, 75 nt, Artificial Sequence
  Q685J3_1-25
augccccgccccggcaccauggcccucugccuccucacacucguccucucacuccuccccccccaagcagccgca

SEQ ID NO: 2180 - RNA, 75 nt, Artificial Sequence
  P17787_1-25
auggccaggcgcuguggcccggucgcgcucuugcucggguucgggcucuugcgauugugcucgggcguguggggg

SEQ ID NO: 2181 - RNA, 75 nt, Artificial Sequence
  Q6UQ28_1-25
auggccgucuuccacgacaugcuccuccaaccccucggcauguuucucugccucucccuacaacuauccuccgcc

SEQ ID NO: 2182 - RNA, 75 nt, Artificial Sequence; identical to SEQ ID NO: 1974
  P13987_1-25

SEQ ID NO: 2183 - RNA, 75 nt, Artificial Sequence
  P10721_1-25
augaggggagcgcgcggggccugggacuuucucugugucuugcuauugcuauugagagugcaaacgggaucgagc

SEQ ID NO: 2184 - RNA, 75 nt, Artificial Sequence
  P12319_1-25
auggccccagccauggaaucacccacccuccucugcguagcccuccucuucuucgcccccgacggcguccucgcc

SEQ ID NO: 2185 - RNA, 78 nt, Artificial Sequence; identical to SEQ ID NO: 1977
  Q9BZR6_1-26

SEQ ID NO: 2186 - RNA, 78 nt, Artificial Sequence
  P25063_1-26
augggccgcgccauggucgcccgccucggccucggccuacuccuacucgcccuacuacuccccacccaaaucuacucc

SEQ ID NO: 2187 - RNA, 78 nt, Artificial Sequence
  Q9NR97_1-26
auggaaaacauguuccuccaaucauccaugcuaaccugcaucuuccuccucaucuccggauccugcgaacucugcgcc

SEQ ID NO: 2188 - RNA, 78 nt, Artificial Sequence; identical to SEQ ID NO: 1980
  Q8N131_1-26

SEQ ID NO: 2189 - RNA, 78 nt, Artificial Sequence
  P49771_1-26
augaccguccucgcccccgcuuggucucccacuaccuaucuccuccuccuccuccuucucuccuccggccucucuggc

SEQ ID NO: 2190 - RNA, 78 nt, Artificial Sequence
  P02679_1-26
auguccuggucccuucacccccgcaaucucauucucuacuucuacgcccuucucuuucucuccucuaccugcgucgcc

SEQ ID NO: 2191 - RNA, 78 nt, Artificial Sequence
  P14784_1-26
auggcagccccagcccuauccuggcgccuaccccuacucauccuccuacucccccucgccacuuccugggccuccgcc

SEQ ID NO: 2192 - RNA, 81 nt, Artificial Sequence
  P05362_1-27
auggccccauccucaccccgccccgcacucccagcccuccucguccuccucggcgcccucuuccccggccccggaaaugcc

SEQ ID NO: 2193 - RNA, 81 nt, Artificial Sequence
  Q13740_1-27
auggaauccaaaggcgccuccuccugccgccuacucuucugccuccucauaucagccaccgucuuccgacccggccucgga

SEQ ID NO: 2194 - RNA, 84 nt, Artificial Sequence
  Q13443_1-28
augggcucgggcgcgagauuuccaucgggcacgcucagggucaggugguugcuauugcucgggcucgugggcccggucuugggc

SEQ ID NO: 2195 - RNA, 84 nt, Artificial Sequence
  P14151_1-28
augaucuuccccuggaaaugccaaucaacccagagagaccucuggaacauauucaaacucuggggcuggaccaugcucugcugc

SEQ ID NO: 2196 - RNA, 84 nt, Artificial Sequence
  P56199_1-28
auggccccgcgcccgcgcgcacgaccgggcguggccguggccuguugcuggcucuugaccguagucuugcgcuguugcgugagc

SEQ ID NO: 2197 - RNA, 84 nt, Artificial Sequence
  P11279_1-28
auggccgcccccggcuccgcccgccgcccccuacuccuccuccuccuccuacuucuacucggccucaugcacugcgcuuccgcc

SEQ ID NO: 2198 - RNA, 84 nt, Artificial Sequence
  P40259_1-28
auggcccgccuagcccuauccccaguccccucccacuggauggucgcccuccuccuccuacucuccgccgaacccguccccgcc

SEQ ID NO: 2199 - RNA, 84 nt, Artificial Sequence
  P43681_1-28
auggagcucgggggcccgggcgcgcccaggcucuugcccccgcucuugcucuugcucgggaccgggcuauugcgcgcgagcucg

SEQ ID NO: 2200 - RNA, 84 nt, Artificial Sequence; identical to SEQ ID NO: 1992
  P18627_1-28

SEQ ID NO: 2201 - RNA, 84 nt, Artificial Sequence; identical to SEQ ID NO: 1993
  Q5ZPR3_1-28

SEQ ID NO: 2202 - RNA, 84 nt, Artificial Sequence
  P23415_1-28
auguacucauucaacacccuccgccucuaccucugggaaacaauagucuucuucucccucgccgccucaaaagaagccgaagcc

SEQ ID NO: 2203 - RNA, 84 nt, Artificial Sequence
  Q8TD46_1-28
augcucugccccuggcguacugccaaucucggccuccuucucauucucacuauuuuucucgucgccgccuccuccucccucugc

SEQ ID NO: 2204 - RNA, 87 nt, Artificial Sequence
  P17301_1-29
augggccccgaacgcaccggcgccgccccacucccccuccuacucguacucgcacucucccaaggaauccucaacugcugccucgcc

SEQ ID NO: 2205 - RNA, 87 nt, Artificial Sequence
  P12821_1-29
augggcgccgccuccggccgccgcggccccggacuccuacuaccccuaccccuccuccuccuccucccaccccaacccgcacucgcc

SEQ ID NO: 2206 - RNA, 87 nt, Artificial Sequence; identical to SEQ ID NO: 1998
  Q14118_1-29

SEQ ID NO: 2207 - RNA, 87 nt, Artificial Sequence
  P05231_1-29
augaacuccuucucuacauccgccuucggccccgucgcuuucucucucggccuccuccuaguccuacccgccgccuuccccgccccc

SEQ ID NO: 2208 - RNA, 87 nt, Artificial Sequence
  O00602_1-29
auggaauugagcggggccacgauggcgcgcgggcucgcggucuugcucgugcucuuucuccauaucaagaacuugcccgcgcaagcg

SEQ ID NO: 2209 - RNA, 87 nt, Artificial Sequence
  Q9Y6Q6_1-29
auggcaccccgcgcccgccgacgccgcccccucuucgcccuccuacuccucugcgcccuccuagccagacuccaagucgcccuccaa

SEQ ID NO: 2210 - RNA, 87 nt, Artificial Sequence
  Q9ULI3_1-29
auggccuccccacgcgccucccgcuggcccccaccccuucuccuccuccuccucccccuacuucuacucccacccgccgcccccggc

SEQ ID NO: 2211 - RNA, 90 nt, Artificial Sequence
  Q8NBP7_1-30
auggggacagugagcucgcgcaggagcugguggccgcucccgcucuugcucuuacucuugcucuugcucgggcccgcgggcgcgcgcgcg

SEQ ID NO: 2212 - RNA, 90 nt, Artificial Sequence
  P02675_1-30
augaaacgcauggucuccugguccuuccacaaacucaaaacuaugaaacaccuccuccuccuacuccuaugcgucuuccucgucaaaucc

SEQ ID NO: 2213 - RNA, 90 nt, Artificial Sequence
  P06756_1-30
auggccuucccaccccgccgccgccuacgccucggcccccgcggacucccccuccuacucuccggccuacuucuaccccucugccgagcc

SEQ ID NO: 2214 - RNA, 93 nt, Artificial Sequence
  O60609_1-31
augguccguccccuuaacccccgcccccuacccccagucguccucaugcuccuacuucuccucccacccucaccccucccccucgccgccggc

SEQ ID NO: 2215 - RNA, 93 nt, Artificial Sequence
  P50895_1-31
auggaacccccagacgcccccgcccaagcccgaggagccccccgccuacuccuacucgccguccuacucgccgcccaccccgacgcccaagcc

SEQ ID NO: 2216 - RNA, 93 nt, Artificial Sequence
  P28906_1-31
augcucgugcgcaggggcgcgcgcgcgggcccgcgaaugcccaggggcuggaccgcgcucugucucuugagcuugcucccgagcggguucaug

SEQ ID NO: 2217 - RNA, 93 nt, Artificial Sequence; identical to SEQ ID NO: 2009
  P08514_1-31

SEQ ID NO: 2218 - RNA, 93 nt, Artificial Sequence
  P00742_1-31
augggccgcccccuccaccucguccuccucuccgccucccuagccggccuccuacuccuaggcgaaucccuauucauccgccgcgaacaagcc

SEQ ID NO: 2219 - RNA, 96 nt, Artificial Sequence; identical to SEQ ID NO: 2011
  P26006_1-32

SEQ ID NO: 2220 - RNA, 96 nt, Artificial Sequence
  P13726_1-32
auggaaacgccagcguggccgcgcgugcccagacccgagaccgcggucgcgcgcacgcucuugcucggguggguauucgcgcaaguggccggggcc

SEQ ID NO: 2221 - RNA, 96 nt, Artificial Sequence
  P11912_1-32
augcccggcggccccggcguccuccaagcccuccccgccaccauauuccuacucuuccuccuauccgccgucuaccucggacccggcugccaagcc

SEQ ID NO: 2222 - RNA, 96 nt, Artificial Sequence
  Q9H6X2_1-32
auggcgacagcggaaaggcgagcgcucgggaucggguuccagugguugagcuuggccacgcuagugcuaauaugcgcgggccagggcgggcgcagg

SEQ ID NO: 2223 - RNA, 99 nt, Artificial Sequence
  Q8IWK6_1-33
auggaaccgcccgggcgcaggcgcgggcgcgcgcaaccgcccuugcucuugcccuugagcuugcucgcgcucuuggccuugcucgggggcgggggcggg

SEQ ID NO: 2224 - RNA, 99 nt, Artificial Sequence
  P58335_1-33
augguggccgagcgaucgcccgcgcgcucgcccgggagcuggcuauuucccgggcucuggcuauuggucuugagcgggcccgggggcuugcucagggcc

SEQ ID NO: 2225 - RNA, 102 nt, Artificial Sequence
  P06731_1-34
auggaaucccccuccgccccaccccaccgcuggugcauccccuggcaacgccuacuccuaaccgccucccuccucacauucuggaacccacccaccaccgcc

SEQ ID NO: 2226 - RNA, 102 nt, Artificial Sequence
  P33681_1-34
augggccacacccgccgccaaggaaccuccccauccaaaugcccauaccuaaacuucuuccaacuccucguccuagccggccuaucccacuucugcucaggc

SEQ ID NO: 2227 - RNA, 105 nt, Artificial Sequence
  P38567_1-35
augggcguacucaaauucaaacacauauucuuccguuccuucgucaaaucauccggcgucucccaaauagucuucaccuuccuccucaucccaugcugccucaca

SEQ ID NO: 2228 - RNA, 105 nt, Artificial Sequence
  P16410_1-35
auggccugccucggcuuccaacgccacaaagcacaacucaaccuagccacccgcaccuggcccugcacacuccucuucuuccuccuauucauacccguauucugc

SEQ ID NO: 2229 - RNA, 111 nt, Artificial Sequence; identical to SEQ ID NO: 2021
  P15814_1-37

SEQ ID NO: 2230 - RNA, 114 nt, Artificial Sequence
  Q92956_1-38
auggaacccccaggcgacuggggacccccccccuggcgcucaacacccaaaaccgacguccucagacucguccucuaccucacauuccuaggcgcccccugcuacgcccccgcc

SEQ ID NO: 2231 - RNA, 123 nt, Artificial Sequence
  Q86VB7_1-41
augucaaaacuccgcaugguccuccuagaagacuccggcuccgccgacuuccgccgccacuucgucaaccucucccccuucaccauaaccguaguccuacuccuaucagccugcuucgucacc

SEQ ID NO: 2232 - RNA, 123 nt, Artificial Sequence
  P08648_1-41
augggcucccgcacccccgaauccccccuccacgccguccaacuccgcuggggcccccgccgccgcccaccccuacucccccuccuacuacuccuccuacccccacccccccgcgucggcgga

SEQ ID NO: 2233 - RNA, 123 nt, Artificial Sequence
  P16109_1-41
auggccaacugccaaauagccauacuauaccaacgcuuccaacgcgucgucuucggcaucucccaacuccucugcuucuccgcccucaucuccgaacucaccaaccaaaaagaagucgccgcc

SEQ ID NO: 2234 - RNA, 132 nt, Artificial Sequence
  O75326_1-44
augaccccacccccccccggccgcgccgcccccuccgcaccccgagcccgcgucccaggcccccccgcccgccucggccuaccccuacgccuacgccuacuccuacuccucugggcagccgcagccucagcc

SEQ ID NO: 2235 - RNA, 135 nt, Artificial Sequence; identical to SEQ ID NO: 2027
  Q8N2Q7_1-45

SEQ ID NO: 2236 - RNA, 138 nt, Artificial Sequence
  Q86UN3_1-46
augcuccccggccuccgccgacuccuacaagccccugccuccgccugccuccuccuaaugcuccucgcccuuccacucgcagccccauccugccccaugcucugcacaugcuacuccucucccccuaccgucuccugc

SEQ ID NO: 2237 - RNA, 540 nt, Artificial Sequence
  A0A5B9
auggaccucaaaaacgucuucccaccagaagucgccgucuucgaacccagcgaagccgaaaucucccacacccaaaaagccacucuagucugccucgccaccggcuucuaccccgaccacgucgaacuauccuggugggucaacggcaaagaaguccacuccggcgucuccacagacccacaaccccucaaagaacaacccgcccucaacgacucccgauacugccucagcuccagacuccgcgucuccgccaccuucuggcaaaacccccgcaaccacuuccgcugccaaguacaauucuacggccucuccgaaaacgacgaauggacccaagaccgcgccaaacccgucacccaaaucgucuccgccgaagccuggggccgagccgacugcggauucaccuccgaaucauaccaacaaggcguacucucagccacaauccuauacgaaauccuccuaggcaaagccacccucuacgccguccuagucuccgcccuaguacucauggcaaugguaaaacgcaaagacucccgaggcuaa

SEQ ID NO: 2238 - RNA, 465 nt, Artificial Sequence
  B7Z8K6
augucccaaccccacaccaaacccuccgucuucgucaugaaaaacggcaccaacgucgccugccucguaaaagaauucuaccccaaagacauccgcauaaaccucgucucauccaaaaaaaucaccgaauuugaccccgccaucgucaucucccccuccggaaaauacaacgccgucaaacuaggcaaauacgaagacucaaacucagucaccugcucaguacaacacgacaacaaaaccguccacucaaccgacuucgaagucaaaaccgacuccaccgaccacgucaaacccaaagaaaccgaaaacaccaaacaacccucaaaaucaugucacaaacccaaagccauaguccacaccgaaaaaguaaacaugaugucacucaccguccuaggccuccgcaugcuauucgccaaaaccgucgccgucaacuuccuccucacagccaaacucuucuuccucuaa

SEQ ID NO: 2239 - RNA, 645 nt, Artificial Sequence
  B9A064
augcgaccaaaaaccggccaagucggcugcgaaacccccgaagaacucggccccggaccccgccaacgcuggccccuccuccuccucggccuagcaauggucgcccacggccuacuacgccccauggucgcaccccaaucaggcgaccccgacccaggcgccucagucggcucaucccgaucaucccuccgaucccucuggggccgccuccuccuucaacccucaccccaacgcgccgacccccgcugcuggccccgcggcuucugguccgaaccccaaucccucugcuacgucuucggcaccggcaccaaaguaaccguccuaggccaacccaaagcaaaccccaccgucacccucuucccacccuccuccgaagaacuccaagccaacaaagccacccucgucugccucaucucagacuucuaccccggcgccgucaccgucgccuggaaagccgacggcucacccguaaaagcaggaguagaaaccaccaaacccuccaaacaauccaacaacaaauacgccgcauccuccuaccucucccucacacccgaacaauggaaaucacacagauccuacuccugccaagucacccacgaaggauccacagucgaaaagaccgucgcacccaccgaaugcuccuga

SEQ ID NO: 2240 - RNA, 2520 nt, Artificial Sequence
  O00206
augaugagcgccucacgccucgccggcacacugauaccagcaauggcauuccuuuccugcguccgaccugaauccugggaacccugcgucgaggucguucccaacauaacauaccagugcauggaacugaauuucuauaaaauacccgacaaccuuccuuucucuacaaagaaccucgaccucuccuucaacccccuacgucaccuaggcuccuacagcuucuucucauuccccgagcuccaaguccuagaccucucucgcugcgaaauccaaacaauugaggauggggccuaccaaucacuaucacaccuuuccaccuuaauacucacuggaaauccuauacaauccuuagcacucggcgcuuucuccggacucucuagccuccaaaaacucgucgccgucgagacuaaccucgccucccuugaaaacuuuccaaucgggcaccucaaaacucucaaagaacuuaauguugcccacaaccuuauacaaucauucaaacuaccagaguacuucucaaaccucacaaaccuggagcaccuugaccuguccuccaacaaaauucaauccaucuacugcacugaucuucgaguccuccaccaaaugccccuccuuaaccuuucacucgaccucucccucaaccccaugaauuucauccaacccggcgcauucaaagaaauaaggcuccacaaacucacccuccguaacaacuucgauagccugaacgucaugaaaaccuguauccagggucucgcuggacucgaaguccaccgacucguccucggcgaguuccgaaacgaaggcaaccuagaaaaguucgacaaguccgcccucgaaggccucugcaaccucacaauagaagaguuccgacucgcauaccucgacuacuaccuggacgauauaaucgaccuuuucaacugccugacuaacguuuccuccuucucacucguaucggucacuaucgaacgagucaaagacuuuuccuacaacuucgguuggcaacaccucgaacucgucaauugcaaauucggccaauuccccacacuuaaacuuaaaagucucaagcgccucacguucaccuccaacaaaggcggcaacgcauucuccgaagucgaccuccccucacuagaguuccucgaccucucucgcaacgggcucagcuucaaaggaugcugcucacaaucagacuucggcaccacaucccuaaaauaccucgaccucagcuucaacggcguaauuaccaugucgucuaacuucuuaggacuagaacaacucgaacaucucgauuuccagcauucaaaccucaaacaaauguccgaguucucuguuuuccugucccugaggaaccucaucuaccucgacaucagccacacacacacccgagucgcauucaauggaauuuucaacggccuauccucccuagaaguccuaaaaauggccggcaacucauuccaagaaaacuuccuccccgacaucuucaccgaacuccgaaaccucaccuuccucgaccuaucacaaugccaacucgaacaacuauccccaacagccuucaacucacuaagcuccuuacaaguucuaaacaugucccacaacaacuucuucagucuagacacauuccccuauaaaugccucaacagccuccagguucucgacuauucacuaaaccacauaaugacaagcaagaaacaggaacugcaacauuuccccuccucccucgcauuccugaaccucacucagaacgauuucgccuguaccugcgaacaccaaucguuccuccaguggauuaaagaccaacgacaauuacucgucgaaguggaacgcauggaaugcgccacccccagugauaagcaaggcaugccaguacucucuuuaaauaucacuugccagaugaauaaaaccaucaucggcgucuccguucuuuccguccucguugucuccgucgucgccguccucgucuacaaauucuacuuccaccuuaugcuccuggcaggcugcaucaaauacggucgcggcgaaaacaucuacgacgccuucguuaucuacucgucucaagacgaagacuggguuagaaaugaacucguaaagaaccucgaagaaggaguacccccuuuccaacuaugccuccauuaccgcgauuucaucccaggcgucgccaucgcagcaaauaucauccacgaaggcuuccauaaauccagaaaagucaucgucgucgugagccagcacuuuauacaaucacgcuggugcaucuuugaguacgaaaucgcccaaacguggcaauuccucucaagcagagccggcauaaucuucauuguacuacagaaagucgaaaagacccuucuucgacaacaaguugaacucuaccgucuccucucccgaaauacauaccucgaaugggaagacucaguccuuggccggcacauauuuuggcgucggcuacguaaagcacuccucgacggcaaauccuggaaccccgaaggaacugugggcaccggcugcaauuggcaagaagcaaccucgauauga

SEQ ID NO: 2241 - RNA, 1377 nt, Artificial Sequence
  P01730
augaaccgcggagucccauuccgucaccuacuccucguccuccaacuagcacuccuacccgccgccacccaaggcaaaaaagucguccuaggcaagaaaggcgacaccguagaacucaccugcacagccucccaaaaaaagagcauccaauuccacuggaaaaacuccaaccaaauaaaaauccucggaaaccaaggcucauuccugaccaaaggacccagcaaacucaacgaccgcgccgacucaagacgaucccuaugggaccaaggcaacuucccccucaucauaaaaaaccucaagauagaagacuccgacaccuacaucugcgaagucgaagaccaaaaagaggaaguccaacuacuaguauucggccucaccgccaacuccgacacccaccuacuacaaggacaaucucuaacacucacccucgaauccccccccggcuccucacccucaguccaaugccgauccccccgcggaaaaaacauccaagguggcaaaacccucucagucucccaacucgaacuccaagacuccggcacauggaccugcaccguccugcaaaaccagaaaaaagucgaauucaaaaucgacauuguaguacucgccuuccaaaaagccucgucaaucgucuacaaaaaagaaggcgaacaagucgaauucuccuucccucucgccuuuacagucgaaaagcucaccggcuccggcgaacucugguggcaagccgaacgcgccuccagcuccaaauccuggaucaccuucgaccuaaaaaacaaagaagucucaguaaaacgagucacacaagacccaaaacuccaaaugggcaaaaaacucccacugcaccucacucuaccccaagcccucccccaauacgccggcuccggcaaccucacccuagcccucgaagccaaaaccggcaaacuucaccaagaaguaaaccuaguugucaugcgcgccacccaacuacaaaaaaaccucacaugcgaaguguggggccccacuagcccaaaacucaugcucucccucaagcuagagaacaaagaagccaaagucuccaaaagagaaaaggcagucuggguacuaaaccccgaagccggcauguggcaaugccuacucuccgacuccggacaaguccuccuagaauccaacauuaaaguccugcccaccuggucuacccccguccagccaauggcccuaaucguacucgguggagucgccggacuccuccucuucaucggccuugguaucuucuucugcgucagaugccgccaccgacgucgccaagccgaacgcaugucucaaaucaaacggcugcucucagagaaaaaaaccugccaaugcccacaccgcuuccaaaaaaccugcuccccaaucuga

SEQ ID NO: 2242 - RNA, 537 nt, Artificial Sequence
  P01850
auggaagaccucaacaaagucuucccacccgaagucgccgucuucgaacccuccgaagccgaaaucucacacacccaaaaagccacccuagucugccuagcaacaggcuucuuccccgaccacgucgaacucucauggugggucaacggcaaagaaguccacucaggcguaucaaccgacccccaaccccucaaagaacaacccgcacucaacgacucccgcuacugccucucaucccgccuccgcgucucagcaacauucuggcaaaacccccgcaaccacuuccgcugccaaguccaauucuacggccucuccgaaaacgacgaauggacacaagaccgcgccaaacccgucacccaaaucgucucugccgaagccuggggccgcgccgacugcggcuucaccucaguaagcuaccaacaaggcguacucuccgccaccauacuauacgaaauccuccucggcaaagccacccucuacgccguccuagucuccgcccuaguccucauggcaaugguaaaacgcaaagacuucuaa

SEQ ID NO: 2243 - RNA, 624 nt, Artificial Sequence
  P07766
augcaaagcggaacccacuggaggguccuaggccuaugccuccucuccgucggagucuggggccaagacggaaacgaagaaaugggaggaaucacgcaaacacccuacaaaguaagcauaagcggaaccacaguaauacucacaugcccacaauaccccggauccgaaauccuauggcaacacaacgacaaaaacauaggcggagacgaagacgacaaaaacaucggaagcgacgaagaccaccuaagccuaaaagaauucucagaacuagaacaaagcggcuacuacgucugcuacccgcgcggaagcaaacccgaagacgcaaacuucuaccuguaccuacgcgcgcgcguaugcgaaaacugcauggaaauggacguaaugagcguagccacaaucguaaucguagacaucugcauaaccggaggccuacuacuccucguauacuacuggucaaaaaaccgaaaagccaaagcaaaaccaguaaccaggggcgcaggcgcaggaggacgccaacgcggacaaaacaaagaacgcccacccccagucccaaacccagacuacgaaccaaucagaaaagggcaaagagaccuguacuccggccuaaaccaacgcagaaucuga

SEQ ID NO: 2244 - RNA, 3915 nt, Artificial Sequence
  P08575
auguaccucuggcucaagcuacucgccuuuggcuucgccuuucuugacaccgaagucuuugucaccggacaaucacccacgccuagcccaaccggccucacaacagcaaaaaugcccagcgucccucucagcucugacccacuccccacgcauaccacagcuuucucaccagccaguacauuugaacgagaaaacgacuucuccgaaacgacgacaucacuaagccccgacaacaccucgacacagguaucgcccgacuccuuggacaacgcgagugcauucaacacaaccggaguaucuucuguacaaacaccccaucugccaacccacgccgacagccaaacacccagcgcgggcaccgacacacagaccuucuccggaagcgcugccaaugcgaaacucaacccgacccccggcucuaaugcaaucuccgacgugccgggugaacgcuccacggccucaacuuuuccuacugacccaguauccccacugaccacaacacuaagccucgcccaccacuccuccgcagcgcucccagcccgcacaucuaacaccacgauaacggcuaacacauccgacgccuacuuaaacgccucggaaacuacaacccucucccccuccggcucugccgucauaagcaccacaaccaucgcaacuacccccucgaaaccgacaugcgacgaaaaguacgccaacauaaccguagacuaccuauacaacaaggaaacgaagcuauuuaccgccaaacuaaacgucaacgagaacgucgaaugcggcaacaacacguguacaaauaacgaaguacacaaccucacagaaugcaaaaacgccucaguaaguauaucacacaauucaugcaccgcacccgacaaaacacucauccucgacgucccacccggcgucgaaaaguuucaacuccaugacugcacacaaguagaaaaagcugacaccacgaucugccugaaauggaaaaacauagaaaccuuuacaugcgacacccagaauauaaccuaucgcuuucaaugcggaaauaugauauucgacaauaaggaaauaaaacucgaaaaccucgaacccgaacacgaauacaaaugugacagcgagauacucuacaacaaccacaaguucaccaaugccucaaaaaucaucaaaacugacuucggcucgccaggggaaccgcaaaucaucuucugccgcucagaagccgcgcaucaaggugucaucacguggaacccuccacaacggagcuuucacaacuucacacucugcuauauuaaagaaacagaaaaggauugucugaaccuggacaagaacuuaaucaaauacgaccuccaaaacuuaaagccauacacaaaguacgugcucucucuacacgccuacaucaucgccaaaguacagcgaaacggcuccgccgcgaugugccacuucacuacgaaaagcgcaccaccaucacaaguauggaacaugacagucaguaugaccuccgacaacuccaugcacgucaaaugccgaccgccgagagaccgcaacgggccccacgaacgcuaccaccucgaggucgaagcggguaacacgcuuguacgaaacgagucccacaaaaacugugacuuccgcgucaaagaccuacaguacuccacagacuacacguucaaagcauacuuccacaacggcgacuacccaggcgaaccauucauacuacaccauucgaccucauauaacucaaaagccuuaauagccuuccuagcauuccuaaucaucgugaccagcauagcccuucuagucguccucuauaaaaucuacgaccugcacaaaaagagaucauguaacuuggaugaacaacaagaauuagucgaaagagacgacgagaaacaacugaugaacguagagccuauacacgccgacauccuccucgaaacauauaaacgcaagaucgccgacgaaggcagacuauuccucgcggaguuccaaucaauaccgcgcguauucucgaaguucccuaucaaagaagcacgcaaaccauucaaccagaacaaaaaccgguacgucgauauauuaccauacgacuauaaccgcgucgaacuguccgaaaucaacggcgacgccggcuccaacuacauaaacgccuccuacauagauggauucaaagagccacgaaaguauaucgcagcucaagguccaagagacgaaaccguagacgauuucuggcgaaugaucugggaacaaaaggccaccguaaucguaauggucacucggugcgaagaaggcaaccguaauaaaugcgcggaauacuggcccucaauggaagaaggaacaagagccuucggcgaugucgucgucaagaucaaccaacauaaaagaugcccugauuacauaauccaaaaacucaacaucguuaacaagaaagaaaaagcaacaggcagggagguaacucacauacaguucacaaguuggccagaccacgggguaccagaagacccucaucuacuccucaaacugcgccgccgcgucaacgcauuuucaaacuucuucuccggcccgaucguaguacauugcagcgcuggcgucggccgcacaggcaccuauaucggcauagacgcuaugcuggaagggcuugaggccgaaaacaaaguagacguauacggcuacgucgucaaauugcgccgccagcggugucucaugguucaggucgaagcgcaguacauccugauucaccaggcccucguagaguacaaccaauucggcgagaccgaagucaaccuuuccgaacuccaucccuaccuccacaacaugaagaaacgcgaucccccuuccgaaccuaguccccucgaggccgaguuccagcgccuccccuccuaccgcuccuggagaacacaacacauaggcaaucaagaagaaaacaaauccaaaaaccgaaauucaaaugucauccccuacgacuacaaccgagucccccucaaacacgaacuagaaaugucaaaagaaucugaacacgacagcgacgaauccagcgacgacgacucagacucugaagaaccaucaaaauacaucaaugccucguucaucaugucuuauuggaaacccgaagucaugauagccgcacaaggcccgcugaaggaaaccaucggugacuucuggcaaaugauuuuccaacguaaagucaaagucauaguaaugcucacggaacuaaaacacggcgaccaagaaaucugcgcccaauacuggggagagggcaaacaaaccuacggugacaucgaaguagaccucaaagacaccgacaaguccagcacauacacccuacgcgucuucgagcucagacauuccaaacgaaaagacucccgcaccguuuaccaauaccaauacacaaacugguccguagaacaacuuccugcagagcccaaagaacucaucucuaugauccaagucguaaaacaaaaacugccccagaaaaacucguccgagggcaacaaacaccacaaauccacgccccuacugauucauugcagagacgguucccaacaaaccgguaucuucugcgcccuccuaaaccuccucgaaucagccgaaaccgaagaagugguggacaucuuccaagucgucaaagcucuccgcaaggcacgacccggaaugguuagcacauucgagcaauaccaguuccucuacgacguuauagcuagcacauacccagcacaaaauggccaggucaaaaagaacaaccaccaagaggacaaaauagaguucgacaacgaaguagacaaagugaaacaagacgccaacugcgucaauccccucggagccccugaaaaacucccagaagccaaagaacaggccgaaggcucagaacccaccucuggcacggagggaccugagcacagcgucaacggaccagcaucaccagcccuaaaccaggguagcuaa

SEQ ID NO: 2245 - RNA, 765 nt, Artificial Sequence
  P08637
auguggcaacuccuacuccccaccgcccuacuccuacuagucuccgccggaaugcgaaccgaagaccuccccaaagccgucgucuuccucgaaccccaaugguaccgaguccuagaaaaagacuccgucacccucaaaugccaaggcgccuacucccccgaagacaacuccacccaaugguuccacaacgaaucacucaucuccucccaagccuccuccuacuucauagaugccgccaccgucgacgacuccggcgaauaccguugccaaacaaaccuaucaacccucuccgaccccguacaacuagaaguacacaucggcuggcuccuccuccaagccccccgaugggucuucaaagaagaagaccccauccaccuacguugccacuccuggaaaaacaccgcacuccacaaagucaccuaccuccaaaauggaaaaggacgcaaauacuuccaccacaacuccgacuucuacauccccaaagccacccucaaagacuccggcuccuacuucugccgcggacucuucggauccaaaaacgucuccuccgaaaccgucaacaucacaauaacacaaggccucgcagucuccaccaucucuuccuucuucccccccggauaccaaguaucauucugccuuguaaugguccuacucuucgccgucgacaccggccucuacuucuccgucaaaaccaacauccgcuccucuacucgcgacuggaaagaccacaaauucaaauggcgaaaagacccccaagacaaauga

SEQ ID NO: 2246 - RNA, 663 nt, Artificial Sequence
  P10747
augcuacgccuccuauuagcccuaaaccucuucccuuccauccaagucaccggaaacaaaauccuagucaaacaaucaccuaugcucgucgccuacgacaacgcagucaaccuuuccuguaaauauuccuacaaccucuucucccgcgaauuccgcgcaucacuccacaaaggccucgacuccgcagucgaagucugugucguauacggcaacuacucccaacaacuccaaguauacuccaaaacaggcuucaacugcgacggcaaacuaggcaacgaauccgucacauucuaccuucaaaaccucuacguaaaccaaacagacauauacuucugcaaaaucgaagucauguaccccccacccuaccucgacaacgaaaaauccaacggaacaaucauccacgucaaaggcaaacaccuaugccccucaccccucuuccccggcccauccaaacccuucuggguccucgucguagucggcggaguccuagccugcuacucccuacucgucaccgucgccuucauaaucuucuggguccgcuccaaacgcucacgacuccuccacuccgacuacaugaacaugacaccacgccgccccggccccacacgcaaacacuaccaacccuacgcccccccccgcgacuucgccgccuaccgcuccuga

SEQ ID NO: 2247 - RNA, 681 nt, Artificial Sequence
  P11912
augcccggaggccccggcguacuccaagcccucccugcaacaaucuuccuccucuuccuccucuccgcagucuaccucggccccggcugccaagcccucuggaugcacaaaguccccgccucccucauggucucacucggcgaagacgcccacuuccaaugcccacacaacuccucaaacaacgccaacguaaccugguggcgcguccuccacggaaacuacaccuggccccccgaauuccucggccccggcgaagaccccaacggaacacucaucauacaaaacguaaacaaaagccacggaggcauauacgucugcagaguacaagaaggcaacgaaucauaccaacaauccugcggcacauaccuacgaguccgacaaccacccccccgcccauuccucgacaugggcgaaggcaccaaaaaccgcaucauaaccgccgaaggcaucauccuccucuucugcgccgucgucccaggcacacuccuccuauuccgcaaacgcuggcaaaacgaaaaacuuggacucgacgccggugacgaauacgaagacgaaaaccuauacgaaggccucaaccucgacgacugcuccauguacgaagacaucucccgcggacuccaaggcaccuaccaagacguuggcucccuaaacaucggcgacguccaacuagaaaaacccuga

SEQ ID NO: 2248 - RNA, 1671 nt, Artificial Sequence
  P15391
augccacccccacggcuacucuucuuccugcuguuccuuacccccauggaaguacgccccgaagaaccccuagucguaaaagucgaagaaggcgacaacgcuguccugcaaugccuaaaagggacaagcgacggacccacacaacaacuaaccuggucaagagaauccccucuuaaacccuuccuaaaacuaucucucggccucccaggacucggcauccacaugagaccccuagccaucuggcuauucauuuucaacgucucccaacaaaugggcggcuucuaccuaugccagcccggcccacccagcgaaaaagcguggcaacccggauggacaguaaacgucgaaggcagcggcgaacucuucagauggaacguaucagaccuuggcggccuaggcugcggccucaaaaaccgcucaucagaaggccccagcagccccagcggcaaacucaugucacccaaacuauacgucugggcaaaagacagacccgaaauaugggaaggggaaccaccgugccugccaccccgagacucacuaaaccaaagccuuagccaagaccuaacgauggcacccggauccacacuauggcuauccugcggcguuccacccgacucaguaagccguggaccccucuccuggacacacguccaccccaagggaccaaaaucccuacuaagccucgaacugaaagacgaccggcccgcacgcgauaugugggucauggaaacgggccuacuacucccccgagccacagcacaggacgcaggcaaauacuacugucaccgcggcaacuuaaccaugagcuuccaccuagaaauaaccgcacgcccaguacucuggcacuggcuacuccgcaccggcggauggaaagucuccgcaguuacccuagcauaccuaaucuuuugccuaugcucgcucguaggcauccuacaccuccaacgcgcccucgugcucagacggaaacgcaaacgcaugacagaccccacacggagauucuucaaaguaaccccaccacccggcucaggcccccaaaaccaauacggcaauguccuaucccuaccuacaccuacaucagggcuaggccgagcccaaagaugggcagcaggacucggcggcaccgcccccaguuacggcaaccccucaagcgacguccaagccgacggggcacucggcucccgauccccgcccggagucgggcccgaagaagaggaaggagaaggauacgaagaacccgacucagaagaagauagcgaguucuacgaaaacgacuccaaccucggacaagaccaacuuucccaagauggaagcggcuacgaaaaccccgaagacgaacccuuaggccccgaagacgaagacucauucuccaacgcggaaucauacgaaaacgaagacgaagaacuaacacaaccagucgcacgaaccauggacuuccucucaccacacgggucagccugggacccaagccgagaagcaacuagccugggaucccaaagcuacgaagacaugcgcggaauacucuacgcagcaccccaacuccgaaguauaagaggacaacccggccccaaucacgaagaagacgccgacagcuacgaaaacauggacaacccagauggcccagacccagccuggggcggaggcggccgaauggggacuugguccacuagauaa

SEQ ID NO: 2249 - RNA, 672 nt, Artificial Sequence
  P16410
auggccugucucggcuuccaacgccacaaagcccaacuuaaccuagcaacucgcaccuggcccugcacccuccucuucuuccuacuauucauccccgucuucugcaaagccaugcacgucgcacaacccgcagucguccucgccuccucacguggcauagcauccuucgucugcgaauacgccucccccggcaaagcaacagaaguccgagucaccguccuccgccaagccgacucccaagucacagaagucugcgccgcaacauacaugaugggcaacgaacuaacauuccucgacgacuccaucugcacaggcaccuccuccggcaaccaagucaaccucacaauccaaggccuccgcgccauggacacuggccuauacauaugcaaagucgaacucauguacccaccucccuacuaccucggcauaggaaacggcacccaaaucuacguaauagaccccgaacccugccccgacucagacuuccuccucuggauccucgcagccgucucauccggccucuucuucuacucuuuccuccucaccgccgucucacucuccaaaaugcucaaaaaacgcucaccccucacaaccggagucuaugucaaaaugccccccaccgaacccgaaugcgaaaaacaauuccaaccauacuucauccccaucaacuga

SEQ ID NO: 2250 - RNA, 1419 nt, Artificial Sequence
  P16671
augggcugcgaccgaaacuguggucuaaucgccggcgccgucaucggcgccguccucgcaguauuuggcggcauccucaugcccguaggcgacuuacucauacagaaaaccaucaagaaacaagucguccuagaagaaggcaccauagcauucaaaaacugggucaaaacgggcaccgaagucuaccgccaauucuggaucuucgacguccaaaacccccaagaagucaugaugaacuccuccaacauacaagucaaacagagaggaccguacacauaucgcguccgcuuccuugccaaagaaaacgucacccaagacgcugaagacaacaccgucuccuuccuccaaccaaacggcgcaauauucgaacccucacucuccgucggcaccgaggccgacaacuucacuguacucaaccuggccguugccgcagccucccacauauaccaaaaccaauucguacaaaugauccuaaacucacucaucaacaagagcaaaucguccauguuucaaguacgcacacuccgcgaacuccucuggggguaccgcgaucccuuccucagccucguccccuacccagucaccaccacagucggccucuucuacccuuacaacaacaccgccgacggagucuauaaagucuuuaacggcaaagacaacaucucaaaagucgccaucaucgacaccuacaaaggaaaacgcaaccucuccuacugggaaucacacugcgacaugaucaacggcaccgacgccgcguccuucccgcccuucguggaaaagucacaagugcuucaauucuucucauccgacaucugccgcuccaucuacgcagucuucgaaagcgacgucaaccucaagggcauccccgucuaccgcuucguacuccccucaaaagccuucgccucacccgucgaaaacccagacaacuacugcuucugcaccgagaaaauaaucaguaaaaacugcacauccuacggcguacucgacauauccaaaugcaaagaaggacgccccgucuacauaagccucccccacuuccucuacgcaucaccggacgucuccgaacccauagacggccugaacccuaacgaagaagaacaccgaaccuaucucgacauagaaccuaucaccggcuucacccuacaauucgccaaacgccuccaaguuaaccuacucgucaaaccauccgaaaagauacaaguacucaaaaaccuaaagcgaaauuacaucgucccaauccuuuggcucaacgaaaccggaaccaucggcgacgaaaaagcaaacauguuccgaagccaggucaccgguaaaauaaaccuacuaggccucauagaaaugauucuccucuccguaggcgucguuauguucgucgccuuuaugauaucauacugcgccugccgcuccaaaacaaucaaauga

SEQ ID NO: 2251 - RNA, 651 nt, Artificial Sequence
  P26718
augggcuggauccgcggccgcagaagccgacacuccugggaaaugucagaauuccacaacuacaaccucgaccuaaaaaaauccgacuucuccacccgauggcaaaaacaacgaugcccagucguaaaaucaaaaugccgcgaaaacgcaagucccuucuucuucugcugcuucauagccguagcaaugggcauccgauucaucaucauggucgccaucuggagcgcagucuuccucaacagccucuucaaccaagaaguccaaaucccauuaacagaaucauacugcggccccugccccaaaaacuggaucugcuacaaaaacaacugcuaccaauucuucgacgaauccaaaaacugguacgaaucccaagccuccugcaugagccaaaacgccucccugcucaaagucuacuccaaggaagaccaagaccuccuaaaacucgucaaaagcuaccacuggaugggacucguacacauccccacaaacggcagcuggcaaugggaagacggcucaauccucagccccaaccugcucacaaucaucgaaaugcaaaaaggagacugcgcccucuacgccuccuccuucaaaggcuacauagaaaacugcuccaccccaaacacauacaucugcaugcaaagaaccgucuaa

SEQ ID NO: 2252 - RNA, 261 nt, Artificial Sequence
  P30273
augauccccgccgucguccuccuccuccuacuccuagucgaacaagccgccgcccuaggagaaccccaacucugcuacauccuagacgccauccucuuccuauacggcaucguccucacccuccuauacugccgccuaaaaauccaaguccgcaaagccgccaucaccuccuacgaaaaaucagacggcgucuacaccggccucuccacccgcaaccaagaaaccuacgaaacccucaaacacgaaaaaccaccccaauag

SEQ ID NO: 2253 - RNA, 1137 nt, Artificial Sequence
  P32248
auggaccucggcaaacccaugaaauccguccuagucgucgcccuccuagucaucuuccaagucugccucugccaagacgaagucacagacgacuacaucggcgauaacacuaccgucgacuacacccuauucgaaucccucugcuccaaaaaagacguacgcaacuucaaagcaugguuccucccaauaauguacuccauaaucugcuucgucggccuccuaggaaacggccucgucguccuaacuuacaucuacuucaaacgccucaaaaccaugaccgacacguaucuacucaaccucgcaguagccgacauacucuuccuccuaacccuccccuucugggccuacucagcugccaaaucuugggucuucggaguacacuucugcaaacucauauucgccaucuacaaaauguccuucuucucaggcaugcuucuccuuuuaugcaucucaauagaccgcuacguagccauuguccaagccgucuccgcccaucgccaccgcgcccguguccuccucaucuccaaacuaucaugcgucggaauauggauccucgcuacuguccucuccauccccgagcuacucuacucagaccuccaacgcuccuccagcgaacaagccaugagaugcucccucaucacugagcacgucgaagccuucaucacaauucaaguagcccaaauggucaucggauuccucgucccacuucucgccauguccuucugcuaccucgucaucauccguacccuacuucaagcccgaaacuucgaacgcaauaaagccaucaaaguuauaauagccgucgucgucguauucaucgucuuccaauuacccuacaacggcgucguccucgcucaaacagucgcaaacuucaacaucaccuccuccaccugcgaacucuccaaacaacucaacaucgccuacgacguuaccuacucccuagccugcguccguugcugcgucaaccccuuccucuacgccuuuaucggcgucaaauuccgcaacgaccuauucaaacucuucaaagaccucggcugccuuucccaggaacagcuccgacaaugguccuccugucgacacauacgccgcuccuccauguccguagaggccgaaaccaccaccacauuuucucccuga

SEQ ID NO: 2254 - RNA, 690 nt, Artificial Sequence
  P40259
auggcccgccuagcccucucccccguccccucacacuggauggucgcccuccuacuccuccucucagcagaacccguccccgccgccagauccgaagaccgcuaccgcaacccaaaaggaagcgccugcucacgcauauggcaaagcccccgcuucaucgcccgcaaacgcggcuucacagucaaaaugcacugcuacaugaacuccgccuccggcaacgucuccuggcuauggaaacaagaaauggacgaaaacccccaacaacucaaacucgaaaaaggccgcauggaagaaucccaaaacgaaagccuagccacccucaccauccaaggcaucagauuugaagacaacgggaucuacuucugccaacaaaaaugcaacaacaccuccgaaguauaccaaggcugcggcaccgaacuccgcgucaugggauucuccacccucgcccaacucaaacaacgcaacacccucaaagacggcaucaucaugauacaaacacuccuaauaauccucuucaucaucguccccaucuuccuccuacucgacaaagacgacuccaaagccggcauggaagaagaccacaccuacgaaggccucgacaucgaccaaaccgccaccuacgaagacaucgucacacuacgcaccggagaaguaaaaugguccgucggagaacaccccggacaagaauga

SEQ ID NO: 2255 - RNA, 990 nt, Artificial Sequence
  P42081
auggacccccaauguaccaugggccuuagcaacauccuauuugucauggccuuccuccucucaggcgcagcaccccucaaaauccaagccuacuucaacgaaaccgcagaccuacccugccaauucgcaaacucacaaaaccaaucccuauccgaacuagucgucuucuggcaagaccaagaaaaccuaguccucaacgaagucuaccugggcaaagaaaaauucgacuccguccacuccaaauacaugggccgaaccucauucgacuccgacuccuggacacuccgccuccacaaccuccaaaucaaagacaaaggcuuguaccaaugcauaauccaccacaaaaaacccaccgguaugauccgcauacaccagaugaacucagaacucuccguucucgccaacuucucccaacccgaaauugucccaauaucaaacauaaccgaaaacgucuacaucaaccuuaccugcagcucuauccacggauaccccgaacccaaaaaaauguccguacuccuccgcaccaaaaacuccaccaucgaauacgacggcguuaugcaaaaaucccaagacaacgucaccgaacucuacgacgucuccaucuccuuauccgucuccuuccccgacgucaccuccaacaugacaaucuucugcauccucgaaaccgacaaaacccgccuccuaucaucccccuucucaaucgaacucgaagacccacaacccccccccgaccacauccccuggauaaccgccguccuccccacugucaucaucugcguaauggucuucugccucauccuauggaaauggaaaaaaaaaaaacgcccccgcaacucauacaaaugcggcaccaacacaauggagcgcgaagaauccgagcaaaccaaaaaacgagaaaaaauccacauccccgaacgcuccgacgaggcccaacgcgucuucaaaucauccaaaaccagcucaugcgauaaauccgacaccugcuucuga

SEQ ID NO: 2256 - RNA, 1011 nt, Artificial Sequence
  Q15762
auggacuaccccacccuccuccuagcccuccuacacgucuaccgcgcccucugcgaagaaguccucuggcacaccucugucccauucgccgaaaacaugucccuggaaugcgucuacccuuccaugggcauccucacccaaguagaaugguucaaaaucggaacccaacaagacuccauagccaucuucuccccaacccacggcauggucauucgcaaacccuacgcugaacgcguuuacuuccuaaacagcaccauggccuccaacaacaugacucuauucuuccgcaacgccuccgaagacgacguaggauacuacucaugcucccuauacaccuacccccaaggcaccuggcaaaaagucauacaagucguccaaucugacagcuucgaagcagccguccccuccaacucccacauaguaucggaacccggaaaaaacgucacccucaccugccaaccccaaaugacauggcccguccaagcaguccgaugggaaaaaauacagccccgccaaaucgaccuccucacuuacugcaaccucguacacggccgcaacuucaccuccaaauucccacgccaaaucgucucaaacugcucccacggucgcugguccgucauaguaauacccgacgucaccgucucagacuccggacucuaccgcugcuaccuccaagccuccgcaggcgaaaacgaaaccuucgucaugcgccucaccgucgccgaaggaaaaacagacaaccaauauacacucuucguagccggcggcacaguccuccuccuacucuucguaaucucuaucacaaccaucaucguaaucuuccucaaccgccgccgccgccgcgaacggcgagaucuauucacagaaucaugggacacucaaaaagcacccaacaacuaccgcucaccaaucagcacuucccagcccacaaaccaauccauggacgacacccgcgaagacauauacgucaauuaccccaccuucuccagacgaccgaaaacucgcgucuga

SEQ ID NO: 2257 - RNA, 13482 nt, Artificial Sequence
  Q685J3
augccucgcccgggcaccauggcgcuaugcuuacucacccugguucucucucugcuaccaccccaagcugcggcugaacaagaccuuuccguaaauagagccgugugggacgggggaggaugcauaucgcagggcgauguuuugaaccgacagugccagcaacugagucaacaugugcguacagguuccgcugccaacacugcaaccggaaccacuuccacgaacguaguugaaccgagaauguaucugucaugcagcaccaaccccgaaaugacuucgauagaauccuccgugaccuccgacacucccggggucucuucgacuaggaugaccccuacugaaucccguaccaccucugaaucgaccucagacucuaccacgcuuuuccccuccuccaccgaagacaccucgucccccaccaccccugaagggaccgacguccccaugagcacccccucagaagaauccaucucuuccaccauggccuucguuuccacagccccucuuccgaguuuugaagccuacacaucccuuacuuacaagguggauauguccacuccccuaacuaccucgacucaagcauccucaagccccacuacacccgaaucuacuaccauaccgaagucuaccaacucagaaggauccacgccccugaccucgaugcccgcauccaccaugaaaguagcaucaucugaagcgauuacgcuucucaccacccccgucgaaaucagcacuccuguaaccaucucagcucaggcaucaucgucccccacuaccgcagaaggacccagccuguccaacuccgcgccaaguggaggcucuaccccucugacaaggaugccucuauccguaaugcucguuguauccagcgaagcguccacacugucgaccacucccgcggcuacaaauauuccaguaaucaccagcaccgaggcuuccuccucaccuaccacagcagaaggaacuucaaucccuaccucaaccuacacggaagguuccacgccacuaaccucaacaccggcuucuaccaugccuguagcaaccucugaaauguccacccucucaaucacaccuguagacaccuccacccucguaacaacaucgacugaacccagcagucugccuaccacggcugaagcgaccuccauguuaaccaguacacucucggaaggcucaacaccccugaccaauaugccaguaucuaccauccuggucgcaucaucugaagcauccacaacuuccacuauaccagucgacucaaagaccuuuguaacuacggccuccgaagccucuagcagccccaccacugccgaagacaccucuauugccacguccacacccuccgaaggaucaacaccacuuacaucuaugccagucuccaccacgccugucgccuccucugaagccaguaaucucucuacuacccccguagauuccaaaacacaaguaaccacgucaacagaagcgucgagcucaccgccuacugcugagguaaacucuaugccgaccucuacaccuagugaaggaagcacuccccucaccucaaugaguguaagcacuaugcccguugccuccuccgaagcgucuaccuuaucaacaacaccagucgacacgucgaccccuguaaccaccucgagcgaagccuccucuucguccacgacacccgaggggacaucaauccccacuucaacaccaucugaaggaucgacacccuugacgaacaugcccguguccacaaggcuaguaguaucaagugaggcuucaacuaccuccacuacgccagccgacaguaauaccuucgugacuaccagcucagaagcguccaguucaucaacuacugcagaagggaccucaaugccaaccaguacuuacucugaacgggguacaacuaucacaaguaugagcgucaguacaacguuagucgcgucgagcgaagcauccaccuugucgaccacacccguugauucaaacaccccaguaacaaccuccacagaagcgacuuccucaucuacuacugcagagggaacuagcaugcccaccucuaccuacaccgaaggcagcaccccucucacuuccaugcccguaaauacaacuuuagucgccucaucagaggcuucaaccuuaucaacaacuccaguggacacgagcacucccguuacaacuuccacugaggccucguccuccccaacuaccgcugacggcgccucuaugccaacgucuaccccaucagaaggaucaaccccucuaacaucuaugccaguaucaaagacccuccuaacaaguucugaggcuuccacacuauccacaacaccccuggauacaucuacgcauaucacaacuucgaccgaagcaagcugcucacccacaaccacugaaggaaccagcaugcccaucucaaccccaucugaaggcucgccgcuacuaaccucaauuccuguaucgauuacccccgugacgagcccagaggcaucgacccugucuacuaccccggucgacucaaacuccccagugaccaccucgacggaaguuagcucguccccuacucccgcugaaggaaccucaaugccuacaucgacauacucggaaggucggaccccucucacgagcaugccagucuccacuacccuugucgccaccucggcgaucucuacacugucaacaacacccgucgauaccuccacaccuguaaccaauucaacagaggcgcgaucgucucccacgacuuccgaaggcacaaguaugccuacaucuaccccaggcgaagggaguacaccacuaacauccaugccagauagcaccacgcccgucguauccuccgaagcccgcacccucucagccacgcccguugacaccuccacccccguuaccaccuccaccgaagccacaucgucccccacuacagccgaagguacuuccauccccacuagcacaccuucggaaggaaccacuccccucacuucaacucccguuagucauacucuaguggcaaacucagaagcaucaacacucucgaccaccccaguugacucgaacacucccuugaccacaaguaccgaagccucuaguccuccacccaccgccgaaggaacuuccaugcccacaucaacgcccagcgaaggaagcacaccacuaacccgcaugccagucucaaccacaauggucgcuuccucugaaacgucaacacuaucaacuacuccugcagauacguccacacccguuaccacuuauagccaggcauccucuucuucaaccacugccgacggcaccuccaugccuacuucaacauauucggaaggcaguacaccucuuaccuccguacccguuucuacuagauuggucgucagcuccgaggcauccacgcuaagcacuacuccaguugacaccuccaucccggugacuacaagcaccgaagccagcucaucaccuacuacagcggagggaaccuccauucccacuagcccacccucugaaggaacaacaccgcuagcaucuaugccugucucaacaacccuuguuguaagcucagaagcaaacacacuuucgaccacaccggucgauucuaaaacucaaguugcgacgucaacagaagcgucaucgccacccccaaccgcagaggugaccuccaugccaaccuccacccccggggaacgcuccacuccauugacgagcaugcccgucagacacacaccuguagcgucgucagaggcguccacgcugucuacaucuccugucgacaccucaacaccuguuaccacuuccgccgaaaccuccucgucucccacuacggccgaaggcaccucucucccaaccucuacgacuuccgagggaucgacccuucugaccucgaucccggucucaacaacacucgucaccuccccagaagcauccaccuuacucacaacaccaguggacacgaaaggucccguggucacuucaaacgaaguuuccagcucccccacucccgccgagggcacuucuaugccaacauccaccuauuccgaaggucguaccccguuaaccucaaucccggucaauacuacacuuguagcaaguagcgccaucagcaucuuaagcacgacaccaguugauaauucgaccccaguaacuacgucaacagaagccuguucuuccccuaccacuagcgaagguacuucaaugcccaacagcaauccgucggaaggcaccacgccucugaccuccaucccugucuccacgacuccgguuguaagcucugaagcguccacccuuucagccacuccagucgauacuucgacccccgggacaaccucggcagaggcgacaaguucuccuacaaccgccgaaggcauuucaaucccuacgucaacccccucugaaggcaagacuccacucaaauccaucccugucucaaauaccccuguagcuaacucagaagcguccacgcucucaacuacccccguggauagcaacucgccuguaguuacgucgacggcuguuucaucauccccgacucccgccgaaggcacaucuauagcaauuucaacgccgucugaagguagcaccgcacuuacuucuauacccguuuccacgacaacaguggcuaguagcgaaauaaacucccuauccacaacacccgcgguuaccucuacuccagugaccaccuacucacaagcauccaguuccccgacaacagcugacggaaccuccaugcaaacuuccacauauucggaagguuccacaccccugaccucccucccgguauccacaaugcuuguaguuucaagcgaggccaauacucugucaacuacucccauugacaguaagacucaagucaccgcuuccaccgaagcauccuccaguaccacagcugaaggaucauccaugaccaucagcacgccuucagaagguucaccacuucuuacuagcauaccgguauccaccacucccguggcuucgcccgaggcuucaacccuaaguacaacuccuguugauaguaacucaccggucauaaccucaacagagguuuccuccucucccacaccggccgaggguacgagcaugccgacaucuaccuacacagaggggaggacaccacugaccagcaucacuguucgaacuacucccguugccuccucugcuaucucgaccuuauccacuacgccuguagacaacucgacuccgguuaccaccucuacggaagccagaucauccccuaccacgucagaggguacuucaaugccaaauaguacacccucagaggggacgacgccccucaccucaauuccagucucgacaacccccguucugaguucugaggcuucgacccuuucggccaccccaauagacacaucaacaccagucacaaccagcacugaagcaaccucaucaccuaccaccgccgaaggcacuucuauacccacgagcacacuaucugaaggaaugacaccccuaacauccaccccagucucucacacacugguagcgaacucagaggcuuccacucucucaacaaccccaguagacagcaacuccccagucguaacaaguaccgccgucucaucaagucccaccccugccgagggcacgucaaucgccaccucuaccccuagugaaggguccaccgcucuaacgucaaucccuguaucaacuacuacagucgccucuucugaaacuaacacucucuccacuacgccagccgugacaucaacucccguuacgaccuaugcacaagucucaucuucccccaccaccgcugaugguagcaguaugcccacaaguacgccgagggaaggucggcccccucuuaccucaauccccguaucaacuaccaccgucgccucaagugagaucaauacccuaagcacuacccuggcugacacccggacccccguaacgaccuacucacaagcaaguucaagucccacgaccgcugauggcacaagcaugcccacuccugcauacagcgaagggucuacgccacuuacgagcaugccccucucuaccacucuugucgucagcagugaggcuucaacucuaucgaccaccccaguugauacauccacuccagccaccaccucuacugaaggcucgucaaguccgacuaccgccggcggcacuagcauccaaacguccacgcccuccgaacgaaccacaccacuagcgggcaugccagucucuacgacccuuguuguaucgagcgagggaaauacacuuuccacuacgccuguagauucaaaaacccaggucacaaacagcacagaggcaucgagcucugcuaccgcagaaggcuccucaaugacaaucucugccccauccgaaggcagcccccuucuaacuucaauaccgcuauccacuaccccgguagcaucuccugaggcuuccacacuuuccacaacaccaguagacuccaacucaccagucauaacaucaacagaaguuuccuccuccccuaucccgacagaagggacuuccaugcagaccuccacauacucugaucgucgaacuccacuaacaaguaugccugucuccacaacagucguagcuuccuccgcaaucucuacgcucucaacuaccccaguggauaccucaaccccaguaacaaauucaacugaagcccgcucaucaccuaccacuucagaagguacauccaugcccaccaguacccccuccgagggauccaccccguucacaagcaugccgguaucuaccaugcccgucgucacuucagaggccuccacccuaucagcaaccccaguugacaccuccacacccguaaccaccucgacugaagcgacauccucaccaacgaccgccgaagguaccuccauccccacaucaacucucucagaaggaaccacaccccuuaccucuaucccagucucccacaccuuaguagcaaacucagaggucuccacucuuucaacaaccccaguggacucuaacacucccuuuacgacguccacugaggcuucuucaccuccaccgaccgcggaagguaccucaaugccuacaaguacuucuucugaaggcaauacuccucuaaccagaaugcccgucucaaccaccaugguagcgucauucgagacuucaacccuaucaacgacuccagcggacaccagcacacccguaaccacauacucccaagccgguucuucacccaccacagcagaugauacgucuaugccaacuucgaccuacucugaaggcucgacaccccucaccucagucccugucucuaccaugccugucguuucaucagaggcuucgacccauucuacaaccccagucgauacaagcacuccuguaacuacuuccaccgaagccuccucuucuccgaccacugcagaaggcacguccauuccaacaucuccaccgucggaaggaaccacaccgcuugcuuccaugcccgucucgaccacucccguggucuccuccgaggcugggaccuuauccaccacgcccguagacaccucuaccccgaugaccaccucaacugaggcauccaguuccccuaccaccgcggaagacaucguugugcccaucucgaccgccucagaagguagcacacuacucaccucgauuccaguguccacgacgccuguugcaagccccgaagccaguacgcuaucaaccaccccuguggauagcaacuccccgguugucaccucaacggagauaaguucauccgccaccucggccgaggguaccucgaugccuacuuccacguauucggagggcuccaccccucuacggucuaugccagucucuacaaaaccccuagccucuagcgaagccucgacccuaucuacaacaccaguugacaccuccauaccugucaccacgucaaccgaaacuucuuccucucccaccacggcaaaagacaccucaaugccuaucucaaccccuucugaaguuuccaccucgcucacguccauucugguaucuacaaugcccguugccagcucugaagccuccacucuaucgacaaccccaguagauacccggacucuggucacaacaucuaccggcaccuccucuaguccuacaaccgcugaaggcuccucaaugccaacguccaccccaggagagcgcucaacaccccuaacgaacauucuaguaucuacuacauuauuggccaacuccgaggcuucgacucucucgacgacgcccguugacacauccacaccagucaccacauccgccgaagccucuagcuccccgaccaccgcagaagguacaucuaugcgaauuucuacccccucggacggaucaacuccucucacaaguauuuuagucucgacuuugccaguugcaucaucugaagccucuaccgucuccacaacugccgucgauacaucgaucccagucaccacaucaacagaagcguccucuucuccgacgaccgcagaagucacaucgaugccuacgaguacuccgagugaaacauccacuccacuaacgucaaugcccguaaaccacacaccaguagccucguccgaagccgguacgcugucaacaacaccuguugauacuuccaccccgguaacaacuucaacgaaagcauccucaucgcccacgacggcagaggguauuguuguucccaucucuaccgccucggaaggcucgacguuacuuaccucuauucccguuaguacuacccccguagcaucuucugaggcaucuacacuaucuaccaccccgguugacacuucuauccccguuacaacuucuaccgaaggaaguucauccccaacuaccgccgaaggcacuucuaugccaauuucaaccccuagcgaaguuuccacaccucugacaucaauucuagugucuacggucccuguggcagguagugaagccuccacgcucagcacaaccccaguagacacucggaccccuguaacuaccucagccgaagcaucaucaagucccaccaccgccgaaggcacuagcaugccaaucucuacccccggcgaaaggaggacacccuuaaccucaaugucagugucaaccaugccuguugccuccagcgaagcaaguacacuaucacgaaccccagccgauacgucaacaccaguaacuaccuccacagaagcguccuccaguccuaccacugcagaggguacaggcauccccauaagcacgccaagugaaggcuccacaccacugacaucaauaccaguuagcacaacccccguagcaaucccugaagcaucaacacucucgaccacccccguugacagcaauuccccagucgucaccucuaccgaggucucaucgucacccacacccgcggaggguacauccaugcccaucaguaccuauagcgaggguucuacgccacugaccggcguacccgucucuacaacaccgguaacaagcagcgcuauuuccacccuuuccaccacucccguagacaccucuaccccggucacaacaucaacggaggcccauucaucuccuacuaccucugaaggcaccucuaugccaacaucuacucccucugaaggcucaacaccucucacuuacaugccggucucgaccaugcucguggugucgucugaggauucuacccuaucugccacaccggucgauacuucgacucccgugacaacaagcaccgaggcaaccucauccacuaccgccgaaggcacguccauuccgaccucaacaccauccgagggcaugaccccgcugacuuccguacccguuucgaacacaccaguugcuuccucagaagcgucaauucuguccacaaccccaguugauagcaacaccccucucacgaccucaacugaagcuagcuccucaccaccuacagcagagggaacaucgaugcccacaucaacuccauccgaggggucgacaccucuuacuuccaugcccgugucgaccacaacaguggccucuagcgaaacauccacacucuccacaacuccggcggacacaucuacacccguaacgacguacagucaagcaucgucaucgccacccauagcagaugggacauccaugccaacuuccacauacucagaagguuccacuccucugacaaauaugucuuuuucgacaacucccguggucuccucggaagcaucaacccuaucgaccaccccaguagacacaucgacgcccguaaccaccucuacagaggccucacugucgccaacgacagccgaggguacuucuaucccgacuucaagcccuuccgaaggaacgacgcccuuggcguccaugccugucucuacaacgccuguggugucgucagaaguaaacacucuuucuaccacccccguagacucuaauacacuugugacgacuucuacggaagccuccaguucccccacgaucgcagaagggaccagcuuacccaccaguaccaccucggagggguccacaccacugucgaucaugccgcuaucaaccacaccaguugcuagcucggaggcauccacgcuaucaacaaccccaguugauacauccacucccgugaccaccucaucccccacaaacucuuccccuacuacagcagaggugacguccaugcccacaagcacagcgggagagggcuccacaccccuaacgaauaugccaguaaguaccacgcccguugccagcucggaagcguccacuuuaucaacaaccccggucgacagcaacacuuuuguuacaucauccucacaggcauccuccuccccagccacauuacaaguuaccacgaugcgaaugagcacgccguccgaaggcagcucgagccuuacuacgaugcuacuaucgagcacguaugucacaagcucggaggcuuccacccccaguaccccaucuguagaccgaucuacuccugugacaaccucaacccaauccaacucuacuccaacaccaccggagguuauuacucuacccauguccacgcccucagaagucagcaccccucugaccauaaugccaguauccacgacaagcguuacaauuagugaagcugggacagccuccacccucccuguugacacuagcacuccaguaauaacaaguacacaaguaucaaguagcccuguaacucccgaaggcaccacgaugcccauauggacgccuucagaagguucaaccccucuuacaacaaugcccguauccacuacacgggucacaucaagcgagggguccacacugucaacaccaucggucguaaccucgacuccagucacgaccucuacagaagccauaucuaguuccgcuacccuugacagcaccacaaugagugucucuaugccaauggagauaucuacucucggcaccaccauacuggucuccacaaccccaguuacucgcuucccggagagcuccacaccauccauaccuuccguauauacgagcaugucuaugacaacagccucagaagguuccucuuccccgacgacccuagaaggaacaaccaccaugcccaugaguacuacauccgaaagaagcacccuccuaacaacgguccuaaucucuccaauauccgucaugucaccaagcgaggccagcacauuaucaaccccaccuggugauaccuccacgccgcuucucaccucaacaaaagccgggucauuuuccauccccgcugaagucacuacgauccggauuucuauaacgagugagcgcagcacuccccucacgacccuccuugucagcaccacacuuccaacaucuuuuccaggugcgagcauagcaucaaccccuccccuugauacauccacaacuuucacuccuucgacagacacagcauccaccccuacuauccccguagccaccacgaucuccgugagcguuaucaccgaagggucgacaccaggaacgacgaucuucauuccaucaacgccagucacuuccucuacggccgacguguuccccgcaaccacaggagcagucucaacaccagucauaacaucuaccgaacucaacacgccgucaacuuccucaucuuccacaacuacgucauucucaacuacaaaagaguuuaccacaccagcuaugacuacagcagccccgcuaacuuacgucacuaugucuacugccccaucaacuccuagaacgaccucccguggcugcacuacgucggcuaguacuuuauccgccacaucaacuccccauaccagcacuagcguuacaaccagacccguuacaccuucgagugaaucuagccgcccuucuacgauaaccucacauacgaucccaccuacguuuccgccagcucacucguccacgcccccaaccacaagcgccuccaguaccacuguuaacccagaggccguuaccacuaugacaacacgcacgaagcccuccacccgcacaaccagcuucccuacuguaaccaccacugcuguccccaccaauacuacaaucaaguccaaucccacgucaacgcccaccguaccccgcacgaccacgugcuuuggugacgguugccagaacaccgccucaagauguaagaacggcggcacuugggacggccuaaaaugucaaugcccuaacuuauauuauggcgaauugugcgaagaagucguaaguuccauugauauaggucccccggaaacgaucucagcccaaauggagcugacugucaccgugacuuccguuaaguuuacagaggaacucaagaaccauuccagccaagaguuccaagaguucaaacaaaccuuuaccgaacagaugaauauaguauauucuggcauaccagaguacgugggagugaacauuacaaaacuacgccuaggaucuguuguagucgagcacgauguucuccuccgcacgaaauacacccccgaauauaaaaccguccuagacaaugccacagagguagugaaggagaaaaucacuaaagucaccacacagcaaaucaugauuaaugacaucugcagugauaugaugugcuucaacacaacagggacacaaguccaaaauaucacaguuacucaauaugauccagaagaagacugccgcaaaauggcaaaagaauacggcgauuacuucguaguagaguaucgggaccaaaaacccuacuguauaagccccugcgaaccgggauuuucgguguccaaaaauugcaaucuggguaaaugccaaaugucacucuccggcccucagugccuaugcgucacgaccgaaacccacugguacucaggggaaacguguaaucaggguacacagaaaagccuggucuacggccucguuggggcuggcguagugcuaaugcucaucaucuuagucgcccuccucaugcuggucuuccguagcaaacgggagguuaaacgacaaaaauaccgacuuucgcaauuauauaaguggcaggaagaagacucaggaccagcccccggaaccuuccagaauaucgguuucgauauuugccaagacgacgacuccauacaccucgaaucuauuuauucaaauuuccaaccuucccuucgucauauagauccggaaaccaagauccgaauacaacguccucaggugaugacuacuuccuuuuga

SEQ ID NO: 2258 - RNA, 1215 nt, Artificial Sequence
  Q9NNX6
augucggacucaaaagaaccccgccuccaacaacucggacuacucgaagaagaacaacuucgaggccucggauuccgccaaacacguggcuacaaaucccucgccggaugccucggccacggaccccucguacuacaacuccucuccuucacacuccucgccgggcuacucguccaagucuccaaaguucccucgagcaucagccaagaacaaucccggcaagacgcaauauaccaaaaccuaacccaguuaaaagcagccgucggcgaacugagcgagaaaagcaaacuacaagaaauauaccaagaacucacacagcucaaagccgcggucggcgaacuccccgaaaaauccaaacuccaagaaaucuaccaagaacucacacgccuaaaagccgccguaggcgaacuccccgaaaaauccaaacuccaagaaauauaccaagaacucaccuggcucaaagccgcaguaggcgaacuccccgaaaaauccaagaugcaagaaaucuaccaagaacucacacgacugaaagccgcaguaggcgaacuaccugaaaaaucaaaacagcaagaaaucuaccaagaacuaacccgccuaaaagccgcgguaggcgaacuacccgaaaaaucaaaacagcaagaaaucuaccaagaacuaacccgacuaaaagccgccguaggagaacuccccgaaaaauccaaacaacaagaaaucuaccaagaacucacacaacuaaaagcagcaguggaaagacucugccaccccugccccugggaauggaccuucuuccaaggcaacugcuacuucaugagcaacagccaaagaaacuggcacgacucaauaaccgcaugcaaagaagucggcgcccaacucguagucauaaaaucagcagaagaacaaaacuuccuacagcuccaauccagcagaagcaaccgcuucacauggaugggccucuccgaccucaaccaagaaggcacauggcaaugggucgacggcuccccacuccuccccucauucaaacaauacuggaacagaggcgaaccgaacaacgucggcgaagaagacugcgccgaguucagcggcaacggcuggaacgacgacaaaugcaaccucgccaaauucuggauaugcaagaaauccgccgccuccugcucccgcgacgaagaacaauuccucucaccagcccccgcaacccccaacccaccacccgccuga

SEQ ID NO: 2259 - RNA, 3126 nt, Artificial Sequence
  Q9NR97
auggaaaauauguuccuccaaucuuccaugcuaacauguaucuuccuacucaucuccggcuccugcgaacucugcgccgaggagaacuucucccgcucguaccccugcgacgaaaagaaacagaacgacagcgucaucgcggaguguuccaaccgccgcuuacaagaaguaccccagacagucgggaaauacgucacagaacucgaccuguccgacaauuucauaacccacaucaccaacgagagcuuccaaggccugcaaaaucucaccaaaaucaacuuaaaccacaaccccaacguacagcaccaaaacggcaaccccgguauccaguccaacggguuaaacauaacagacggcgcauuccuaaaccucaaaaaccuccgugaacuccuccuagaagauaaucaacucccacaaaucccguccggucugcccgagucacuuaccgagcugucccucauccagaacaacauauacaauauaaccaaagagggaaucucccgccuuauuaaccucaaaaaucuguaucucgcguggaacugcuacuucaacaaaguaugcgagaaaaccaacaucgaagacggaguuuucgaaacucuaaccaaccuggaacugcucucucuauccuuuaacucucugucccacguaccuccuaagcuaccuucuagccuccgcaaacucuucuuaucaaacacucaaaucaaauacauauccgaagaggacuuuaaaggccucaucaauuuaacccuccuagaccuuuccggcaacugcccgcguugcuucaacgcccccuucccaugcguacccugcgacgguggagccucgauaaacauagaccgauucgccuuccaaaaccugacucagcuccgauaccuaaaccucucuagcaccucuuuacgcaagauaaaugcugccugguucaaaaacaugccccaccucaaaguccucgaucuggaauuuaacuaccuagucggcgagaucgccucaggagccuuucucaccaugcucccgcgcuuagaaauacucgaccucucuuuuaacuauaucaaaggcucuuacccccagcacauaaacauaucccggaacuucuccaaacuacugucacuccgcgcccuucaccuccgcggcuaugucuuccaggaacuacgcgaagaugacuuccagccgcucaugcaguuaccaaacuugucaaccauuaaccuuggaaucaacuucauaaaacaaaucgacuucaaauuguuccaaaacuucuccaaccuagagaucauuuaccuuuccgaaaaccguaucuccccgcucgucaaagacacccgccagucauacgccaacagcuccucauuccaacgccacauccggaaacgacgguccaccgauuucgaauuugacccccacucaaauuucuaccacuucacucgcccccuaauaaaaccccaaugcgcagcauacggcaaggcccucgaccucucccucaacucuaucuucuuuaucggaccaaaccaauucgaaaaucugcccgacaucgccugccugaaccucucagccaacucaaacgcccagguucucuccggcaccgaguucuccgccaucccccauguaaaauaccucgaccuaaccaacaacagacuggacuuugacaacgccuccgcacucaccgagcucucggaccuagaaguccuugaccuaucguacaacagccacuacuuccguaucgccggcgucacucaccacuuagaguucauccaaaacuucaccaaccucaaaguccuaaaccucucgcauaacaacauauacacacucacagacaaauacaaccucgaaagcaagucgcucgucgaacuugucuucucaggcaaccgccucgauauccuauggaacgacgaugacaaccgcuacauaucaauauucaaaggucucaaaaaccugacgcgccucgaccuaagccucaacagacuuaagcacauccccaacgaggcauuccuuaaccuccccgcaucgcugaccgagcuccacaucaacgacaacaugcugaaauucuuuaauuggacccugcuccaacaguuuccccgcuuagagcuccucgaccuacguggcaacaaacuccuuuuccuaaccgacuccuuaucugacuuuacuucaagucuucgcacucuccugcuaucucauaaucgcauaucccaucucccuuccggcuuccucuccgagguaagcucgcuaaaacaucucgaccucucaucuaaccuacucaaaacaaucaacaaaucagccuuagaaacaaagaccaccacaaaacucuccaugcuugagcuccacggcaaccccuucgagugcaccugugacauaggagauuuucgcagauggauggacgaacaccuaaaugucaagaucccccgucucguugaugucaucugcgcaucccccggcgaccagcgagguaaaagcaucgucucgcuagaacucacgaccugcgucuccgacguuaccgcagucauccucuucuucuucaccuucuucaucacuacaauggucaugcuugcagcgcuagcacaccaccuauucuacugggacguuugguucauauacaacgucugccucgcaaaagugaagggcuaccgaucccucucgacaagucaaacauucuacgacgccuacaucaguuacgacaccaaagacgcauccguaaccgauugggucauaaacgaacuacgauaccaccucgaagaaucccgcgacaagaacguccuucucugccucgaagaacgagacugggaccccgggcuugcaaucaucgauaaccuaaugcaaucaaucaaccaauccaaaaagacaguauucgucuuaacuaaaaaguacgcgaaaagcuggaacuucaaaacggccuucuaccuggcucuacagcgccucauggacgaaaacauggacgucauuaucuucauucuccucgaacccgugcuccaacacagucaauaccuacgacuacgucaacguaucuguaaaagcucaauauuacaguggcccgacaaucccaaggccgaaggccuauucuggcaaacacuucgaaacgucguccugaccgaaaacgacucccguuacaacaacauguacguagacucaaucaaacaauacuga

SEQ ID NO: 2260 - RNA, 66 nt, Artificial Sequence
  P16671_TM_1_8-29
ggcuugaucgcgggcgcggucauaggcgcggucuuggccguguucgggggcauacucaugcccgug

SEQ ID NO: 2261 - RNA, 81 nt, Artificial Sequence
  P32248_TM_1_60-86
uuccuuccaauuauguacucaaucaucugcuucguuggccuccucggcaacggucucgucguccucaccuacaucuacuuc

SEQ ID NO: 2262 - RNA, 66 nt, Artificial Sequence
  P16671_TM_2_440-461
cuguugggguugauagagaugauacuguugagcguggggguggugauguucguggcguuuaugaua

SEQ ID NO: 2263 - RNA, 63 nt, Artificial Sequence
  P32248_TM_2_96-116
uaucuccuuaaccucgccgucgccgacauccucuuccuccuaacccuacccuucugggccuac

SEQ ID NO: 2264 - RNA, 66 nt, Artificial Sequence
  P32248_TM_3_131-152
cucauauucgccaucuacaaaauguccuucuucuccggcaugcuccuacuccuaugcauauccauc

SEQ ID NO: 2265 - RNA, 63 nt, Artificial Sequence
  P32248_TM_4_171-191
guccuacucaucuccaaacucucaugcgucggcaucuggauccucgcaaccguccucuccauc

SEQ ID NO: 2266 - RNA, 84 nt, Artificial Sequence
  P32248_TM_5_220-247
uucaucaccauacaagucgcccaaaugguaaucggcuuccuagucccacuccucgccauguccuucugcuaccucgucaucaua

SEQ ID NO: 2267 - RNA, 78 nt, Artificial Sequence
  P32248_TM_6_264-289
gucauaaucgccguagucgucgucuucaucgucuuccaacuccccuacaacggcguaguccucgcccaaaccgucgcc

SEQ ID NO: 2268 - RNA, 54 nt, Artificial Sequence
  P32248_TM_7_314-331
cucgcgugcguacgcuguugcgugaacccguucuuguacgcguucauaggcgug

SEQ ID NO: 2269 - RNA, 69 nt, Artificial Sequence
  A0A5B9_TM_145-167
accauccucuacgaaauccuccucggcaaagccacccucuacgccguccucgucucagcccucguacua

SEQ ID NO: 2270 - RNA, 69 nt, Artificial Sequence
  B7Z8K6_TM_130-152
cucggccuacgcaugcuuuucgccaaaaccgucgcugucaacuuccuccucaccgcaaaacuauucuuc

SEQ ID NO: 2271 - RNA, 63 nt, Artificial Sequence
  O00206_TM_632-652
acuaucaucggcgucuccguccucucuguccuugucgucuccgucgucgccguccucgucuac

SEQ ID NO: 2272 - RNA, 66 nt, Artificial Sequence
  P01730_TM_397-418
auggcgcucauaguccugggcggggucgcgggccugcuccuguucauaggcuugggcauauucuuu

SEQ ID NO: 2273 - RNA, 63 nt, Artificial Sequence; identical to SEQ ID NO: 2065
  P01850_TM_151-171

SEQ ID NO: 2274 - RNA, 78 nt, Artificial Sequence
  P07766_TM_127-152
gucaugagcguggccacaaucgugaucguggacauaugcauaaccgggggcuugcucuugcucguguacuauuggucg

SEQ ID NO: 2275 - RNA, 66 nt, Artificial Sequence
  P08575_TM_576-597
gcccucaucgcuuuccucgccuuccucaucaucgucaccuccaucgcucuccuugucguccuuuau

SEQ ID NO: 2276 - RNA, 63 nt, Artificial Sequence
  P08637_TM_209-229
guauccuucugccucgucaugguccuccuuuucgccgucgacaccggccucuacuucucuguc

SEQ ID NO: 2277 - RNA, 81 nt, Artificial Sequence
  P10747_TM_153-179
uuuugggugcucguggucgugggcggggucuuggccuguuacucgcucuuggucacggucgcguucauaaucuuuugggug

SEQ ID NO: 2278 - RNA, 66 nt, Artificial Sequence
  P11912_TM_144-165
aucaucacagccgaaggcaucauccuacucuucugcgccgucguccccggaacucuccuccuauuc

SEQ ID NO: 2279 - RNA, 66 nt, Artificial Sequence
  P15391_TM_292-313
guauccgccgucacacucgccuaccucaucuucugccucugcucacucgucggcauacuccaccuc

SEQ ID NO: 2280 - RNA, 63 nt, Artificial Sequence
  P16410_TM_162-182
uuccuucuuuggauccucgccgccgucuccuccggucucuucuucuacucuuuccuucucacc

SEQ ID NO: 2281 - RNA, 63 nt, Artificial Sequence
  P26718_TM_52-72
cccuucuucuuuugcugcuuuaucgcugucgccauggguauccguuucauuaucaugguugcc

SEQ ID NO: 2282 - RNA, 63 nt, Artificial Sequence
  P30273_TM_24-44
cucuguuacauccuagacgccauccuauuucucuacggcaucguccucacccuccucuacugc

SEQ ID NO: 2283 - RNA, 63 nt, Artificial Sequence
  P40259_TM_160-180
ggcaucaucaugauccaaacccuccucaucauccuauucauaaucguccccauauuccuccuu

SEQ ID NO: 2284 - RNA, 63 nt, Artificial Sequence
  P42081_TM_248-268
uggaucaccgccguacuccccaccgucaucaucugcguaaugguauucugccuaauacucugg

SEQ ID NO: 2285 - RNA, 63 nt, Artificial Sequence
  Q15762_TM_255-275
ggcgguaccguccuccuccuccucuucgucaucuccaucacuaccaucaucguuaucuuucua

SEQ ID NO: 2286 - RNA, 63 nt, Artificial Sequence; identical to SEQ ID NO: 2078
  Q685J3_TM_4394-4414

SEQ ID NO: 2287 - RNA, 63 nt, Artificial Sequence
  Q9NNX6_TM_38-58
cucggccacggcccccucguccuccaacuucucuccuucacccuacucgccggccuccucguc

SEQ ID NO: 2288 - RNA, 63 nt, Artificial Sequence
  Q9NR97_TM_828-848
gccgucauccucuuuuucuuuaccuuuuucaucaccaccauggucaugcucgcugcccucgcu

SEQ ID NO: 2289 - RNA, 48 nt, Artificial Sequence
  P14207_1-16
auggucuggaaauggaugccccuccuccuccuccucgucugcgucgcc

SEQ ID NO: 2290 - RNA, 48 nt, Artificial Sequence
  O75787_1-16
auggccguguucguggucuugcucgcgcucguggccggggucuugggc

SEQ ID NO: 2291 - RNA, 48 nt, Artificial Sequence; identical to SEQ ID NO: 627
  P07359_1-16

SEQ ID NO: 2292 - RNA, 48 nt, Artificial Sequence
  P08637_1-16
auguggcaacuccuccuccccaccgcccuccuccuccucgucuccgcc

SEQ ID NO: 2293 - RNA, 51 nt, Artificial Sequence; identical to SEQ ID NO: 2085
  P07237_1-17

SEQ ID NO: 2294 - RNA, 51 nt, Artificial Sequence; identical to SEQ ID NO: 630
  O60911_1-17

SEQ ID NO: 2295 - RNA, 51 nt, Artificial Sequence; identical to SEQ ID NO: 631
  P20138_1-17

SEQ ID NO: 2296 - RNA, 51 nt, Artificial Sequence; identical to SEQ ID NO: 2088
  P27797_1-17

SEQ ID NO: 2297 - RNA, 54 nt, Artificial Sequence
  P10747_1-18
augcuccgccuccuccucgcccucaaccucuuccccuccauccaagucaccggc

SEQ ID NO: 2298 - RNA, 54 nt, Artificial Sequence; identical to SEQ ID NO: 1882
  O75487_1-18

SEQ ID NO: 2299 - RNA, 54 nt, Artificial Sequence; identical to SEQ ID NO: 1883
  P07996_1-18

SEQ ID NO: 2300 - RNA, 54 nt, Artificial Sequence
  P22748_1-18
augcgcaugcuccuagcccuacucgcccucucagccgcccgcccauccgccucc

SEQ ID NO: 2301 - RNA, 54 nt, Artificial Sequence; identical to SEQ ID NO: 637
  Q15762_1-18

SEQ ID NO: 2302 - RNA, 54 nt, Artificial Sequence; identical to SEQ ID NO: 2094
  P30273_1-18

SEQ ID NO: 2303 - RNA, 54 nt, Artificial Sequence; identical to SEQ ID NO: 639
  P38570_1-18

SEQ ID NO: 2304 - RNA, 54 nt, Artificial Sequence
  Q01638_1-18
augggcuucuggauacucgcaauccugaccauacucauguacucgaccgcggcc

SEQ ID NO: 2305 - RNA, 54 nt, Artificial Sequence; identical to SEQ ID NO: 641
  Q9NZQ7_1-18

SEQ ID NO: 2306 - RNA, 57 nt, Artificial Sequence
  P13591_1-19
augcuccaaaccaaagaccucaucuggacccucuucuuccucggcaccgccgucucc

SEQ ID NO: 2307 - RNA, 57 nt, Artificial Sequence
  P26842_1-19
auggcgcgaccgcacccgugguggcucugugucuugggcacgcucgugggcuugagc

SEQ ID NO: 2308 - RNA, 57 nt, Artificial Sequence
  P15391_1-19
augccccccccccgccuccucuucuuccuccucuuccucacccccauggaaguccgc

SEQ ID NO: 2309 - RNA, 57 nt, Artificial Sequence; identical to SEQ ID NO: 1893
  Q8NI17_1-19

SEQ ID NO: 2310 - RNA, 57 nt, Artificial Sequence
  P08571_1-19
auggaacgcgccuccugccuccuccuccuccuccucccccucguccacgucuccgcc

SEQ ID NO: 2311 - RNA, 57 nt, Artificial Sequence
  P05154_1-19
augcaacucuuccuccuccucugccucguccuccucuccccccaaggcgccucccuc

SEQ ID NO: 2312 - RNA, 57 nt, Artificial Sequence
  P02787_1-19
augcgcuuggccgugggcgcgcuauuggucugugccgugcucgggcucugucucgcg

SEQ ID NO: 2313 - RNA, 57 nt, Artificial Sequence
  P02671_1-19
auguucagcaugcgaauagucugucucgugcucucggucgugggcacggccuggacc

SEQ ID NO: 2314 - RNA, 57 nt, Artificial Sequence
  P04216_1-19
augaaccucgccaucuccaucgcccuccuccucaccguccuccaagucucccgcggc

SEQ ID NO: 2315 - RNA, 57 nt, Artificial Sequence
  P00747_1-19
auggaacacaaggaaguaguccugcuccugcuccuguuccugaaaucgggccagggc

SEQ ID NO: 2316 - RNA, 57 nt, Artificial Sequence; identical to SEQ ID NO: 2108
  P01764_1-19

SEQ ID NO: 2317 - RNA, 57 nt, Artificial Sequence
  P16150_1-19
auggcgaccuugcucuugcucuugggcgugcucguggucucgcccgaugccuugggc

SEQ ID NO: 2318 - RNA, 57 nt, Artificial Sequence
  Q6DN72_1-19
augcuacucuggaccgccguccuccucuucguccccugcgucggcaaaaccgucugg

SEQ ID NO: 2319 - RNA, 57 nt, Artificial Sequence
  Q01151_1-19
augucccgcggccuccaacuacuccuccucuccugcgccuacucccucgcccccgcc

SEQ ID NO: 2320 - RNA, 57 nt, Artificial Sequence; identical to SEQ ID NO: 656
  P07093_1-19

SEQ ID NO: 2321 - RNA, 57 nt, Artificial Sequence
  Q8WWQ8_1-19
augaugcuccaacaccucgucaucuucugccucggccucgucguccaaaacuucugc

SEQ ID NO: 2322 - RNA, 60 nt, Artificial Sequence
  Q13291_1-20
auggaccccaaaggccuccucucccucaccuucguccucuuccucucccucgccuucggc

SEQ ID NO: 2323 - RNA, 60 nt, Artificial Sequence
  P35225_1-20
auggcgcucuugcucacgaccgugaucgcgcucacgugcuugggcggguucgcgagcccg

SEQ ID NO: 2324 - RNA, 60 nt, Artificial Sequence
  P25942_1-20
augguccgccucccccuccaaugcguccucuggggcugccuccucaccgccguccacccc

SEQ ID NO: 2325 - RNA, 60 nt, Artificial Sequence; identical to SEQ ID NO: 2117
  P52803_1-20

SEQ ID NO: 2326 - RNA, 60 nt, Artificial Sequence
  Q15116_1-20
augcaaauaccccaagccccauggccagucgucugggccguccuacaacucggcuggcgc

SEQ ID NO: 2327 - RNA, 60 nt, Artificial Sequence
  P05556_1-20
augaaccuccaacccaucuucuggaucggccucaucuccuccgucugcugcgucuucgcc

SEQ ID NO: 2328 - RNA, 60 nt, Artificial Sequence
  Q12891_1-20
augagggccgggccagggccaacgguaacgcuagcgcuagugcuagcgguagcgugggcg

SEQ ID NO: 2329 - RNA, 60 nt, Artificial Sequence; identical to SEQ ID NO: 1913
  Q8IV16_1-20

SEQ ID NO: 2330 - RNA, 60 nt, Artificial Sequence; identical to SEQ ID NO: 666
  Q03167_1-20

SEQ ID NO: 2331 - RNA, 60 nt, Artificial Sequence; identical to SEQ ID NO: 2123
  Q14246_1-20

SEQ ID NO: 2332 - RNA, 60 nt, Artificial Sequence
  P16871_1-20
augacgaucuugggcacgaccuuuggcauggucuuuagcuugcuccaggucgugagcggg

SEQ ID NO: 2333 - RNA, 60 nt, Artificial Sequence
  P61769_1-20
augagcaggagcguggccuuggccgugcucgcgcucuugagcuugagcgggcucgaggcc

SEQ ID NO: 2334 - RNA, 60 nt, Artificial Sequence
  Q9Y6W8_1-20
augaaauccggccucugguacuucuuccucuucugccuccgcaucaaaguccucaccggc

SEQ ID NO: 2335 - RNA, 63 nt, Artificial Sequence; identical to SEQ ID NO: 1919
  P10966_1-21

SEQ ID NO: 2336 - RNA, 63 nt, Artificial Sequence
  Q9BZW8_1-21
augcucgggcaaguggucacgcucauacuccugcuccugcucaaggucuaucaagggaaaggg

SEQ ID NO: 2337 - RNA, 63 nt, Artificial Sequence
  P02778_1-21
augaaccaaaccgccauccucaucugcugccucaucuuccucacccucuccggcauccaaggc

SEQ ID NO: 2338 - RNA, 63 nt, Artificial Sequence
  P18564_1-21
augggcaucgaacuccucugccucuucuuccucuuccucggccgcaacgaccacguccaaggc

SEQ ID NO: 2339 - RNA, 63 nt, Artificial Sequence
  O14525_1-21
auggccuuggccgggcucugugccuugcucgcgugcuguugggggccagcggcagugcuagcg

SEQ ID NO: 2340 - RNA, 63 nt, Artificial Sequence
  P01130_1-21
augggaccguggggguggaagcucagguggacggucgcgcuauugcuagcggccgcgggaacg

SEQ ID NO: 2341 - RNA, 63 nt, Artificial Sequence
  P01732_1-21
auggcccuacccgucaccgcccuccuacucccccucgcccuccuacuccacgccgcccgcccc

SEQ ID NO: 2342 - RNA, 63 nt, Artificial Sequence; identical to SEQ ID NO: 2134
  P48061_1-21

SEQ ID NO: 2343 - RNA, 63 nt, Artificial Sequence; identical to SEQ ID NO: 2135
  P01589_1-21

SEQ ID NO: 2344 - RNA, 63 nt, Artificial Sequence
  Q86T13_1-21
augcgaccggccuuugccuugugcuugcucuggcaagcgcucuggcccgggcccgggggcggg

SEQ ID NO: 2345 - RNA, 63 nt, Artificial Sequence
  Q5DID0_1-21
augcuccgcaccuccggccucgcccuccucgcccucgucuccgccgucggccccucccaagcc

SEQ ID NO: 2346 - RNA, 66 nt, Artificial Sequence
  P40189_1-22
augcucacccuccaaaccuggcucguccaagcccucuucaucuuccucaccaccgaauccaccggc

SEQ ID NO: 2347 - RNA, 66 nt, Artificial Sequence; identical to SEQ ID NO: 1931
  Q86YL7_1-22

SEQ ID NO: 2348 - RNA, 66 nt, Artificial Sequence
  P55075_1-22
augggcuccccccgcuccgcccucuccugccuccuccuccaccuccucguccucugccuccaagcc

SEQ ID NO: 2349 - RNA, 66 nt, Artificial Sequence
  Q30201_1-22
augggcccccgcgcccgccccgcccuacuccuacucaugcuccuacaaaccgccguccuccaaggc

SEQ ID NO: 2350 - RNA, 66 nt, Artificial Sequence; identical to SEQ ID NO: 2142
  P07766_1-22

SEQ ID NO: 2351 - RNA, 66 nt, Artificial Sequence
  P18827_1-22
augcgccgcgccgcccucuggcucuggcucugcgcccucgcccucucccuccaacccgcccucccc

SEQ ID NO: 2352 - RNA, 66 nt, Artificial Sequence
  P55290_1-22
augcaaccccgcaccccccucguccucugcguccuccucucccaaguccuccuccucaccuccgcc

SEQ ID NO: 2353 - RNA, 66 nt, Artificial Sequence; identical to SEQ ID NO: 1937
  P37173_1-22

SEQ ID NO: 2354 - RNA, 66 nt, Artificial Sequence
  Q07325_1-22
augaaaaaauccggcguccucuuccuccucggcaucauccuccucguccucaucggcguccaaggc

SEQ ID NO: 2355 - RNA, 66 nt, Artificial Sequence; identical to SEQ ID NO: 2147
  P04156_1-22

SEQ ID NO: 2356 - RNA, 66 nt, Artificial Sequence
  P31785_1-22
augcucaaacccucccuccccuucaccucccuccucuuccuccaacucccccuccucggcgucggc

SEQ ID NO: 2357 - RNA, 69 nt, Artificial Sequence
  P01579_1-23
augaaauacaccuccuacauccucgccuuccaacucugcaucguccucggcucccucggcugcuacugc

SEQ ID NO: 2358 - RNA, 69 nt, Artificial Sequence
  P23229_1-23
auggccgccgccggccaacucugccuccucuaccucuccgccggccuccucucccgccucggcgccgcc

SEQ ID NO: 2359 - RNA, 69 nt, Artificial Sequence
  O60494_1-23
augaugaacaugucccuccccuuccucuggucccuccucacccuccucaucuucgccgaagucaacggc

SEQ ID NO: 2360 - RNA, 69 nt, Artificial Sequence; identical to SEQ ID NO: 1944
  P08575_1-23

SEQ ID NO: 2361 - RNA, 69 nt, Artificial Sequence; identical to SEQ ID NO: 1945
  Q8IWY4_1-23

SEQ ID NO: 2362 - RNA, 69 nt, Artificial Sequence; identical to SEQ ID NO: 698
  Q08431_1-23

SEQ ID NO: 2363 - RNA, 69 nt, Artificial Sequence
  Q99665_1-23
auggcccacaccuuccgcggcugcucacucgccuucauguucaucaucaccuggcuccucaucaaagcc

SEQ ID NO: 2364 - RNA, 69 nt, Artificial Sequence
  Q6Q8B3_1-23
augucggccccgcgcuugcucauaagcauaaucauaauggugagcgcgagcucgagcucgugcaugggc

SEQ ID NO: 2365 - RNA, 69 nt, Artificial Sequence
  Q07011_1-23
augggcaacuccugcuacaacaucgucgccacccuccuccucguccucaacuucgaacgcacccgcucc

SEQ ID NO: 2366 - RNA, 69 nt, Artificial Sequence; identical to SEQ ID NO: 1950
  Q8NHL6_1-23

SEQ ID NO: 2367 - RNA, 69 nt, Artificial Sequence
  P36894_1-23
augccccaacucuacaucuacauccgccuccucggcgccuaccucuucaucaucucccgcguccaaggc

SEQ ID NO: 2368 - RNA, 69 nt, Artificial Sequence
  Q16552_1-23
augacccccggcaaaaccucccucgucucccuccuccuccuccucucccucgaagccaucgucaaagcc

SEQ ID NO: 2369 - RNA, 69 nt, Artificial Sequence
  P42081_1-23
auggacccccaaugcaccaugggccucuccaacauccucuucgucauggccuuccuccucuccggcgcc

SEQ ID NO: 2370 - RNA, 69 nt, Artificial Sequence
  P43121_1-23
augggcuugcccaggcucgugugcgcguucuugcucgcggccuguugcuguugcccgcgcguggccggg

SEQ ID NO: 2371 - RNA, 69 nt, Artificial Sequence; identical to SEQ ID NO: 707
  O00206_1-23

SEQ ID NO: 2372 - RNA, 69 nt, Artificial Sequence
  P42701_1-23
auggaaccccucgucaccugggucgucccccuccucuuccucuuccuccucucccgccaaggcgccgcc

SEQ ID NO: 2373 - RNA, 72 nt, Artificial Sequence
  P06729_1-24
auguccuuccccugcaaauucgucgccuccuuccuccucaucuucaacgucuccuccaaaggcgccgucucc

SEQ ID NO: 2374 - RNA, 72 nt, Artificial Sequence
  P15328_1-24
auggcgcaaaggaugacgacccagcucuugcucuugcucguguggguggccguggucggggaagcgcaaacg

SEQ ID NO: 2375 - RNA, 72 nt, Artificial Sequence
  P05112_1-24
augggccucaccucccaacuccuccccccccucuucuuccuccucgccugcgccggcaacuucguccacggc

SEQ ID NO: 2376 - RNA, 72 nt, Artificial Sequence
  P06127_1-24
augcccaugggcucccuccaaccccucgccacccucuaccuccucggcaugcucgucgccuccugccucggc

SEQ ID NO: 2377 - RNA, 72 nt, Artificial Sequence
  P32248_1-24
auggacuugggcaagcccaugaaaucggucuuggucguggccuugcucgugaucuuucaagugugcuugugc

SEQ ID NO: 2378 - RNA, 72 nt, Artificial Sequence
  Q7Z7D3_1-24
auggccucccucggccaaauccucuucugguccaucaucuccaucaucaucauccucgccggcgccaucgcc

SEQ ID NO: 2379 - RNA, 72 nt, Artificial Sequence; identical to SEQ ID NO: 1963
  P54756_1-24

SEQ ID NO: 2380 - RNA, 72 nt, Artificial Sequence
  Q92823_1-24
augcaacucaaaaucaugcccaaaaaaaaacgccucuccgccggccgcgucccccucauccucuuccucugc

SEQ ID NO: 2381 - RNA, 72 nt, Artificial Sequence; identical to SEQ ID NO: 1965
  P19320_1-24

SEQ ID NO: 2382 - RNA, 72 nt, Artificial Sequence; identical to SEQ ID NO: 1966
  Q86UN2_1-24

SEQ ID NO: 2383 - RNA, 75 nt, Artificial Sequence; identical to SEQ ID NO: 1967
  P33151_1-25

SEQ ID NO: 2384 - RNA, 75 nt, Artificial Sequence; identical to SEQ ID NO: 720
  P17813_1-25

SEQ ID NO: 2385 - RNA, 75 nt, Artificial Sequence
  P25445_1-25
augcucggcaucuggacccuccucccccucguccucaccuccgucgcccgccucuccuccaaauccgucaacgcc

SEQ ID NO: 2386 - RNA, 75 nt, Artificial Sequence
  P01730_1-25
augaaccgcggcguccccuuccgccaccuccuccucguccuccaacucgcccuccuccccgccgccacccaaggc

SEQ ID NO: 2387 - RNA, 75 nt, Artificial Sequence
  Q685J3_1-25
augccccgccccggcaccauggcccucugccuccucacccucguccucucccuccuccccccccaagccgccgcc

SEQ ID NO: 2388 - RNA, 75 nt, Artificial Sequence; identical to SEQ ID NO: 1972
  P17787_1-25

SEQ ID NO: 2389 - RNA, 75 nt, Artificial Sequence
  Q6UQ28_1-25
auggccgucuuccacgacaugcuccuccaaccccucggcauguuccucugccucucccuccaacucuccuccgcc

SEQ ID NO: 2390 - RNA, 75 nt, Artificial Sequence
  P13987_1-25
augggcauccaaggcggcuccguccucuucggccuccuccucguccucgccgucuucugccacuccggccacucc

SEQ ID NO: 2391 - RNA, 75 nt, Artificial Sequence; identical to SEQ ID NO: 1975
  P10721_1-25

SEQ ID NO: 2392 - RNA, 75 nt, Artificial Sequence
  P12319_1-25
auggccccagccauggaaucacccacccuccucugcgucgcccuccucuucuucgcccccgacggcguccucgcc

SEQ ID NO: 2393 - RNA, 78 nt, Artificial Sequence; identical to SEQ ID NO: 1977
  Q9BZR6_1-26

SEQ ID NO: 2394 - RNA, 78 nt, Artificial Sequence
  P25063_1-26
augggcagggccauggucgcgcgcuugggcuugggcuugcucuugcucgcgcucuugcucccgacccagaucuauagc

SEQ ID NO: 2395 - RNA, 78 nt, Artificial Sequence
  Q9NR97_1-26
auggaaaacauguuccuccaauccuccaugcucaccugcaucuuccuccucaucuccggcuccugcgaacucugcgcc

SEQ ID NO: 2396 - RNA, 78 nt, Artificial Sequence
  Q8N131_1-26
augggcuugggcgcgcgcggggccugggccgcgcucuugcucgggaccuugcaagugcucgcgcucuugggcgcggcc

SEQ ID NO: 2397 - RNA, 78 nt, Artificial Sequence; identical to SEQ ID NO: 733
  P49771_1-26

SEQ ID NO: 2398 - RNA, 78 nt, Artificial Sequence; identical to SEQ ID NO: 734
  P02679_1-26

SEQ ID NO: 2399 - RNA, 78 nt, Artificial Sequence; identical to SEQ ID NO: 735
  P14784_1-26

SEQ ID NO: 2400 - RNA, 81 nt, Artificial Sequence; identical to SEQ ID NO: 736
  P05362_1-27

SEQ ID NO: 2401 - RNA, 81 nt, Artificial Sequence
  Q13740_1-27
auggaauccaaaggcgccuccuccugccgccuccucuucugccuccucaucuccgccaccgucuuccgccccggccucggc

SEQ ID NO: 2402 - RNA, 84 nt, Artificial Sequence
  Q13443_1-28
auggggagcggggccagguucccgagcgggaccuugcgcgugcgcuggcucuugcuauugggcuuggucgggccagugcucggg

SEQ ID NO: 2403 - RNA, 84 nt, Artificial Sequence
  P14151_1-28
augaucuuccccuggaaaugccaauccacccaacgcgaccucuggaacaucuucaaacucuggggcuggaccaugcucugcugc

SEQ ID NO: 2404 - RNA, 84 nt, Artificial Sequence
  P56199_1-28
auggccccgcgcccgcgcgcgcgcccgggcguggccguggccuguugcuggcucuugaccguggucuugcgcuguugcgugagc

SEQ ID NO: 2405 - RNA, 84 nt, Artificial Sequence; identical to SEQ ID NO: 741
  P11279_1-28

SEQ ID NO: 2406 - RNA, 84 nt, Artificial Sequence
  P40259_1-28
auggcccgccucgcccucucccccguccccucccacuggauggucgcccuccuccuccuccucuccgccgaacccguccccgcc

SEQ ID NO: 2407 - RNA, 84 nt, Artificial Sequence
  P43681_1-28
auggaacucggcggccccggcgccccccgccuccuccccccccuccuccuccuccucggcaccggccuccuccgcgccuccucc

SEQ ID NO: 2408 - RNA, 84 nt, Artificial Sequence; identical to SEQ ID NO: 1992
  P18627_1-28

SEQ ID NO: 2409 - RNA, 84 nt, Artificial Sequence; identical to SEQ ID NO: 1993
  Q5ZPR3_1-28

SEQ ID NO: 2410 - RNA, 84 nt, Artificial Sequence
  P23415_1-28
auguacuccuucaacacccuccgccucuaccucugggaaaccaucgucuucuucucccucgccgccuccaaagaagccgaagcc

SEQ ID NO: 2411 - RNA, 84 nt, Artificial Sequence; identical to SEQ ID NO: 747
  Q8TD46_1-28

SEQ ID NO: 2412 - RNA, 87 nt, Artificial Sequence
  P17301_1-29
augggccccgaacgcaccggcgccgccccccucccccuccuccucguccucgcccucucccaaggcauccucaacugcugccucgcc

SEQ ID NO: 2413 - RNA, 87 nt, Artificial Sequence
  P12821_1-29
augggcgccgccuccggccgccgcggccccggccuccuccucccccucccccuccuccuccuccuccccccccaacccgcccucgcc

SEQ ID NO: 2414 - RNA, 87 nt, Artificial Sequence
  Q14118_1-29
augcgcauguccgucggccucucccuccuccucccccucuggggccgcaccuuccuccuccuccucuccgucgucauggcccaaucc

SEQ ID NO: 2415 - RNA, 87 nt, Artificial Sequence; identical to SEQ ID NO: 751
  P05231_1-29

SEQ ID NO: 2416 - RNA, 87 nt, Artificial Sequence; identical to SEQ ID NO: 2208
  O00602_1-29

SEQ ID NO: 2417 - RNA, 87 nt, Artificial Sequence
  Q9Y6Q6_1-29
auggccccccgcgcccgccgccgccgcccccuauucgcccuccuccuccucugcgcccuccucgcccgccuccaagucgcccuccaa

SEQ ID NO: 2418 - RNA, 87 nt, Artificial Sequence; identical to SEQ ID NO: 754
  Q9ULI3_1-29

SEQ ID NO: 2419 - RNA, 90 nt, Artificial Sequence
  Q8NBP7_1-30
auggggaccgugagcucgcgcaggagcugguggccgcucccgcucuugcucuugcucuugcucuugcucgggcccgcgggcgcgcgagcg

SEQ ID NO: 2420 - RNA, 90 nt, Artificial Sequence
  P02675_1-30
augaaacgcauggucuccugguccuuccacaaacucaaaaccaugaaacaccuccuccuccuccuccucugcgucuuccucgucaaaucc

SEQ ID NO: 2421 - RNA, 90 nt, Artificial Sequence; identical to SEQ ID NO: 757
  P06756_1-30

SEQ ID NO: 2422 - RNA, 93 nt, Artificial Sequence; identical to SEQ ID NO: 758
  O60609_1-31

SEQ ID NO: 2423 - RNA, 93 nt, Artificial Sequence
  P50895_1-31
auggaaccccccgacgcccccgcccaagcccgcggcgccccccgccuccuccuccucgccguccuacucgccgcccaccccgacgcccaagcc

SEQ ID NO: 2424 - RNA, 93 nt, Artificial Sequence
  P28906_1-31
augcucgugcgcaggggcgcgcgcgcgggcccgcgcaugcccaggggcuggaccgcgcucugucucuugagcuugcucccgagcggguucaug

SEQ ID NO: 2425 - RNA, 93 nt, Artificial Sequence
  P08514_1-31
auggccagagcccucugcccacuccaagcccucuggcuacucgaauggguacuccuacuccucggccccugcgccgccccacccgccugggcc

SEQ ID NO: 2426 - RNA, 93 nt, Artificial Sequence
  P00742_1-31
augggccgcccccuccaccucguccuccucuccgccucccucgccggccuccuccuccucggcgaaucccucuucauccgccgcgaacaagcc

SEQ ID NO: 2427 - RNA, 96 nt, Artificial Sequence
  P26006_1-32
auggggcccgggcccucgagagcgcccagggccccgagauugauguugugcgcgcucgcgcuaauggucgcggccgggggcuguguagugagcgcg

SEQ ID NO: 2428 - RNA, 96 nt, Artificial Sequence
  P13726_1-32
auggaaacgcccgcguggccgcgcgugcccaggcccgagaccgcggucgcgcgcacgcucuugcucggguggguguucgcgcaaguggccggggcc

SEQ ID NO: 2429 - RNA, 96 nt, Artificial Sequence
  P11912_1-32
augcccggcggccccggcguccuccaagcccuccccgccaccaucuuccuccucuuccuccucuccgccgucuaccucggccccggcugccaagcc

SEQ ID NO: 2430 - RNA, 96 nt, Artificial Sequence
  Q9H6X2_1-32
auggcgaccgcggaaaggcgcgcgcucgggaucggguuccagugguugagcuuggccacgcucgugcucauaugcgcgggccagggcgggcgcagg

SEQ ID NO: 2431 - RNA, 99 nt, Artificial Sequence
  Q8IWK6_1-33
auggaaccacccggccgccgccgcggccgcgcacaaccaccccuacuccuaccccuaucccuacucgcacuccuagcccuacucggcggcggcggcggc

SEQ ID NO: 2432 - RNA, 99 nt, Artificial Sequence
  P58335_1-33
augguggccgagcgaucgcccgcgcgcucgcccgggagcuggcucuuucccgggcucuggcucuuggucuugagcgggcccgggggcuugcucagggcc

SEQ ID NO: 2433 - RNA, 102 nt, Artificial Sequence
  P06731_1-34
auggaaucccccuccgcccccccccaccgcuggugcauccccuggcaacgccuccuccucaccgccucccuccucaccuucuggaacccccccaccaccgcc

SEQ ID NO: 2434 - RNA, 102 nt, Artificial Sequence
  P33681_1-34
augggccacacccgccgccaaggcaccucccccuccaaaugccccuaccucaacuucuuccaacuccucguccucgccggccucucccacuucugcuccggc

SEQ ID NO: 2435 - RNA, 105 nt, Artificial Sequence
  P38567_1-35
augggcguccucaaauucaaacacaucuucuuccgcuccuucgucaaauccuccggcgucucccaaaucgucuucaccuuccuccucauccccugcugccucacc

SEQ ID NO: 2436 - RNA, 105 nt, Artificial Sequence
  P16410_1-35
auggccugccucggcuuccaacgccacaaagcccaacucaaccucgccacccgcaccuggcccugcacccuccucuucuuccuccucuucauccccgucuucugc

SEQ ID NO: 2437 - RNA, 111 nt, Artificial Sequence
  P15814_1-37
augagaccgggaacgggacagggcgggcuagaggccccgggcgagcccgggccaaaucucaggcaaagguggccgcuauugcuauugggauuggcagugguaacgcacggg

SEQ ID NO: 2438 - RNA, 114 nt, Artificial Sequence
  Q92956_1-38
auggaaccccccggcgacuggggccccccccccuggcgcuccacccccaaaaccgacguccuccgccucguccucuaccucaccuuccucggcgcccccugcuacgcccccgcc

SEQ ID NO: 2439 - RNA, 123 nt, Artificial Sequence
  Q86VB7_1-41
auguccaaacuccgcaugguccuccucgaagacuccggcuccgccgacuuccgccgccacuucgucaaccucucccccuucaccaucaccgucguccuccuccucuccgccugcuucgucacc

SEQ ID NO: 2440 - RNA, 123 nt, Artificial Sequence
  P08648_1-41
augggcucccgcacccccgaauccccccuccacgccguccaacuccgcuggggcccccgccgccgccccccccuccucccccuccuacuccuccuccuccccccccccccccgcgucggcggc

SEQ ID NO: 2441 - RNA, 123 nt, Artificial Sequence
  P16109_1-41
auggccaacugccaaaucgccauccucuaccaacgcuuccaacgcgucgucuucggcaucucccaacuccucugcuucuccgcccucaucuccgaacucaccaaccaaaaagaagucgccgcc

SEQ ID NO: 2442 - RNA, 132 nt, Artificial Sequence
  O75326_1-44
augaccccccccccccccggccgcgccgcccccuccgccccccgcgcccgaguccccggcccccccgcccgccucggccucccccuccgccuccgccuccuccuacuccucugggccgccgccgccuccgcc

SEQ ID NO: 2443 - RNA, 135 nt, Artificial Sequence
  Q8N2Q7_1-45
auggcccuaccccgcugcaccuggcccaacuacgucuggcgcgccgucauggccugccucguccaccgcggccucggcgccccccucacccucugcaugcucggcugccuccuccaagccggccacguccucuca

SEQ ID NO: 2444 - RNA, 138 nt, Artificial Sequence
  Q86UN3_1-46
augcuccccggccuccgccgccuccuccaagcccccgccuccgccugccuccuccucaugcuccucgcccucccccucgccgcccccuccugccccaugcucugcaccugcuacuccuccccccccaccgucuccugc

SEQ ID NO: 2445 - RNA, 540 nt, Artificial Sequence
  A0A5B9
auggaccucaaaaacgucuucccacccgaagucgccguauucgaacccuccgaagcagaaaucucacacacacaaaaagccacccucgucugccucgccaccggcuucuaccccgaccacgucgaacucuccuggugggucaacggcaaagaaguccacuccggcgucucaaccgacccccaaccccucaaagaacaacccgcccuaaacgacucccgcuacugccucuccucccgccuccgcguauccgccaccuucuggcaaaacccccgcaaccacuucagaugccaaguacaauucuacggccucuccgaaaacgacgaauggacccaagaccgagccaaacccgucacccaaaucgucucagccgaagccuggggccgcgccgacugcggauucaccuccgaauccuaccaacaaggcguacucuccgccaccauccucuacgaaauccuccucggcaaagccacccucuacgccguccucgucuccgcccuaguccucauggccauggucaaacgcaaagacucccgcggcuaa

SEQ ID NO: 2446 - RNA, 465 nt, Artificial Sequence
  B7Z8K6
augucccaaccccacaccaaacccuccgucuucgucaugaaaaacggcaccaacgucgccugccucguaaaagaauucuaccccaaagacauucgcaucaaccucgucuccuccaaaaaaaucaccgaauucgaccccgccaucgucaucucccccuccggcaaauacaacgccgucaaacucggcaaauacgaagacuccaacuccgucaccugcuccguccaacacgacaacaaaaccguacacuccaccgacuucgaagucaaaaccgacuccaccgaccacgucaaacccaaagaaaccgaaaacaccaaacaacccuccaaauccugccacaaacccaaagccaucguccacaccgaaaaagucaacaugaugucccucaccguccucggccuacgcaugcucuucgcaaaaaccgucgccgucaacuuccuccucaccgccaaacucuucuuccucuaa

SEQ ID NO: 2447 - RNA, 645 nt, Artificial Sequence
  B9A064
augcgccccaaaacuggccaaguaggaugcgaaacccccgaagaacucggucccggcccccgacaacgcuggccccuccuccuccucggccucgccauggucgcccacggacuacuccgcccaauggucgccccccaauccggcgaccccgaccccggcgccuccgucggcuccucccgaucauccuuacgcagccucuggggaagacuacuacuccaacccuccccccaacgcgccgacccccgcugcuggccccgcggcuucugguccgaaccccaaucccuaugcuacguauucggcaccggcacaaaagucacaguccucggccaaccaaaagccaaccccaccgucacacucuuccccccauccucagaagaacuccaagccaacaaagccacccucgucugccucaucuccgacuucuacccaggcgccguuaccguagccuggaaagccgacggcucccccgucaaagccggagucgaaaccaccaaacccuccaaacaauccaacaacaaauacgccgcauccuccuaccucucccuaacccccgaacaauggaaaucacaccgcuccuacuccugccaagucacccacgaaggcuccacagucgaaaaaaccgucgcccccaccgaaugcuccuga

SEQ ID NO: 2448 - RNA, 2520 nt, Artificial Sequence
  O00206
augauguccgcaucacgccucgccggaacccucauacccgccauggcguuccucuccugcguaagaccggaauccugggaacccugcguggaagucguccccaacaucaccuaucaaugcauggaauuaaacuuuuacaaaauaccggacaaccuccccuucuccaccaaaaaccucgacuuaucauucaacccccuacgacaccucggcucauauucuuucuucuccuucccagaacuacaaguccucgaccuuagccguugcgaaauacaaaccauugaggacggcgccuaccaaagccuaagccaccucuccacacucauccucaccggcaaccccauucagagucuagcucucggcgccuucaguggacuuuccucccuacagaaacucgucgcagucgaaacaaaccuugccucccucgaaaacuuccccaucggacaccuaaagacccuuaaagagcuaaacgucgcccacaaucucauacagucauucaaacuacccgaauacuucuccaaccugaccaaccuagaacacuuagaccucucaagcaacaaaauccaaucaauuuacugcaccgaccuccgaguucuccaccagaugccccuccucaaccucucacucgaccuuucacuuaacccuaugaacuucauacagcccggcgccuucaaagaaauacgauuacacaaacuuacccuccgcaacaacuucgacucccuaaacgucaugaaaaccuguauccaggggcucgccggacucgaaguccaccgccucguacucggagaguuccgcaacgaaggcaaccucgaaaaauucgacaaauccgcccuagaaggacuauguaaccucacaaucgaagaauuucgacuagccuaccucgacuacuaccuggacgacauaaucgaccuauucaacugucucaccaacguuuccuccuucuccuuagugucagucaccaucgaacgcguuaaagacuucuccuacaauuucgguuggcaacaucuagagcucgucaacuguaaguucggccaguucccaacacucaaacugaaaucccucaaacgccuuacguucacaucgaacaagggaggcaacgccuucagcgaagucgaccuccccucacucgaguuccucgaccuaucccguaacggccuuagcuuuaaaggcugcugcucccagucagacuucgggaccaccucucuaaaguaccuugaccucuccuucaacggcgucauaaccaugucaucaaacuuucucggccuugaacaacucgaacaccucgacuuucagcacuccaaccucaaacaaaugagcgaguucuccguauuucuuucccuacguaaccucaucuacuuggacaucucccacacccacaccagaguagccuucaacggcaucuucaacggucucuccucacuagaaguacucaagauggccggcaacuccuuccaggaaaacuuucuuccagacauauucaccgaacuccgcaaccucaccuuucuagaccucucucaaugccaauuagaacagcuauccccaaccgcguucaauucccuuuccucccuucaaguccucaacaugucccacaacaacuuuuucucccucgauacauuccccuacaaaugccuaaauucccugcaagugcuugacuacucacucaaccacaucaugacaucaaagaaacaagaacugcaacacuuccccucuucacucgcauucuuaaaccuaacccaaaacgacuucgccuguaccugcgaacaccaauccuuccuccaguggauaaaagaccaacgccaacuucucguugaagucgaacgcauggagugcgccacccccuccgacaaacaaggcaugcccguacugucccucaacaucacaugccaaaugaacaaaacaauaauaggcgucucaguccuuucaguccucgucgucagugucgucgcagugcuagucuauaaauucuacuuccaccuaaugcuccuugccggcugcaucaaauacggccgcggcgaaaacaucuacgacgcguucgucaucuacuccagccaggacgaagauuggguccgaaacgaacugguuaaaaaccuugaagaaggggucccacccuuccagcuaugccuccacuacagagacuucauccccggagucgcgaucgccgccaacauaauacaugaaggcuuccauaaaagccggaaagucauaguuguagucucccagcauuuuauccagucgagauggugcauuuucgaauacgaaauagcucaaacauggcaauuccuuaguagccgcgccggaaucauauucaucgugcuucagaaagucgagaaaacguuacuacgccagcaaguggaacucuaccggcuucugucccgaaacacuuaucuagaaugggaagacucaguccucggacgacacauuuucuggcgccgacuucgcaaggcacuccucgacggaaaaucauggaaucccgagggaaccguagguaccgguugcaacuggcaagaagccaccucaaucuga

SEQ ID NO: 2449 - RNA, 1377 nt, Artificial Sequence
  P01730
augaaccgaggcguaccauuccgccaccuccuacuagugcuccaacuagcccuccucccagcagcaacccaagggaaaaaaguaguccuaggaaaaaaaggcgacacagucgaacuaaccugcaccgcaucccaaaaaaaaucaauccaguuccacuggaaaaacagcaaccagaucaaaauacuaggcaaccaaggcuccuuccuaacgaaaggccccuccaaacucaacgaucgcgcagacagccgccgcucacucugggaccaaggcaacuucccccucaucaucaaaaaccugaaaaucgaagacuccgacaccuacaucugcgaagucgaagaccaaaaagaagaaguacaacuccuaguauucggccucaccgccaacuccgauacacaccuacuccaaggacaaucccucacucuaacccucgaaucccccccgggauccagcccauccguccaauguagaucacccagaggcaaaaauauacaaggcgggaaaacccucuccguaagccaacuagaacuacaagacuccgguacauggaccuguaccguucuccaaaaccaaaaaaaagucgaauucaaaauagacauagucguucucgccuuccaaaaggccuccucaaucgucuacaaaaaagaaggcgaacaagucgaauucaguuucccccuagccuucacaguugaaaaacuaacaggcuccggcgaacucugguggcaggccgagcgcgccuccucauccaaauccuggaucacauucgaccuuaaaaacaaagaagucucaguaaaacgcguuacgcaagaccccaaacuacaaaugggcaaaaagcucccccuccaccucacgcucccccaagcccucccccaauacgccggcagcggcaaccuaacccucgcccucgaagccaagaccgguaaacuccaccaagaagucaaccuagucgucaugcgagccacacaacuccaaaaaaaccucacgugcgaagucuggggacccacaucccccaaacuaaugcucucccuaaaacucgagaacaaagaagcaaaagucagcaagcgcgaaaaagccgucuggguccucaaccccgaagcaggcauguggcaaugccuccucucagacagcggccaaguccuacuagaaucaaacaucaaaguccuaccgaccuggagcacaccaguccaacccauggcccucaucguccucggcggcgucgccggccuccuucuauucaucggucuaggcauauucuucugcguccgcugccgacaccggcgccgacaagccgaacgcaugucacaaaucaaacgacuccuuucugaaaaaaaaaccugccaaugcccccaccguuuccaaaaaaccugcuccccaaucuga

SEQ ID NO: 2450 - RNA, 537 nt, Artificial Sequence
  P01850
auggaagaccucaacaaagucuucccccccgaagucgccgucuucgaacccuccgaagccgaaaucucacacacccaaaaagccacccuagucugccucgccaccggcuucuuccccgaccaugucgaacucuccuggugggucaacggcaaagaaguacacuccggcgucuccacagacccccaaccccucaaagaacaacccgcccucaacgacucccgcuacugccucuccucccgccuccgcgucuccgccaccuucuggcaaaacccccgcaaccacuuccgcugccaaguccaauucuacggccucuccgaaaacgacgaauggacccaagaccgcgccaaacccgucacacaaaucgucuccgccgaagccuggggccgcgccgacugcggcuucaccucagucuccuaccaacaaggcguccucuccgccaccauccucuacgaaauccuccucggcaaagccacccucuacgccguccucgucuccgcccuaguccucauggccaugguaaaacgcaaagacuucuaa

SEQ ID NO: 2451 - RNA, 624 nt, Artificial Sequence
  P07766
augcagagcggaacccauuggagaguccugggcuugugccugcucucgguaggggucuggggccaggacgggaacgaggaaaugggcgggaucacgcaaacgcccuauaaagugagcauaagcgggaccacagucauacucacgugcccacaauaucccggaagcgagaucuuguggcagcacaacgacaaaaacauaggcggggacgaggacgauaaaaacaucgggagcgaugaagaucaccugagccugaaagaguucucggaacuggaacagagcggguacuaugucuguuacccacgcgggagcaagcccgaggacgcaaacuuuuaccuguacuuacgcgcgcgcgugugcgagaacugcauggagauggaugucaugagcguggccacgaucgugaucguggacauaugcauaaccggaggccugcucuugcuaguguacuauuggucgaaaaaccgcaaggccaaggcaaagcccgugaccaggggcgcgggcgcgggcgggcgacagcgcgggcaaaacaaagagagaccgcccccggucccgaacccggacuaugaaccgaucaggaaagggcaaagggaccuguacucgggcuugaaccagcgcaggaucuga

SEQ ID NO: 2452 - RNA, 3915 nt, Artificial Sequence
  P08575
auguacuuguggcugaaacuccucgcauucggcuucgcauuccucgacaccgaaguauucguaaccggacaaucccccacaccuucaccaacaggccugacaaccgcaaagaugcccuccguaccacucucaucagauccucucccaacccacacgaccgccuucagccccgcuucuacuuuugaacgagagaacgacuucucggagaccacaacaucacucagccccgacaacacaucaacccaggucagccccgacucccuagacaacgccagcgccuucaauacaaccggaguuagcagcgugcaaacaccccaccucccgacccacgccgacucucagacccccuccgccggcaccgauacucaaacauucucaggcucugcagcaaacgccaaacuaaaccccacccccggaucaaacgcaauuagcgacgugcccggagaacgcucaacugccuccaccuucccgaccgacccggugagccccuuaacgaccacacuuucgcuggcccaccauucauccgccgcuuuacccgccagaacauccaacaccacuauaacugccaacacuuccgacgcauaccucaacgcuuccgaaacaaccacccuuagcccuuccggguccgccguuaucagcaccacaacgauagccaccacccccucaaaaccuaccugugacgaaaaguacgccaacaucacggucgauuaccuauacaacaaagagacaaaguuauucaccgccaaauuaaacgucaacgagaacguagagugcggaaacaacaccuguacgaacaacgaggugcacaacuuaacagaauguaaaaaugcauccguuucaauaucccacaacagcugcacggccccagacaaaacguuaauccuagacgucccacccggcguagaaaaauuccaacuccacgacuguacccaaguugagaaggccgauacaacaauaugcuuaaaguggaaaaacaucgaaacauucaccugugacacacaaaacaucaccuaccgcuuucaaugcggcaacaugauauucgacaacaaagaaauaaaacucgaaaaccuugagccagaacacgaauacaaaugugauuccgagauccuauauaacaaccacaaauucaccaacgccucaaagauaaucaaaaccgacuucggcuccccaggcgaaccccaaaucaucuucugccgcuccgaagcagcccaucaagggguaaucaccuggaacccaccucaacgcaguuuccacaacuucacgcuaugcuauaucaaggaaacggaaaaagacugccuaaaucucgacaaaaacuuaauaaaguacgaccugcagaaccugaaaccguacaccaaauacguguugagccuacaugcguacaucaucgcaaaaguacagagaaauggauccgcggcaaugugccacuuuacaaccaaauccgcgccgccaucccagguauggaacaugaccgucucgaugaccucagacaacagcaugcacguaaaaugcaggcccccgcgcgaccgcaacgguccacacgaacgcuaccaccuugaagucgaagcuggcaauacccucguccgcaacgaaucacacaagaacugcgacuuccgaguaaaagaccuacaguauagcaccgacuauacguucaaagccuacuuccauaauggugacuaccccggggaacccuucauccuccaucacucaacgucauacaacuccaaagcacuaauagcauuccucgcauuccuuauaauagugaccucaauagcccuacucgucguccuauacaaaaucuaugaccuccacaagaagagaaguuguaaucuagacgaacaacaagaacucguagagcgagaugacgaaaagcaacuaaugaacguagaacccauccacgcagauauacuccucgagaccuacaagcgcaaaauagcugacgaaggccgucuauuucucgccgaguuccaaucaauccccagagucuucucaaaauuccccaucaaagaagcgcgcaaacccuuuaaccaaaacaaaaaccgguacgucgacauccuacccuacgacuacaaccgcgucgaacucagcgaaaucaacggagacgcaggaucaaacuacaucaacgcaagcuauaucgauggauucaaagaaccacggaaauauaucgccgcccagggaccacgagacgaaacaguagacgacuucuggcguaugaucugggaacaaaaagccaccguuauaguaauggucacccgaugcgaggaaggaaaccgaaauaaaugcgccgaauacuggccaaguauggaggaaggcacuagagccuucggugacgucguugugaaaauaaaucagcacaaaagaugcccagacuacauaauacaaaagcuaaacaucgucaacaagaaagagaaagcgacgggcagagaagucacacacauccaguucaccucauggcccgaccacgguguccccgaggacccgcaccuccuccucaaacuccgccgacgugucaacgcauucucaaacuuuuucagcggcccgaucguaguccacugcuccgcaggagugggucgaacaggcaccuacaucggaaucgacgccaugcucgaaggcuuagaagcagaaaacaaaguugauguuuacggcuacguugucaaacuaagacgccagcgcugccuuaugguccagguagaagcacaauacauccucauucaccaagcccuaguagaauauaaucaauucggggaaacggagguuaaccuuucggagcuucaccccuaccuccacaacaugaagaaacgagauccacccuccgaacccagcccccuagaagccgaauuucagcgcuuaccauccuaccgaucguggcgcacccaacacaucggcaaccaagaagagaacaaauccaagaaccgaaacagcaaugucauccccuacgacuauaaccgcgucccccuaaaacacgagcucgaaaugucaaaagaaucagaacacgacuccgacgaauccagcgacgacgauuccgacucggaggaacccuccaaauacaucaaugcuagcuucaucaugucguacuggaagcccgaagugaugauugccgcacagggcccccugaaagaaaccauaggcgacuuuuggcaaaugaucuuccaacgcaaaguaaaaguaauagucaugcuuacagaacugaagcacggcgaccaagaaaucugcgcucaguacuggggagagggaaagcaaaccuauggcgacaucgagguugaccuaaaggacaccgauaaaucaaguaccuacacccuuagaguguucgaacuucggcacagcaaaaggaaggacucuaggacagucuaccaauaccaauauaccaauuggucagucgagcaacuuccagccgaaccgaaagaacuuauauccaugauacaagucgucaaacaaaaacuuccccagaaaaauucaagcgaggggaacaaacaucacaaaucgaccccgcuacuaauucacugccgugacggaagucaacaaacaggaaucuuuugcgcacuacuaaaccugcuagaauccgccgaaaccgaagaagucgucgacaucuuucaggucguuaaggcacuccgcaaagcccgccccgguauggugucaacguucgagcaguaccaauuucuuuacgacgucauagcauccacuuaccccgcacaaaacggucaagugaagaaaaacaaccaucaagaggacaaaaucgaguucgacaacgaaguugacaaagugaagcaagacgccaacugcguaaacccacucggcgcgccagaaaagcuccccgaagcaaaagaacaagccgaagggagugagcccaccagcggaaccgaagggccugaacacucggucaacgggcccgccagccccgcacuaaaccaagggucauaa

SEQ ID NO: 2453 - RNA, 765 nt, Artificial Sequence
  P08637
auguggcaacuccuccuccccacagcccuccuacuccucgucuccgccggaaugcgcaccgaagaccuccccaaagccgucgucuuccucgaaccccaaugguaccgcguccucgaaaaagacuccgucacccucaaaugccaaggcgccuacucccccgaagacaacuccacccaaugguuccacaacgaaucccuuaucuccucccaagccuccuccuacuucaucgacgccgccacagucgacgacuccggagaauaccguugccaaaccaaccucuccacccucuccgaccccguacaacucgaaguccacaucggauggcuccuccuccaagcuccccgcugggucuucaaagaagaagaccccauccaccuccgcugccacucuuggaaaaacacugcccuacacaaagucaccuaccuacaaaacggcaaaggacgcaaauacuuccaccacaacuccgacuucuacauccccaaagccacacucaaagacucaggcucauacuucugccgcggccucuucggcucuaaaaacgucucuucagaaaccgucaacaucaccaucacacaaggccucgccgucuccaccaucucauccuucuucccacccggcuaccaagucucauucugccucgucaugguccuccucuucgccgucgacacuggccucuacuucuccgucaaaaccaacauccgcucauccacccgcgacuggaaagaccacaaauucaaauggcggaaagacccccaagacaaauga

SEQ ID NO: 2454 - RNA, 663 nt, Artificial Sequence
  P10747
augcuccgccuccuacucgcccucaaccucuuccccuccauccaagucaccggcaacaaaauccuagucaaacaaucccccaugcucgucgcguacgacaacgccgucaaccucuccugcaaauacuccuacaaccucuucucccgcgaauuccgcgccucccuucacaaaggccucgacuccgccgucgaagucugcgucguauacggcaacuauucccagcaacuccaagucuacucuaaaaccggcuucaacugcgacggcaaacucggcaacgaauccgucacauucuaccuccaaaaccucuacgucaaccaaaccgacaucuacuucugcaaaaucgaaguaauguaccccccccccuaccucgacaacgaaaaauccaacggcaccaucauccacguaaaaggcaaacaccuuugccccuccccccucuuccccggccccucuaaacccuucuggguccucgucgucgucggcggcguccucgccugcuacucccuccuagucaccguagccuucaucaucuucuggguccgcuccaaacgcucccgucuucuccacuccgacuacaugaacaugaccccccgccgccccggccccacccgcaaacacuaccaacccuacgcccccccccgagacuucgccgccuaccgcuccuga

SEQ ID NO: 2455 - RNA, 681 nt, Artificial Sequence
  P11912
augcccggcggcccuggaguccuucaagcccuacccgccaccaucuuccuccucuuccuacucuccgccgucuaccucggccccggcugccaagcccucuggaugcacaaaguccccgcaucccuaauggucucacucggcgaagacgcacacuuccaaugcccccacaacuccucaaacaacgccaacgucaccugguggcgcguccuccacggaaacuacaccuggccaccagaauuccucggccccggcgaagaccccaacggcacccucaucauccaaaacgucaacaaaucucacggaggcaucuacgucugcagaguacaagaaggaaacgaauccuaccaacaauccugcggcacauaccuacgaguccgccaaccccccccgcgcccauuccucgacaugggagaaggcaccaaaaaccgcaucaucacugccgaaggaaucaucuuacuauucugcgccgucguccccggcacccuacuacucuuccgcaaacgcuggcaaaacgaaaaacucggccuagacgccggagacgaauacgaagacgaaaaccucuacgaaggccucaaccuagacgacugcuccauguacgaagacauaucacgcggccuacaaggcaccuaccaagacguaggcucccucaacaucggcgacguccaacucgaaaaacccuga

SEQ ID NO: 2456 - RNA, 1671 nt, Artificial Sequence
  P15391
augcccccaccccgucuacuauuuuuccuccucuuccuaacacccauggaaguaagacccgaagaaccccucgucgucaaagucgaggaaggagacaacgcagugcuccagugccuaaaaggcacauccgacggaccuacccaacaacucaccuggucccgcgaaaguccauuaaaacccuuccucaaacuaucccuaggccucccaggacuaggcauccacaugcgaccccuagcaauauggcuauucauauucaacgucucacagcaaaugggaggcuucuaccucugccaaccaggcccacccucugaaaaagcauggcaacccggauggaccguaaacgucgaaggaagcggagaacucuuccgcuggaacgucucagaccucggcggacuuggcugcggccuaaagaaccgcucauccgaaggaccaucaucacccuccggcaaacucauguccccaaaacuauacguaugggcuaaagacagaccagaaauaugggaaggagagccgcccugccuucccccacgcgacagccucaaccaaucacucucccaagaccucacaauggcacccggcagcacucuuuggcuauccugcggagucccacccgacuccgucucacgcggcccacuaucauggacccacguacaucccaaaggccccaagucacugcucagccuagaacucaaagacgacaggcccgcacgagacaugugggucauggagacaggccuccuccuuccccgcgccaccgcacaagaugcugguaaauacuacugccaccgaggcaaucuaacaauguccuuccaccuagaaaucaccgcacgaccaguccuuuggcacuggcuccuccgcaccggcggcuggaaggucuccgccgucacccuugccuaccuaaucuucugccucugcucacucgucggaauccuccaccuccaacgcgcacucguccuccgaagaaaaagaaaacgcaugacagaccccacacgccgguucuucaaggucacucccccaccaggcuccggcccccaaaaccaauacggcaacgugcucagccucccgaccccgaccuccggacucggccgagcacaaagaugggccgccggccucggaggaaccgcccccucauacggcaaccccaguuccgacguacaagcagacggcgcccucgguucaagaucaccaccaggaguaggccccgaagaagaagaaggcgaaggcuacgaagaacccgauagcgaagaagacagcgaguucuacgaaaacgacuccaaccuuggccaagaccaacucucacaagacggauccggauacgaaaacccugaagacgagccauuaggcccagaagacgaagacagcuucuccaacgcagaauccuacgaaaacgaagacgaagaacucacacaacccguagcuagaacaauggacuuccuaagcccacacggcucagccugggaucccucacgcgaagcuaccucccuaggaagccaaagcuacgaagacaugcgagguauccuuuacgccgcuccccaauuacgaucaauccgcggccaaccaggcccaaaccacgaagaagacgcagacuccuacgaaaacauggacaacccagacgggcccgaccccgccuggggagggggagggcgcaugggaacaugguccacacgcuaa

SEQ ID NO: 2457 - RNA, 672 nt, Artificial Sequence
  P16410
auggcaugccucggcuuccaacgccacaaagcccaacuuaaccucgccacccgaacauggcccugcacccuccucuucuuccuccucuucauccccgucuucugcaaagcaaugcacguagcacaacccgccgucguccucgccucaucccgcggcaucgccuccuucguaugcgaauacgccucccccggcaaagccacagaaguccgagucaccguccuccgucaagccgacucccaagucaccgaaguaugcgcagccacauacaugaugggcaaugaacuaaccuuccucgacgacuccaucugcacaggcaccuccucuggcaaccaaguaaaccucaccauccaaggccuccgcgccauggacacaggacucuacaucugcaaagucgaacucauguaccccccccccuacuaccucggcaucggcaacggcacccaaaucuacgucaucgaccccgaacccugcccagacucagacuuccuccucuggauccucgccgccgucuccuccggccucuucuucuacuccuuccuccuaaccgccgucucccucucuaaaaugcucaaaaaacgcuccccccucaccaccggcgucuacgucaaaaugccccccaccgaacccgaaugcgaaaaacaauuccaacccuacuucaucccuaucaacuga

SEQ ID NO: 2458 - RNA, 1419 nt, Artificial Sequence
  P16671
augggcugcgaccgcaacugcggccucauagccggcgccguaaucggcgcuguccucgcagucuucgguggcauacuaaugcccgucggcgaccuccucauccagaaaaccaucaagaaacaagucguccucgaagaaggaacaaucgccuucaaaaacuggguuaaaaccggcaccgaagucuaccgucaguucuggauauucgacguccagaacccccaagaagucaugaugaacuccagcaacauccaagucaaacaacgaggccccuacaccuaccgcguacgauuucucgccaaagaaaacguaacccaagacgccgaagacaacaccgucucauuccuacaacccaacggagccaucuucgaaccaucacuauccgucggcaccgaagccgacaacuucaccguccuaaaccuagcagucgccgccgccucgcauaucuaccaaaaccaauucguccagaugauccuaaacucauuaaucaacaaauccaaguccuccauguuccaaguccgcacccucagagaacuccucuggggcuacagagacccguuccuaagccucgucccguacccagucacuaccacaguaggacuauucuacccauacaauaacacagccgacggugucuacaaagucuucaacggaaaagacaacauaucuaaaguagccaucaucgacaccuacaaaggcaaacgaaaccucucguacugggaaucccacugcgacaugauaaacggcacagacgccgccucauuuccaccauucgucgaaaaaucacaaguccuccaauucuuuagcuccgacauaugccgcucaaucuacgcugucuucgaaucugacgucaaccucaagggaauccccguauaccgcuucguccuacccuccaaagccuucgccucccccgucgaaaaucccgacaacuacugcuucugcaccgagaaaauaaucuccaaaaacugcaccuccuacggcguccuagacaucuccaaaugcaaggaaggccgccccguauacaucucccucccccacuuccuguacgccuccccugacguaagcgaacccaucgacggccucaaccccaaugaggaagaacaccgaaccuaccucgacaucgaacccaucacaggauucacccuacaauucgccaaacgccuccaggucaaccuccucgucaaaccauccgagaaaauccaaguccucaaaaaccucaaacgcaacuacaucguacccauccucuggcucaacgaaaccggcaccauuggcgacgaaaaagcaaacauguuucgcucacaggucacaggcaaaaucaaccuccuaggucucauagaaaugauccuccucuccguuggcguagucauguucgucgccuucaugauauccuacugcgccugccgaucaaaaaccauaaaauga

SEQ ID NO: 2459 - RNA, 651 nt, Artificial Sequence
  P26718
augggcuggauccgcggccgccgcucccgccacuccugggaaaugucugaauuccacaacuacaaccuagaccucaaaaaauccgacuucagcacacgcuggcaaaaacaacgaugccccgucgucaaauccaaaugccgcgaaaacgccucccccuucuucuucugcugcuucaucgccgucgccaugggcauccgcuucaucaucauggucgccaucugguccgccgucuuccucaacucccucuucaaccaagaaguccaaaucccccucaccgaauccuacugcggacccugccccaaaaacuggaucugcuacaaaaacaacugcuaccaauucuucgacgaaagcaaaaacugguacgaaucccaagccuccugcaugucccaaaacgccucccuccucaaagucuacagcaaagaagaccaagaccuccucaaacucgucaaaagcuaccacuggaugggccuaguccacauccccaccaacggcucauggcaaugggaagacggcucaauccucucccccaaccuccuaaccaucaucgagaugcaaaaaggcgacugcgcccucuacgccuccagcuucaaaggcuacaucgaaaacugcucgacccccaacacauacaucugcaugcaacgcaccgucuaa

SEQ ID NO: 2460 - RNA, 261 nt, Artificial Sequence
  P30273
augauccccgccgucguccuccuccuccuccuccucgucgaacaagccgccgcccucggcgaaccccaacucugcuacauccucgacgccauccucuuccucuacggcaucguccucacccuccucuacugccgccucaaaauccaaguccgcaaagccgccaucaccuccuacgaaaaauccgacggcgucuacaccggccucucaacccgcaaccaagaaaccuacgaaacccucaaacacgaaaaacccccccaauag

SEQ ID NO: 2461 - RNA, 1137 nt, Artificial Sequence
  P32248
auggaccucgguaaacccaugaaauccguccucgucgucgcccuucucguaaucuuccaaguuugccuaugccaagacgaagucaccgacgauuacauaggcgacaacaccaccgucgacuacacccucuucgagagccuaugcucaaagaaagacguccgcaacuucaaagccugguuccuccccauaauguacucaauuaucugcuucgucggccuccucggaaacggccucgucguacucaccuacaucuacuucaaacgacucaaaaccaugaccgacacauaccuccuaaaccucgccgucgccgacauccucuuccuacucacccuccccuucugggcauacucagccgccaaaucauggguguucggaguccacuucugcaaacucaucuucgccaucuacaaaaugucuuucuucuccggcaugcuccuccuccucugcaucuccaucgaccgcuacgucgccaucguccaagccgucucagcccaccgccaccgugcccgcguccugcuaaucuccaaacucucaugcgucggcaucuggauccucgccaccguucucuccaucccugaauuacucuacuccgaccuccaacgcagcuccuccgagcaagccaugcgcugcucccucauaaccgaacacgucgaagcauucaucacaauucaaguagcccaaauggucauaggauuccucguuccccuccucgccaugucauucuguuaccucgucauaauucgcacccuccuccaagcacgcaacuucgagcgcaacaaagccaucaaagucaucaucgccgucgucguagucuucauuguauuccaacuacccuacaacggggucguccucgcccaaaccgucgccaacuucaacaucaccucuucgaccugcgaacucuccaaacaacuaaacaucgcauacgacgucaccuacucccucgccugcguacgcugcugcguaaaccccuuccuauacgcauucaucggcguaaaauuccgcaacgaccuauucaagcuauucaaagaccucggcugccucucacaagaacaacuccgucaaugguccuccugcagacauauacgccgcuccucaauguccguugaagccgaaaccaccaccaccuucucccccuga

SEQ ID NO: 2462 - RNA, 690 nt, Artificial Sequence
  P40259
auggcccgacucgcccucucccccguccccucccacuggaugguagcccuccuacuccuacuauccgccgaacccguccccgcagcccgcuccgaagaccgcuaccgcaacccaaaaggcuccgcaugcucccgcaucuggcaaucaccccgcuucaucgcccgcaaacgcggauucaccgucaaaaugcacugcuacaugaacuccgccuccggcaacgucuccuggcuauggaaacaagaaauggacgaaaacccccaacaacucaaacuagaaaaaggccgcauggaagaaucccaaaacgaaucccucgccacccucaccauccaaggcauccgauucgaagacaacggcaucuacuucugccaacaaaaaugcaacaacaccuccgaaguuuaccaaggcugcggaaccgaacuccgagucaugggcuucuccacccucgcacaacucaaacaaagaaacacccucaaagacggcaucaucaugauccaaacccuccuaaucauccucuucaucaucguaccaaucuuccuccuacucgacaaagacgacuccaaagccggcauggaagaagaccacaccuaugaaggccucgacauagaccaaaccgcaaccuacgaagacaucgucacccuccgcaccggcgaagucaaaugguccgucggcgaacaccccggccaagaauga

SEQ ID NO: 2463 - RNA, 990 nt, Artificial Sequence
  P42081
auggacccccaaugcaccaugggccucuccaacauccucuucguaauggccuuucuccucuccggcgccgccccccucaaaauccaagccuacuucaacgaaaccgccgaccuccccugccaauucgccaacucccaaaaccaaagccucuccgaacucgucguauucuggcaagaccaagagaaccucguacucaacgaagucuaccucggcaaagaaaaauucgacucaguccacuccaaguacaugggccguaccuccuucgacuccgacagcuggacacuacgacuacacaaccuacaaaucaaagacaaaggccucuaccaaugcaucauccaccacaaaaaacccaccggcaugauccguauacaccaaaugaacuccgaacucucuguccucgccaacuucucacagcccgaaaucguccccaucucuaacauaaccgaaaacgucuacaucaaccuaaccugcuccuccauccacggauaccccgaacccaaaaaaauguccguccuacuccgcaccaaaaacuccaccaucgaauacgacggcgucaugcaaaaaucgcaggacaacgucaccgagcuuuacgacguauccaucucccucuccgucuccuuccccgacgucaccuccaacaugacaaucuucugcauccucgaaacugauaaaacacgccuccucuccucaccuuucucaaucgagcucgaagacccccaacccccccccgaccacaucccuuggaucaccgccguccuacccaccgucaucaucugcguuauggucuucugccuaauccucuggaaauggaaaaaaaaaaaacguccccgcaacucauacaaaugcggcaccaacaccauggaacgagaagaauccgaacaaaccaaaaaacgcgaaaaaauacacauccccgagcgcuccgacgaagcccaacgcgucuucaaauccuccaaaaccuccuccugcgacaaauccgacacaugcuucuga

SEQ ID NO: 2464 - RNA, 1011 nt, Artificial Sequence
  Q15762
auggacuaccccacccuccuacuagcccuccuccacgucuaccgagcacucugcgaagaaguccuauggcacacaucgguccccuucgccgaaaacaugucccucgaaugcguauaccccuccaugggcauacuuacccaagucgaaugguucaaaaucggcacccaacaagacuccaucgccaucuucucaccaacacacggcauggucauccgaaaacccuacgcugaacgcgucuacuuccucaacucuaccauggccucaaacaacaugacccuauuuuuccgcaacgcaagcgaagacgacgucggauacuacuccugcucccucuacaccuacccccaaggaaccuggcaaaaagucauccaagucguccaaucagacagcuucgaagccgcgguccccuccaacucccacaucgucuccgaacccggcaaaaacgucacccucacaugccaaccccaaaugaccuggccaguacaagccgucagaugggagaaaauacagccccgccaaaucgaccuccuaacuuacugcaaccuuguacacggacgaaacuucaccagcaaauucccacgccaaaucguauccaauugcucacacggccgauggagcgucaucgucaucccugacgucaccgucuccgacagcggccucuaucgcugcuaccuccaagccucagccggcgaaaacgaaaccuucguaaugcgccuaaccguagccgaaggcaaaaccgacaaccaauacacccucuucgucgccggcggaacgguacuccuccuacucuucgucaucuccaucaccaccauaaucguaaucuuccuaaaccgccgccgccgacgcgaacgccgagaccuauucaccgaauccugggacacccaaaaagcacccaacaacuaccgcuccccaaucuccaccucacaacccaccaaccaauccauggacgacacccgcgaagacaucuacgucaauuacccaaccuucucucgccgcccaaaaacccgcgucuga

SEQ ID NO: 2465 - RNA, 13482 nt, Artificial Sequence
  Q685J3
augccucgaccuggcaccauggccuuaugccuccucaccuugguauuaucccugcuuccaccccaggccgcugccgaacaagacuuauccgucaaucgugcugucugggacgguggcggauguauaucgcaaggugauguccuuaaccgccaaugccaacagcucucacaacacguacgaacuggcagugcugcaaauaccgcuacuggcacgaccuccacuaacgucguagaacccaggauguacuuaagcugcucaacuaaccccgaaaugacuuccauagaauccuccguaacuagcgacacgccgggcgucuccagcacucguaugacucccacugaaucaagaaccacuucagaaaguaccagugacuccacuacccuauucccaucaucaaccgaagacacuucguccccaacgacucccgaaggcacugauguucccauguccaccccgucagaagaauccaucucaucuacuauggcuuuuguuucuacugccccucuaccuucuuucgaagcauacacuuccuugaccuacaagguugacaugucgaccccgcucaccacuucaacccaggcgucuagcuccccgaccacccccgaaucaaccaccauucccaagucuacgaauagcgaaggcagcacaccucucacauccaugcccgccuccaccaugaaaguagccucaucggaagccauaacgcuucucacuacaccgguagaaauuagcacgccaguuacaauuucugcacaagcuagcuccaguccaaccacggccgaagguccuucguugucaaauagcgcaccauccggcggcagcaccccacuuacccguaugccccucucaguaauguuaguugucagcagcgaagcaucuacacuguccacuacccccgccgcuaccaacauacccgucauuacuagcacagaagccuccagcucgccuacaacggccgaagguaccaguauacccaccagcacauacacagaaggcagcacuccccuaacauccacgccagcaagcacaaugcccguugccaccagcgaaaugucuacucuauccauaacgccuguugauaccucgacauuagucaccaccucuaccgaacccagcucccucccuacgaccgcagaagccaccucaaugcugacaagcacguugucugaggggucaacgccacuuacaaacaugccgguuucgacuaucuuaguggccaguuccgaggccucuacuacauccacgaucccaguagacucuaagacuuuuguuaccaccgcaucagaagcgucaagcucacccacuacugcugaagacacuucuauagcuacgucuacaccguccgaaggaucuacgccauugacauccaugcccguauccaccacccccgucgcgagcagcgaggcuucgaaucucaguaccacccccguugacucgaaaacacagguaaccacgucuacugaagccagcucaucuccgccaaccgcugaagugaacaguaugccuacgucuacgcccuccgaaggaucaacaccccugaccagcaugucagucuccacuaugccaguugcuucauccgaggcuucgacucuaucaacuacgcccguggacacaucaacaccaguaacgacuuccucugaagcaaguagcagcuccacaacuccugaaggcacaucgauuccuacaaguaccccaucggaaggauccacgccucugacuaacaugccaguuucgacacgucucgucgucaguagugaagcaucgaccacuucaacaacaccagccgacucuaauaccuucgucacuacgaguucugaggcaucaucaagcuccaccaccgcagaaggcacuagcaugccaacguccaccuacucagaacgcgggaccaccaucaccuccaugucugugucaacgacccuuguagcauccucugaagccuccacucuaucgaccacacccguagauagcaauacuccuguaacaacuuccaccgaagcaacaucguccucuacaaccgccgaagguacaucgaugccuacaucaacauauaccgaaggaaguacaccuuugacuagcaugccagugaacaccacguuaguagcuucuuccgaagccuccaccuuaaguacuacuccaguagauacaucgacacccguaacgacguccaccgaagcauccagcucuccaacuacagcugauggcgccucaaugccuaccuccacucccucagaaggcuccacgccucugacgucuaugcccguaucaaaaacacuccuaaccucgucugaagccuccacacucucuacaacucccuuagacacuagcacucacauuaccaccagcaccgaagcgaguuguucaccuacaaccaccgaaggaaccucuaugccaauuuccaccccguccgaaggguccccacuccugaccuccauuccagucagcauaacccccgucaccucccccgaagcaaguacucucucaacgacuccuguugacuccaauucgcccgucaccacaucaacagaaguuucuuccucgccaaccccagccgaaggcacgagcaugccgacuucaacuuacagugagggucgaacgccgcucaccuccaugcccguaucgacuacgcuugucgcaaccagcgcaauuagcacucuuaguacaacaccggucgauacaaguacaccggucaccaacucgaccgaagcacguaguuccccgacgaccagugaagggaccuccaugcccacuuccacucccggugaaggaucaaccccacucaccuccaugccagacagcaccaccccggucgugucaucagaagccagaacuuugucagcuacccccguagacacaucaacaccagugaccacgucuacugaagcaacaucuuccccaacaaccgcagaaggaaccucgauacccacaucuacccccucugagggaacuacucccuuaacgucaacuccagucucacauacacucgucgcuaauuccgaggcuuccacacuaucaacgacgccuguggauucaaauaccccacuaacuacuucaaccgaagccucuucaccucccccaacagccgagggaaccucgaugcccacaucuacuccuucugaaggcucgacaccacuaacgagaaugcccgucuccacaacaaugguagcgucaagcgagacaucuacccugucaacaacaccagcagacaccagcacgccugugacaacauacucgcaagcaucuucuucaucaaccaccgccgacggcacaagcaugccgacaucuaccuauucagagggcucgacaccccuuaccucaguuccagucuccacucgccuaguagucuccucugaagcauccacgcuuagcacaacucccgucgacacuucuaucccagucacuaccucaacggaagcaagcuccucgccuaccaccgcggagggaacaaguauacccacaucaccucccagcgaggggacaacaccccuggcaucuaugccgguuuccacgacccucguuguauccuccgaggcuaacacccuaagcacgacaccagucgauagcaaaacccaaguggcuacuuccacugaagccucauccccuccacccaccgcagaaguaacaucaaugcccacgucaacccccggggaacgaucaacuccgcuaacgucuaugccgguaagacacacccccguagcaucuucggaagccuccacacucucaacuucacccguugacacaaguacccccguaacaacuuccgccgagacauccucauccccaaccacugcggaaggcaccucacuacccacaucuaccaccucugaagguucuacauuacuuaccagcauucccgucucuacuacacucguuacaucaccggaagccucgacacuccuaacuacuccugucgacacaaaaggaccaguaguaacgucaaacgaggucucgagcucgcccacuccagcggaaggcacaaguaugccuacguccacuuacucagagggccgaacuccgcucaccagcauacccgucaacacaacucucguggccucaagcgccauuagcauacuguccaccacaccuguugacaacagcacgccgguuacuaccuccacagaagcaugcagcucgcccacaacguccgaggguaccuccaugccgaacagcaaccccucggaagguaccacgcccuuaacguccauuccugucucaaccacccccguuguuucaucagaggcgaguacacuguccgcaacuccaguagacaccuccacacccggcaccacuuccgccgaagccacaaguucucccacgacagccgaaggcauaagcauccccaccuccacgccaagugaaggcaagaccccucugaaaucaaucccggucaguaacacaccugucgccaacucagaagcaagcacgcuuuccacuacucccguugacaguaacucuccaguagucacaucuaccgcaguuagcucuagccccacaccagccgaggguaccagcauagcaauuaguacgccaucugagggcagcacggcuuugacaucaaucccuguauccacaacaacgguagcaucgucggaaaucaacagccuuucaacuacgcccgcaguuacgagcaccccuguaacaacuuacagccaggccucuucgucuccuacaacugcugacggaacgucgaugcagaccucaaccuacagcgagggauccacccccuuaaccucacugccagucucaacgaugcuagucgucucuucggaagcuaauacccuaagcacaacuccaaucgacucgaaaacacaggucaccgcuucaacugaagcuaguucuucaacuacggcagaaggaagcuccaugacuaucuccacaccuagcgaagguucuccucuucucacaucuauaccagucuccaccacacccguagcgucuccagaggcuuccacgcuuucaaccacgccagucgacucgaacucucccguaauuaccuccaccgaaguuuccagcucccccacccccgcugaagggaccucaaugcccacuucaacauauaccgaaggacgaacaccccuaacaucgauaacgguccgcaccaccccggucgcaaguuccgcgaucucaacccuuagcaccaccccaguagacaauuccacuccagucacgaccuccacugaggcacgauccucccccaccaccagugaagguacuucaaugccgaacuccacuccuucggagggcacaacaccgcuaacaucuauucccguguccacaacucccguccucuccucagaagccagcacguugagcgccaccccuauagauacgucuacccccguuaccacuucaacggaggcaaccuccucacccacuaccgcugagggcacguccauuccuaccucaacguuaucggaaggcaugaccccgcuaacuucuacgccgguuucucacaccuuaguggcaaacucagaagcauccacuuuaucuacgacuccuguggauuccaauucaccagucgucacaagcacagccgucuccaguucgcccacucccgcagaagguacaucuaucgcuaccucuacaccauccgagggcucaaccgcccuaaccucuauaccggucucgacuaccaccgucgcauccucggaaacaaauaccuuaaguacaacaccagccguuaccuccacccccgucaccacauaugcacaagugagcagcucuccaaccacugcggacggcuccagcaugcccacuucgacaccucgggaggggcgcccaccauuaacauccauuccgguaucuaccaccaccguagccuccagcgaaaucaauacccuaucuacgacccuggccgacacuagaacucccguaaccaccuacucgcaagcauccucgucgccaacgacugccgacggcacauccaugcccaccccggccuacuccgaaggguccacuccgcucacuagcaugccucucucgaccacgcuaguggugucuuccgaagcaagcacacuuucuacaacacccguagacacaucaacuccggccaccacgucuacggaaggaucuucaucaccaacaacagccggcggaacgucaauccaaaccagcacaccguccgaaagaacuacuccuuuggcagggaugcccguauccacgacacucgucguaucauccgagggcaauacccuguccacuaccccaguugacagcaaaacccagguuacaaacucgacagaagcaucaucgucggcaacagccgaagggagcaguaugacgaucuccgcccccuccgagggaucuccccuccuaacaucaauuccacuuuccacgacaccaguagcuucccccgaggcuucaacacuaaguacuaccccuguagauucaaauucgccggucauaaccaguacagaaguauccuccucacccaucccgacugaaggcacaaguaugcaaaccagcacuuauucugaccgccggacuccacuuacgucaaugccuguuuccacuacagucguggccucaucagcuaucuccacacuaucuaccacaccggucgauacuuccacacccguuacuaacucaacagaagcacggagcuccccgacaaccucugagggaaccucaaugcccacaucaaccccaucugaaggcucgacuccguuuacuucaaugcccguuuccacgaugcccguggucacaagugaagcguccacacuaucagccaccccggucgacacaucgacgccagugacgacauccacagaggcaacaagcucaccaacgacagcagaaggcacguccauucccaccagcacccucagcgagggaacuaccccauuaacuuccauccccguuucacauacgcucguggccaacucagaggucucgacauuauccacgacccccguagacucuaacacgccuuuuacaacgagcaccgaagcuaguucacccccucccacagcagaagggacuuccaugcccaccaguacaaguagcgaaggaaacacaccacucacuagaaugccaguaagcacuacgaugguggcuagcuuugaaacgucgaccuuaucaaccacccccgccgacacuucgaccccgguaacaacauacucccaagcaggaucaucuccuacuacagcagacgauacaucuaugccgaccucuacauauucagaggguuccacaccccucacuucagucccugucucaacuaugccaguagugucaucugaagcgucuacacacucaacgacuccuguggauacaaguaccccaguaaccacgaguaccgaagccucuucaucacccacuacugcugaaggaacaucuauccccaccucgcccccuagcgaaggcacgacuccccuagccagcaugccggucuccacaacaccuguagucucuagugaggccgggacucucucuacuacaccugucgacacauccaccccuaugacuaccucgacggaggcuucaucuucacccacaaccgcggaggacauuguuguacccaucucuacggccucggaaggauccacacuccucaccagcaucccugucucuaccacacccgucgcauccccugaggcuuccacacucucuaccaccccagucgauuccaauucaccggucgucacgucuaccgagauuuccaguucugcuacaucugcggaaggcacauccaugccaacgucaacuuacagugagggcuccacgcccuugagaagcaugccugucuccacuaagccauuagcaagcucggaggcauccacccucucaacgacacccgucgacacgucgauaccggucacuacaaguaccgaaacuucaucgagcccaacuacugccaaagacaccucaaugccaauaucaacccccuccgaggucucgacaagucugacaucgauccuaguaucuacuaugccugucgccucgagugaagcaucuacacucuccacgaccccgguggauacccgcacucuagucacaaccucgacuggcacaucaucaucuccuacaacagccgaagguucuaguaugccgaccucuacucccggagagcgcuccaccccgcuuacuaauauauuaguaucgacaacucuccucgccaacagugaagcaucgacuuugagcaccacuccgguagauacgagcaccccaguuacuaccucugcugaagccuccucuucgccaaccacugccgagggcaccucgaugcguauauccacgcccucggauggauccacuccccuaacuuccauccucgugagcacccuuccagucgcaucgagcgaggcuucuaccguaucgaccacagcuguagacaccagcauacccguuaccacauccaccgaagcgagcagcuccccuacuaccgcugaggucacuagcaugcccacgucaacaccuucugaaaccucaacuccucugacguccaugccugugaaucacacuccuguggcauccucggaagccggcacccucagcacuacacccguugacaccucuaccccaguuaccacuucaacgaaggccucuucuucacccacaacagcagaggguauaguugucccaauauccacugcuucggaggguagcacucuucucaccucgaucccagucagcacuaccccgguggccucauccgaagccucgacccuaucaaccaccccgguagacaccucaaucccugucacgaccucuacagaagggucuaguucuccaacaacagccgaagggaccucaaugccaauaucgacuccaagcgaaguuucaacuccacucaccuccauccuugucuccaccgucccugucgcaggauccgaggcuuccacgcucuccacaacccccguugauacucgcacuccggugacuacuagcgcggaggccucguccucccccacaacagcagagggaacaaguaugcccauuucgacgccaggugaacggagaacaccacugacaucuaugagcguaucuacuaugcccguagccucaucagaagcuagcacauuaucacgaacucccgcggacacgaguacccccguuacuacauccacugaagcaaguucaucuccaacaacggcagaagguaccgggauuccuauuaguacucccagugagggauccacccccuuaaccucaauucccguaucgaccacccccgucgcaaucccggaggccuccacccugucuaccacuccggucgacaguaacagcccagucgucacuuccacugaggucucuucuucuccaacuccugcagaaggcacauccaugcccaucuccacauauucggaggguuccacaccccugacaggugugccagucucuacgaccccagucacauccucagccaucagcacgcugaguaccacaccugucgacacaucgacuccuguuacuacaagcacagaggcucacuccucgcccacuaccagugagggcacgucuaugccaacauccaccccuuccgagggauccacgccacucacuuauaugccgguaucaacgaugcuaguaguuagcagugaagacuccacucucucugcaaccccaguagacacaucaaccccggucaccaccucaacugaggcaacuuccucuaccaccgcugaaggaacguccauaccuaccucaacccccucggagggaaugaccccauugacuucagucccaguuucuaauacaccugucgccagcuccgaagccucuauccucaguacaacccccgucgauagcaauaccccgcuaacaacgucaacagaagcuagcucaucuccucccacugcugaggguaccucaaugcccaccucaacaccgagcgagggcucuacaccauuaaccucaaugcccguuucaaccacuacagucgcauccucugagacuuccacauugucuacgacaccagccgacacaucuaccccugucacaaccuauucucaggcuucguccucgcccccuaucgccgauggaacaagcaugccuacaucaaccuacagcgaaggaucuacaccccugaccaacaugaguuucuccacaacccccgucgugagcagcgaagccuccacccucagcaccacacccgucgacacaucuaccccagugaccacaaguaccgaggccucccuuucaccaacaacagcugaagguaccuccaucccuacauccucaccuucagagggcacaacgccccuagcaucgaugccaguauccaccacuccugugguuagcagcgaagucaauacccuaucaacuacuccagucgacucuaauacccuaguaacuacgucuacagaagccuccucaagccccacaauagccgaaggaacuucacuucccacaucaaccacuucagagggguccacgccacuaucaauaaugccacucucaaccacacccgucgccagcagugaagccaguacccucucgacuacuccuguugauacuuccaccccaguaacuaccaguucucccacuaauucgaguccuaccacugcugaggucacaaguaugccgacaucaaccgccggcgaggguucaacaccccucacuaauaugccggucucgacaacuccgguagccagcucagaagccuccacucuguccacaacccccguugacucaaacaccuuuguaaccucgucuucgcaggcuucuuccuccccggcaacgcuccaagucacaacaaugagaaugucuacgcccucugaaggcagcuccucucuuaccacaaugcuccucuccuccacuuacguuacuucaucagaagccucgacgccuaguacuccaagcguugaccgaucgacaccaguaacaaccucuacucaaagcaacucaacacccacuccgcccgagguaauaaccuuaccuaugucuaccccaucugaagucucuacaccgcuuacuaucaugccagucucgacaacguccgugaccauaagugaagccggaacggccagcacccuccccguugacaccucuacgccagucauaaccucaacgcaagucagcucgucacccgucaccccugaaggcaccacuaugcccauuuggacgccgucugaagguucgacccccuuaacaacgaugccagucucgacaacccguguuacuucaucggagggcuccacuuuaucuaccccaagugucgucacuucaaccccugugaccacauccacagaagcaauuuccucaagcgcaacccuggauucuaccacaaugucaguuuccaugccaauggaaauaucuaccuuaggcacuacuaucuuaguuucgacuacacccguuaccagauuuccagaguccucaacgccuuccaucccaagugucuauaccucuauguccaugaccaccgccagugaagggagcagcucccccacgacucuugagggaaccacaacuaugcccauguccaccacauccgaaaggucuacacuucuaaccacuguacucauaucuccaauuagcguaaugucuccuuccgaagccucaacauuauccacaccacccggcgauaccucuacaccacuucuuacauccacaaaggcgggcucauucuccaucccugcugaggucacgaccauaagaauuuccaucaccuccgaacgcaguacuccuuuaaccacccuauugguaucgacaacccugccuaccucauuuccaggcgccucgauugcgaguacaccaccccuugauacguccaccacguuuacuccuuccacagacaccgccucaacuccuaccaucccaguagcuacuacuaucuccgucuccguaaucacagaagggagcacgcccggcaccacaauauucauuccgucaaccccagucaccuccucaacugccgacguguucccagcaacgacgggggcaguuucuacgcccgucauuacuucgacagaacuaaacacucccuccacgagcagcucuagcacaacaaccucauucucuaccacuaaagaguucacgacgccagccaugacaacugccgcccccuuaaccuacgucaccaugaguacggccccguccacaccccgcaccaccucgcgcggcuguacuacaagcgcuaguacauuaucugcaaccuccacaccccacacauccacauccguuaccacgcggccaguaacuccgagcagcgagaguuccaggccuuccacuauuacuagccauaccaucccuccuacauuuccacccgcccacucgucgacuccacccacgaccucagcguccagcacuacgguaaaucccgaagcuguuaccaccaugacaacccguacuaaaccaagcacacguacuaccucuuuucccacaguaacgacuaccgcgguccccaccaauacuacgaucaaaagcaaccccacgucuaccccaacaguuccacgcaccacuacuugcuucggcgauggcugccaaaacacugcuucacguugcaaaaacggugguacaugggacggucugaaaugucaaugcccuaaccuguauuacggugagcuaugcgaagaaguaguaucuagcaucgacauugggccacccgaaacgaucuccgcccagauggagcucacugugacuguuacuucugugaaauucaccgaggaacucaaaaaccacuccucacaagaauuucaagaauuuaaacagacauucacugaacagaugaacauaguuuacucaggcauuccggaguacguaggaguuaacauuacaaaacuacgccuggggagcguggucguagaacaugacguucuccuucgcacaaaauacacuccggaauauaaaaccguacuagacaaugcaacagaaguggugaaagaaaagaucacuaaaguuacgacucaacagauaaugauaaaugauaucugcucagauaugauguguuucaauacuacgggcacccaaguccaaaauauaacgguaacccaauaugauccagaagaggacugcaggaaaauggcgaaagaguauggugacuacuucguagucgaguaucgcgaccaaaaaccuuacugcaucaguccuugcgaacccggguucagcguauccaaaaauugcaacuuaggaaaaugccaaaugaguuugagcggaccucaaugccuuugcguuacgacagagacccauugguacagcggugaaaccuguaaccaggguacacagaagucucuagucuauggucucguuggagccggcguaguucuaauguuaauaauauuaguagcccucuugaugcuaguauuccgcaguaaacgcgaaguuaaacgccagaaauaccgcuuaucucagcuguauaaauggcaagaagaagacucaggaccagcccccgggacuuuccagaauaucggguucgauaucugccaagaugacgacucaauucaucuagaaucuauauacuccaauuuccaaccuucacugagacacauagaucccgaaacaaaaauucguauucagcgcccacaggugaugaccaccagcuuuuga

SEQ ID NO: 2466 - RNA, 1215 nt, Artificial Sequence
  Q9NNX6
augucagacucaaaagaaccccgccuccaacaacucggccuccucgaagaagaacaacuacgaggacucggauuccgucaaacaagaggauacaaaagccucgccggaugccugggccacggcccgcucguacuacaacuccucucauucacccuccucgcaggacuccuaguccaagucagcaagguccccuccagcauaucacaagaacaaucgcgccaagacgcaaucuaccaaaaccuaacccaacucaaagcugccgucggagaacucuccgagaaaagcaaacuccaagaaaucuaccaagaacuaacccaacuaaaggccgcgguuggcgaacuccccgaaaaaucaaaacugcaagaaaucuaccaagaacucacccgccuaaaagcagccguaggagaacuaccagaaaagagcaaacuccaggaaauauaccaggaacuaaccuggcucaaggcagccguaggcgaacuacccgagaaaucaaaaaugcaagaaaucuaccaagaacucacacgccucaaagccgccgucggcgaacucccggagaaaagcaaacaacaggaaauauaccaagaacuaacccgccucaaagcagccguaggagaacuacccgaaaaguccaaacaacaagaaaucuaccaagagcucacacgccuaaaagcagcagucggcgaacucccagagaaaagcaaacaacaagaaaucuaccaagaacucacccaacucaaggccgccgucgaacgucucugccaccccugccccugggaauggacauucuuccaaggcaacugcuacuucaugucaaacagccaacgcaacuggcacgacagcauaacagccugcaaagaagucggggcccaacucguaguaaucaaaucagccgaagaacagaacuuccuccaacuccaaagcucacgcucaaacagauucaccuggaugggccuaagcgaccuaaaccaagaaggcaccuggcaguggguagacggaagcccgcuacuacccagcuucaagcaauacuggaaccgaggcgaacccaacaacguaggcgaagaagacugcgccgaguucuccggcaacggcuggaacgacgacaaaugcaaccucgccaaauucuggaucugcaagaaaucggccgcguccugcagccgagacgaagaacaauuccuaagcccagcccccgccacgcccaacccacccccagcauga

SEQ ID NO: 2467 - RNA, 3126 nt, Artificial Sequence; identical to SEQ ID NO: 595
  Q9NR97

SEQ ID NO: 2468 - RNA, 66 nt, Artificial Sequence; identical to SEQ ID NO: 2052
  P16671_TM_1_8-29

SEQ ID NO: 2469 - RNA, 81 nt, Artificial Sequence; identical to SEQ ID NO: 805
  P32248_TM_1_60-86

SEQ ID NO: 2470 - RNA, 66 nt, Artificial Sequence
  P16671_TM_2_440-461
cugcucgggcucauagaaaugauccugcucucggucggggucgugauguuugucgcguucaugauc

SEQ ID NO: 2471 - RNA, 63 nt, Artificial Sequence; identical to SEQ ID NO: 807
  P32248_TM_2_96-116

SEQ ID NO: 2472 - RNA, 66 nt, Artificial Sequence
  P32248_TM_3_131-152
cucaucuucgccaucuacaaaauguccuucuucuccggcaugcuccuccuccucugcaucuccauc

SEQ ID NO: 2473 - RNA, 63 nt, Artificial Sequence
  P32248_TM_4_171-191
gucuugcucauaagcaagcucucgugcgugggcauauggauacucgcgaccgugcucucgauc

SEQ ID NO: 2474 - RNA, 84 nt, Artificial Sequence
  P32248_TM_5_220-247
uucaucaccauccaagucgcccaaauggucaucggcuuccucgucccccuccucgccauguccuucugcuaccucgucaucauc

SEQ ID NO: 2475 - RNA, 78 nt, Artificial Sequence
  P32248_TM_6_264-289
gucaucaucgccgucgucgucgucuucaucgucuuccaacuccccuacaacggcgucguccucgcccaaaccgucgcc

SEQ ID NO: 2476 - RNA, 54 nt, Artificial Sequence
  P32248_TM_7_314-331
cucgcgugcgugcgcuguugcgugaacccguucuuguacgcguucauaggcgug

SEQ ID NO: 2477 - RNA, 69 nt, Artificial Sequence
  A0A5B9_TM_145-167
accauccucuacgaaauccuccucggcaaagccacccucuacgccguccucgucuccgcccucguccuc

SEQ ID NO: 2478 - RNA, 69 nt, Artificial Sequence
  B7Z8K6_TM_130-152
cucggccuccgcaugcucuucgccaaaaccgucgccgucaacuuccuccucaccgccaaacucuucuuc

SEQ ID NO: 2479 - RNA, 63 nt, Artificial Sequence
  O00206_TM_632-652
acgaucauaggcgugagcgugcucucggucuuggucgugagcguggucgcggucuuggucuau

SEQ ID NO: 2480 - RNA, 66 nt, Artificial Sequence; identical to SEQ ID NO: 816
  P01730_TM_397-418

SEQ ID NO: 2481 - RNA, 63 nt, Artificial Sequence; identical to SEQ ID NO: 2065
  P01850_TM_151-171

SEQ ID NO: 2482 - RNA, 78 nt, Artificial Sequence
  P07766_TM_127-152
gucaugagcguggccacgaucgugaucguggacauaugcauaaccgggggcuugcucuugcucguguacuauuggucg

SEQ ID NO: 2483 - RNA, 66 nt, Artificial Sequence; identical to SEQ ID NO: 819
  P08575_TM_576-597

SEQ ID NO: 2484 - RNA, 63 nt, Artificial Sequence; identical to SEQ ID NO: 820
  P08637_TM_209-229

SEQ ID NO: 2485 - RNA, 81 nt, Artificial Sequence; identical to SEQ ID NO: 821
  P10747_TM_153-179

SEQ ID NO: 2486 - RNA, 66 nt, Artificial Sequence
  P11912_TM_144-165
aucaucaccgccgaaggcaucauccuccucuucugcgccgucguccccggcacccuccuccucuuc

SEQ ID NO: 2487 - RNA, 66 nt, Artificial Sequence; identical to SEQ ID NO: 823
  P15391_TM_292-313

SEQ ID NO: 2488 - RNA, 63 nt, Artificial Sequence; identical to SEQ ID NO: 824
  P16410_TM_162-182

SEQ ID NO: 2489 - RNA, 63 nt, Artificial Sequence; identical to SEQ ID NO: 825
  P26718_TM_52-72

SEQ ID NO: 2490 - RNA, 63 nt, Artificial Sequence; identical to SEQ ID NO: 826
  P30273_TM_24-44

SEQ ID NO: 2491 - RNA, 63 nt, Artificial Sequence
  P40259_TM_160-180
ggcaucaucaugauccaaacccuccucaucauccucuucaucaucguccccaucuuccuccuc

SEQ ID NO: 2492 - RNA, 63 nt, Artificial Sequence; identical to SEQ ID NO: 828
  P42081_TM_248-268

SEQ ID NO: 2493 - RNA, 63 nt, Artificial Sequence; identical to SEQ ID NO: 829
  Q15762_TM_255-275

SEQ ID NO: 2494 - RNA, 63 nt, Artificial Sequence; identical to SEQ ID NO: 2078
  Q685J3_TM_4394-4414

SEQ ID NO: 2495 - RNA, 63 nt, Artificial Sequence
  Q9NNX6_TM_38-58
cucggccacggcccccucguccuccaacuccucuccuucacccuccucgccggccuccucguc

SEQ ID NO: 2496 - RNA, 63 nt, Artificial Sequence; identical to SEQ ID NO: 832
  Q9NR97_TM_828-848

SEQ ID NO: 2497 - RNA, 48 nt, Artificial Sequence; identical to SEQ ID NO: 1457
  P14207_1-16

SEQ ID NO: 2498 - RNA, 48 nt, Artificial Sequence; identical to SEQ ID NO: 1458
  O75787_1-16

SEQ ID NO: 2499 - RNA, 48 nt, Artificial Sequence; identical to SEQ ID NO: 1459
  P07359_1-16

SEQ ID NO: 2500 - RNA, 48 nt, Artificial Sequence
  P08637_1-16
auguggcaacuacuucuaccuacagcucuacuucuacuuguaucugca

SEQ ID NO: 2501 - RNA, 51 nt, Artificial Sequence; identical to SEQ ID NO: 1461
  P07237_1-17

SEQ ID NO: 2502 - RNA, 51 nt, Artificial Sequence
  O60911_1-17
augaauuuaucuuuaguuuuagcugcauuuugucuuggaauugcaucugca

SEQ ID NO: 2503 - RNA, 51 nt, Artificial Sequence; identical to SEQ ID NO: 1463
  P20138_1-17

SEQ ID NO: 2504 - RNA, 51 nt, Artificial Sequence; identical to SEQ ID NO: 1464
  P27797_1-17

SEQ ID NO: 2505 - RNA, 54 nt, Artificial Sequence
  P10747_1-18
augcuaagacuacuacuagcccuaaaccuauucccaucaauacaaguaaccgga

SEQ ID NO: 2506 - RNA, 54 nt, Artificial Sequence
  O75487_1-18
auggcucguuuugguuuaccugcucuuuuauguacucuugcuguuuuaucugcu

SEQ ID NO: 2507 - RNA, 54 nt, Artificial Sequence; identical to SEQ ID NO: 1467
  P07996_1-18

SEQ ID NO: 2508 - RNA, 54 nt, Artificial Sequence
  P22748_1-18
augagaaugcuauuagcauuacuagcacuaucagccgcaagaccaagcgcaagc

SEQ ID NO: 2509 - RNA, 54 nt, Artificial Sequence; identical to SEQ ID NO: 1469
  Q15762_1-18

SEQ ID NO: 2510 - RNA, 54 nt, Artificial Sequence; identical to SEQ ID NO: 1470
  P30273_1-18

SEQ ID NO: 2511 - RNA, 54 nt, Artificial Sequence; identical to SEQ ID NO: 1471
  P38570_1-18

SEQ ID NO: 2512 - RNA, 54 nt, Artificial Sequence; identical to SEQ ID NO: 1472
  Q01638_1-18

SEQ ID NO: 2513 - RNA, 54 nt, Artificial Sequence
  Q9NZQ7_1-18
augcguauuuuugccguuuuuauuuuuaugacuuauuggcauuuacuuaaugcu

SEQ ID NO: 2514 - RNA, 57 nt, Artificial Sequence
  P13591_1-19
augcuacaaacaaaagacuuaauauggacauuauucuuccuaggcacagcaguauca

SEQ ID NO: 2515 - RNA, 57 nt, Artificial Sequence
  P26842_1-19
auggcaagaccacauccauggugguuauguguauuaggaacauuaguaggauuaagu

SEQ ID NO: 2516 - RNA, 57 nt, Artificial Sequence; identical to SEQ ID NO: 1476
  P15391_1-19

SEQ ID NO: 2517 - RNA, 57 nt, Artificial Sequence; identical to SEQ ID NO: 1477
  Q8NI17_1-19

SEQ ID NO: 2518 - RNA, 57 nt, Artificial Sequence; identical to SEQ ID NO: 1478
  P08571_1-19

SEQ ID NO: 2519 - RNA, 57 nt, Artificial Sequence; identical to SEQ ID NO: 1479
  P05154_1-19

SEQ ID NO: 2520 - RNA, 57 nt, Artificial Sequence; identical to SEQ ID NO: 1480
  P02787_1-19

SEQ ID NO: 2521 - RNA, 57 nt, Artificial Sequence; identical to SEQ ID NO: 1481
  P02671_1-19

SEQ ID NO: 2522 - RNA, 57 nt, Artificial Sequence
  P04216_1-19
augaaucuagcuauaucuauagcucuauuacuaacuguacuucaaguuagccgugga

SEQ ID NO: 2523 - RNA, 57 nt, Artificial Sequence; identical to SEQ ID NO: 1483
  P00747_1-19

SEQ ID NO: 2524 - RNA, 57 nt, Artificial Sequence
  P01764_1-19
auggaauuuggauuaaguugguuauuuuuaguugcaauuuuaaaaggaguucagugu

SEQ ID NO: 2525 - RNA, 57 nt, Artificial Sequence
  P16150_1-19
auggcuacauuacuauuacuauuaggaguucuaguuguaucuccagaugcauuagga

SEQ ID NO: 2526 - RNA, 57 nt, Artificial Sequence
  Q6DN72_1-19
auguuauuauggacagcaguauuauuauuuguaccauguguaggaaaaacaguaugg

SEQ ID NO: 2527 - RNA, 57 nt, Artificial Sequence; identical to SEQ ID NO: 1487
  Q01151_1-19

SEQ ID NO: 2528 - RNA, 57 nt, Artificial Sequence; identical to SEQ ID NO: 1488
  P07093_1-19

SEQ ID NO: 2529 - RNA, 57 nt, Artificial Sequence; identical to SEQ ID NO: 1489
  Q8WWQ8_1-19

SEQ ID NO: 2530 - RNA, 60 nt, Artificial Sequence; identical to SEQ ID NO: 1490
  Q13291_1-20

SEQ ID NO: 2531 - RNA, 60 nt, Artificial Sequence
  P35225_1-20
auggcacuauuacuaacaacaguaauagcacuaacaugcuuaggcggauucgcaagucca

SEQ ID NO: 2532 - RNA, 60 nt, Artificial Sequence; identical to SEQ ID NO: 1492
  P25942_1-20

SEQ ID NO: 2533 - RNA, 60 nt, Artificial Sequence; identical to SEQ ID NO: 1493
  P52803_1-20

SEQ ID NO: 2534 - RNA, 60 nt, Artificial Sequence; identical to SEQ ID NO: 1494
  Q15116_1-20

SEQ ID NO: 2535 - RNA, 60 nt, Artificial Sequence
  P05556_1-20
augaauuuacaaccaauuuucuggauaggucuaauuucaucuguauguuguguuuucgcu

SEQ ID NO: 2536 - RNA, 60 nt, Artificial Sequence; identical to SEQ ID NO: 1496
  Q12891_1-20

SEQ ID NO: 2537 - RNA, 60 nt, Artificial Sequence; identical to SEQ ID NO: 1497
  Q8IV16_1-20

SEQ ID NO: 2538 - RNA, 60 nt, Artificial Sequence; identical to SEQ ID NO: 1498
  Q03167_1-20

SEQ ID NO: 2539 - RNA, 60 nt, Artificial Sequence
  Q14246_1-20
augagaggguuuaauuuauuguuauuuuggggguguuguguuaugcauaguugggagggu

SEQ ID NO: 2540 - RNA, 60 nt, Artificial Sequence
  P16871_1-20
augacuauauuaggaacuacauuuggaaugguauuuucauuauuacaaguaguuucaggu

SEQ ID NO: 2541 - RNA, 60 nt, Artificial Sequence; identical to SEQ ID NO: 1501
  P61769_1-20

SEQ ID NO: 2542 - RNA, 60 nt, Artificial Sequence; identical to SEQ ID NO: 1502
  Q9Y6W8_1-20

SEQ ID NO: 2543 - RNA, 63 nt, Artificial Sequence; identical to SEQ ID NO: 1503
  P10966_1-21

SEQ ID NO: 2544 - RNA, 63 nt, Artificial Sequence; identical to SEQ ID NO: 1504
  Q9BZW8_1-21

SEQ ID NO: 2545 - RNA, 63 nt, Artificial Sequence; identical to SEQ ID NO: 1505
  P02778_1-21

SEQ ID NO: 2546 - RNA, 63 nt, Artificial Sequence; identical to SEQ ID NO: 1506
  P18564_1-21

SEQ ID NO: 2547 - RNA, 63 nt, Artificial Sequence; identical to SEQ ID NO: 1507
  O14525_1-21

SEQ ID NO: 2548 - RNA, 63 nt, Artificial Sequence; identical to SEQ ID NO: 1508
  P01130_1-21

SEQ ID NO: 2549 - RNA, 63 nt, Artificial Sequence
  P01732_1-21
auggccuuaccaguuacagcucuauuacuaccucuagcucuauuacuacaugccgcuagaccu

SEQ ID NO: 2550 - RNA, 63 nt, Artificial Sequence; identical to SEQ ID NO: 1510
  P48061_1-21

SEQ ID NO: 2551 - RNA, 63 nt, Artificial Sequence; identical to SEQ ID NO: 1511
  P01589_1-21

SEQ ID NO: 2552 - RNA, 63 nt, Artificial Sequence; identical to SEQ ID NO: 1512
  Q86T13_1-21

SEQ ID NO: 2553 - RNA, 63 nt, Artificial Sequence; identical to SEQ ID NO: 1513
  Q5DID0_1-21

SEQ ID NO: 2554 - RNA, 66 nt, Artificial Sequence
  P40189_1-22
augcuaacacuacaaaccuggcuaguacaagcacuauuuauauuucuaacaacagaaagcacaggc

SEQ ID NO: 2555 - RNA, 66 nt, Artificial Sequence; identical to SEQ ID NO: 1515
  Q86YL7_1-22

SEQ ID NO: 2556 - RNA, 66 nt, Artificial Sequence
  P55075_1-22
auggguucaccuagaucugcacuuucaugucuacuucuacauuuacuuguacuuugccuucaagcu

SEQ ID NO: 2557 - RNA, 66 nt, Artificial Sequence; identical to SEQ ID NO: 1517
  Q30201_1-22

SEQ ID NO: 2558 - RNA, 66 nt, Artificial Sequence; identical to SEQ ID NO: 1518
  P07766_1-22

SEQ ID NO: 2559 - RNA, 66 nt, Artificial Sequence; identical to SEQ ID NO: 1519
  P18827_1-22

SEQ ID NO: 2560 - RNA, 66 nt, Artificial Sequence; identical to SEQ ID NO: 1520
  P55290_1-22

SEQ ID NO: 2561 - RNA, 66 nt, Artificial Sequence; identical to SEQ ID NO: 1521
  P37173_1-22

SEQ ID NO: 2562 - RNA, 66 nt, Artificial Sequence; identical to SEQ ID NO: 1522
  Q07325_1-22

SEQ ID NO: 2563 - RNA, 66 nt, Artificial Sequence; identical to SEQ ID NO: 1523
  P04156_1-22

SEQ ID NO: 2564 - RNA, 66 nt, Artificial Sequence
  P31785_1-22
augcuuaaaccuucucuuccuuuuacuucucuucuuuuucuucaacuuccucuucuuggcgucggc

SEQ ID NO: 2565 - RNA, 69 nt, Artificial Sequence; identical to SEQ ID NO: 1525
  P01579_1-23

SEQ ID NO: 2566 - RNA, 69 nt, Artificial Sequence; identical to SEQ ID NO: 1526
  P23229_1-23

SEQ ID NO: 2567 - RNA, 69 nt, Artificial Sequence
  O60494_1-23
augaugaauaugucucuuccuuuucuuuggucuuuacuuacucuuuuaauuuuugcugaaguuaauggu

SEQ ID NO: 2568 - RNA, 69 nt, Artificial Sequence
  P08575_1-23
auguauuuauggcuaaaauuacuugcauuuggauuugcauuucuagauacagaaguauuuguaacugga

SEQ ID NO: 2569 - RNA, 69 nt, Artificial Sequence; identical to SEQ ID NO: 1529
  Q8IWY4_1-23

SEQ ID NO: 2570 - RNA, 69 nt, Artificial Sequence
  Q08431_1-23
augccuagaccuagauuauuagcugcauuauguggugcauuauuaugugcaccuucauuauuaguugca

SEQ ID NO: 2571 - RNA, 69 nt, Artificial Sequence; identical to SEQ ID NO: 1531
  Q99665_1-23

SEQ ID NO: 2572 - RNA, 69 nt, Artificial Sequence
  Q6Q8B3_1-23
augucagcaccaagauuacuaauaagcauaauaauaaugguaagcgcaagcucaagcucaugcauggga

SEQ ID NO: 2573 - RNA, 69 nt, Artificial Sequence
  Q07011_1-23
augggaaauagcuguuacaauauaguggcaacacuacuauuaguacuaaauuucgaaagaacaagauca

SEQ ID NO: 2574 - RNA, 69 nt, Artificial Sequence; identical to SEQ ID NO: 1534
  Q8NHL6_1-23

SEQ ID NO: 2575 - RNA, 69 nt, Artificial Sequence
  P36894_1-23
augccacaacuauacauauacaucagacuacuaggcgcauaccuauucauaauaucaagaguacaagga

SEQ ID NO: 2576 - RNA, 69 nt, Artificial Sequence
  Q16552_1-23
augaccccaggcaaaacaagccuaguaucacuacuauuacucuuaagccuagaagcaauaguaaaagca

SEQ ID NO: 2577 - RNA, 69 nt, Artificial Sequence; identical to SEQ ID NO: 1537
  P42081_1-23

SEQ ID NO: 2578 - RNA, 69 nt, Artificial Sequence; identical to SEQ ID NO: 1538
  P43121_1-23

SEQ ID NO: 2579 - RNA, 69 nt, Artificial Sequence; identical to SEQ ID NO: 1539
  O00206_1-23

SEQ ID NO: 2580 - RNA, 69 nt, Artificial Sequence
  P42701_1-23
auggaaccuuuaguuacauggguaguuccauuauuauuuuuauuuuuauuaucacgucaaggugcagcu

SEQ ID NO: 2581 - RNA, 72 nt, Artificial Sequence; identical to SEQ ID NO: 1541
  P06729_1-24

SEQ ID NO: 2582 - RNA, 72 nt, Artificial Sequence; identical to SEQ ID NO: 1542
  P15328_1-24

SEQ ID NO: 2583 - RNA, 72 nt, Artificial Sequence
  P05112_1-24
augggacuuacaucucaacuuuuaccuccacuuuuuuuuuuacuugcaugugcagguaauuuuguacaugga

SEQ ID NO: 2584 - RNA, 72 nt, Artificial Sequence
  P06127_1-24
augccuauggguucacuucaaccuuuagcuacacuuuaucuuuuagguaugcuuguagcuucauguuuaggu

SEQ ID NO: 2585 - RNA, 72 nt, Artificial Sequence; identical to SEQ ID NO: 1545
  P32248_1-24

SEQ ID NO: 2586 - RNA, 72 nt, Artificial Sequence; identical to SEQ ID NO: 1546
  Q7Z7D3_1-24

SEQ ID NO: 2587 - RNA, 72 nt, Artificial Sequence; identical to SEQ ID NO: 1547
  P54756_1-24

SEQ ID NO: 2588 - RNA, 72 nt, Artificial Sequence; identical to SEQ ID NO: 1548
  Q92823_1-24

SEQ ID NO: 2589 - RNA, 72 nt, Artificial Sequence; identical to SEQ ID NO: 1549
  P19320_1-24

SEQ ID NO: 2590 - RNA, 72 nt, Artificial Sequence; identical to SEQ ID NO: 1550
  Q86UN2_1-24

SEQ ID NO: 2591 - RNA, 75 nt, Artificial Sequence
  P33151_1-25
augcaaagauuaaugauguuauuagcaacaucaggagcauguuuaggauuauuagcaguagcagcaguagcagca

SEQ ID NO: 2592 - RNA, 75 nt, Artificial Sequence
  P17813_1-25
auggaccguggaacucuaccucuagcuguagcucuauuacuagcuucauguucacuuucaccuacaucucuagcu

SEQ ID NO: 2593 - RNA, 75 nt, Artificial Sequence
  P25445_1-25
augcuaggaauauggacacuacuaccauuaguacuaacaagcguagcaagacuaucaagcaaaagcguaaacgca

SEQ ID NO: 2594 - RNA, 75 nt, Artificial Sequence
  P01730_1-25
augaauagagguguaccuuuccgucaucuuuuacuuguacuucaacuugcacuuuuaccugcagcuacacaagga

SEQ ID NO: 2595 - RNA, 75 nt, Artificial Sequence
  Q685J3_1-25
augccaagaccaggaacaauggcacuaugccuacuaacauuaguacuaucacuacuaccaccacaagcagcagca

SEQ ID NO: 2596 - RNA, 75 nt, Artificial Sequence; identical to SEQ ID NO: 1556
  P17787_1-25

SEQ ID NO: 2597 - RNA, 75 nt, Artificial Sequence
  Q6UQ28_1-25
auggcaguuuuccaugacaugcuacuucaaccuuuagguauguuucuaugucuaucucuacaauuaucuucagcu

SEQ ID NO: 2598 - RNA, 75 nt, Artificial Sequence; identical to SEQ ID NO: 1558
  P13987_1-25

SEQ ID NO: 2599 - RNA, 75 nt, Artificial Sequence; identical to SEQ ID NO: 1559
  P10721_1-25

SEQ ID NO: 2600 - RNA, 75 nt, Artificial Sequence; identical to SEQ ID NO: 1560
  P12319_1-25

SEQ ID NO: 2601 - RNA, 78 nt, Artificial Sequence; identical to SEQ ID NO: 1561
  Q9BZR6_1-26

SEQ ID NO: 2602 - RNA, 78 nt, Artificial Sequence; identical to SEQ ID NO: 1562
  P25063_1-26

SEQ ID NO: 2603 - RNA, 78 nt, Artificial Sequence
  Q9NR97_1-26
auggagaauauguuuuugcaaucgaguaugcuuacguguauauucuuacucauaagcggaagcugugaauugugugcg

SEQ ID NO: 2604 - RNA, 78 nt, Artificial Sequence; identical to SEQ ID NO: 1564
  Q8N131_1-26

SEQ ID NO: 2605 - RNA, 78 nt, Artificial Sequence
  P49771_1-26
augacuguucuugcuccugcuuggucuccuacuacuuaucuuuuacuuuuacuuuuacuuucuucuggucuuucuggu

SEQ ID NO: 2606 - RNA, 78 nt, Artificial Sequence; identical to SEQ ID NO: 1566
  P02679_1-26

SEQ ID NO: 2607 - RNA, 78 nt, Artificial Sequence
  P14784_1-26
auggcugcuccugcuuuaucuuggcguuuaccuuuacuuauucuuuuacuuccucuugcuacuucuugggcuucugcu

SEQ ID NO: 2608 - RNA, 81 nt, Artificial Sequence; identical to SEQ ID NO: 1568
  P05362_1-27

SEQ ID NO: 2609 - RNA, 81 nt, Artificial Sequence
  Q13740_1-27
auggaaucaaaaggagcuucaucuugucgucuauuauucugucuauuaauaucugcaacuguauuuagaccuggacuugga

SEQ ID NO: 2610 - RNA, 84 nt, Artificial Sequence; identical to SEQ ID NO: 1570
  Q13443_1-28

SEQ ID NO: 2611 - RNA, 84 nt, Artificial Sequence; identical to SEQ ID NO: 1571
  P14151_1-28

SEQ ID NO: 2612 - RNA, 84 nt, Artificial Sequence; identical to SEQ ID NO: 1572
  P56199_1-28

SEQ ID NO: 2613 - RNA, 84 nt, Artificial Sequence
  P11279_1-28
auggcugcaccuggaucugcacguagaccuuuacuucuauuauuauuauuacuuuuacuuggacuuaugcauugcgcuucagcu

SEQ ID NO: 2614 - RNA, 84 nt, Artificial Sequence
  P40259_1-28
auggcaagauuagcauuaucaccaguaccaucacauuggaugguagcacuauuacuauuacuaucagcagaaccaguaccagca

SEQ ID NO: 2615 - RNA, 84 nt, Artificial Sequence; identical to SEQ ID NO: 1575
  P43681_1-28

SEQ ID NO: 2616 - RNA, 84 nt, Artificial Sequence; identical to SEQ ID NO: 1576
  P18627_1-28

SEQ ID NO: 2617 - RNA, 84 nt, Artificial Sequence; identical to SEQ ID NO: 1577
  Q5ZPR3_1-28

SEQ ID NO: 2618 - RNA, 84 nt, Artificial Sequence
  P23415_1-28
auguauucauuuaacacucuacgucuauaucuaugggaaacuauaguuuucuuuucacuugcagcuucaaaagaagcugaagcu

SEQ ID NO: 2619 - RNA, 84 nt, Artificial Sequence; identical to SEQ ID NO: 1579
  Q8TD46_1-28

SEQ ID NO: 2620 - RNA, 87 nt, Artificial Sequence; identical to SEQ ID NO: 1580
  P17301_1-29

SEQ ID NO: 2621 - RNA, 87 nt, Artificial Sequence; identical to SEQ ID NO: 1581
  P12821_1-29

SEQ ID NO: 2622 - RNA, 87 nt, Artificial Sequence
  Q14118_1-29
augcguaugaguguagguuuaaguuuacuuuugccuuuauggggacguacauuuuuacuuuuacuuucaguuguaauggcacaauca

SEQ ID NO: 2623 - RNA, 87 nt, Artificial Sequence; identical to SEQ ID NO: 1583
  P05231_1-29

SEQ ID NO: 2624 - RNA, 87 nt, Artificial Sequence; identical to SEQ ID NO: 1584
  O00602_1-29

SEQ ID NO: 2625 - RNA, 87 nt, Artificial Sequence; identical to SEQ ID NO: 1585
  Q9Y6Q6_1-29

SEQ ID NO: 2626 - RNA, 87 nt, Artificial Sequence
  Q9ULI3_1-29
auggcaucuccacgugcaucuagauggccaccuccacuucuacuucuacuucuaccucuacuucuacuuccuccagcagcuccaggu

SEQ ID NO: 2627 - RNA, 90 nt, Artificial Sequence; identical to SEQ ID NO: 1587
  Q8NBP7_1-30

SEQ ID NO: 2628 - RNA, 90 nt, Artificial Sequence; identical to SEQ ID NO: 1588
  P02675_1-30

SEQ ID NO: 2629 - RNA, 90 nt, Artificial Sequence; identical to SEQ ID NO: 1589
  P06756_1-30

SEQ ID NO: 2630 - RNA, 93 nt, Artificial Sequence
  O60609_1-31
augguaagaccacuaaacccaagaccacuaccaccaguaguacuaaugcuacuauuacuacuaccaccaucaccacuaccauuagcagcagga

SEQ ID NO: 2631 - RNA, 93 nt, Artificial Sequence; identical to SEQ ID NO: 1591
  P50895_1-31

SEQ ID NO: 2632 - RNA, 93 nt, Artificial Sequence; identical to SEQ ID NO: 1592
  P28906_1-31

SEQ ID NO: 2633 - RNA, 93 nt, Artificial Sequence; identical to SEQ ID NO: 1593
  P08514_1-31

SEQ ID NO: 2634 - RNA, 93 nt, Artificial Sequence; identical to SEQ ID NO: 1594
  P00742_1-31

SEQ ID NO: 2635 - RNA, 96 nt, Artificial Sequence; identical to SEQ ID NO: 1595
  P26006_1-32

SEQ ID NO: 2636 - RNA, 96 nt, Artificial Sequence; identical to SEQ ID NO: 1596
  P13726_1-32

SEQ ID NO: 2637 - RNA, 96 nt, Artificial Sequence
  P11912_1-32
augccaggaggaccaggaguacuacaagcauuaccagcaacaauauucuuacuauuucuauuaucagcaguauaucuaggaccaggaugucaagca

SEQ ID NO: 2638 - RNA, 96 nt, Artificial Sequence
  Q9H6X2_1-32
auggcaacagcagaaagaagagcauuaggaauaggauuucaaugguuaaguuuagcaacauuaguacuaauaugugcaggacaaggaggaagaaga

SEQ ID NO: 2639 - RNA, 99 nt, Artificial Sequence; identical to SEQ ID NO: 1599
  Q8IWK6_1-33

SEQ ID NO: 2640 - RNA, 99 nt, Artificial Sequence; identical to SEQ ID NO: 1600
  P58335_1-33

SEQ ID NO: 2641 - RNA, 102 nt, Artificial Sequence; identical to SEQ ID NO: 1601
  P06731_1-34

SEQ ID NO: 2642 - RNA, 102 nt, Artificial Sequence; identical to SEQ ID NO: 1602
  P33681_1-34

SEQ ID NO: 2643 - RNA, 105 nt, Artificial Sequence
  P38567_1-35
augggcguacuaaaauucaaacacauauucuucagaucauucguaaaaucauccggagucucacaaauagucuucacauuccuacuaauaccaugcugccuaaca

SEQ ID NO: 2644 - RNA, 105 nt, Artificial Sequence; identical to SEQ ID NO: 1604
  P16410_1-35

SEQ ID NO: 2645 - RNA, 111 nt, Artificial Sequence
  P15814_1-37
augagaccaggaacaggacaaggaggauuagaagcaccaggagaaccaggaccaaauuuaagacaaagauggccauuauuauuauuaggauuagcaguaguaacucaugga

SEQ ID NO: 2646 - RNA, 114 nt, Artificial Sequence; identical to SEQ ID NO: 1606
  Q92956_1-38

SEQ ID NO: 2647 - RNA, 123 nt, Artificial Sequence
  Q86VB7_1-41
augucaaaacuacguaugguuuuacuugaagauucagguucagcugacuuuagacgucacuuuguaaaucuaucuccauuuacaauuacaguuguacuucuacuuucagcuugcuuuguaacu

SEQ ID NO: 2648 - RNA, 123 nt, Artificial Sequence; identical to SEQ ID NO: 1608
  P08648_1-41

SEQ ID NO: 2649 - RNA, 123 nt, Artificial Sequence; identical to SEQ ID NO: 1609
  P16109_1-41

SEQ ID NO: 2650 - RNA, 132 nt, Artificial Sequence; identical to SEQ ID NO: 1610
  O75326_1-44

SEQ ID NO: 2651 - RNA, 135 nt, Artificial Sequence
  Q8N2Q7_1-45
auggcauuaccaagauguacauggccaaauuauguauggagagcaguaauggcauguuuaguacauagaggauuaggagcaccauuaacauuauguauguuaggauguuuauuacaagcaggacauguauuauca

SEQ ID NO: 2652 - RNA, 138 nt, Artificial Sequence
  Q86UN3_1-46
augcuuccuggucuucgucgucuucuucaagcuccugcuucugcuugucuucuucuuauguuacuugcuuuaccucuugcugcuccuucuuguccuaugcuuuguacuuguuauucuucuccuccuacuguuucuugu

SEQ ID NO: 2653 - RNA, 540 nt, Artificial Sequence
  A0A5B9
auggaccuaaaaaacguauucccaccagaaguagcaguauucgaaccaucagaagcagaaauaucacacacacaaaaagcaacccuaguaugccuagcaacaggauuuuacccagaccauguagaacuaucaugguggguaaacggaaaagaaguacacucaggaguaucaacagacccacaaccacuaaaagaacaaccagcacuaaaugacucaagauauugcuuaucaucaagauuaagaguaucagcaacauucuggcaaaacccaagaaaccacuuuagaugccaaguacaauucuacggacuaucugaaaacgacgaauggacacaagacagagcaaaaccaguaacacaaauaguaucagccgaagcauggggaagagcagacugcggauucacaucagaaucauaccaacaaggaguacuaucagcaacuauauuauacgaaauacuacuaggaaaagcaacacuuuacgcaguauuaguaucagcauuaguacuaauggcaauggucaaaagaaaagacagcagaggauaa

SEQ ID NO: 2654 - RNA, 465 nt, Artificial Sequence
  B7Z8K6
augucacaaccacacacaaaaccaucaguauucguaaugaaaaacggaacaaauguagccugccuaguaaaagaauucuacccaaaagacauacgaauaaaccuaguaucaucaaaaaaaauaacagaauucgacccagcaauaguaauaucaccaucaggaaaauacaacgcaguaaaauuaggcaaauacgaagacucaaacucaguaacaugcucaguacaacacgacaacaaaacaguacacucaacagacuucgaaguaaaaacagacucaacagaccacguaaaaccaaaagaaacagaaaacacaaaacaaccauccaaaucaugccacaaaccaaaagcaauaguacacacagaaaaaguaaacaugaugucacuaacaguacuaggacuaagaaugcuauucgcaaaaacaguagcaguaaacuuccuacuaacagcaaaauuauucuuccuauaa

SEQ ID NO: 2655 - RNA, 645 nt, Artificial Sequence
  B9A064
augagaccaaaaacaggacaagucggcugcgaaacaccagaagaacuaggaccaggaccaagacaaagauggccauuauuauuacuaggacuagcaaugguagcacacggauuauuaagaccaaugguagcaccacaaucaggagauccagauccaggagcaucaguaggaaguucaagaucaucauuaagaucauuauggggaagacuauuacuacaaccaucaccacaaagagcagacccacgauguuggccaagaggauucuggucagaaccacaaucauuaugcuacguauuuggcacaggaacuaaaguaacaguacuaggacaaccaaaagcaaacccaacaguaacauuauuuccaccuucaagcgaagaauuacaagcaaacaaagcaacauuaguaugccuaauaucagacuuuuacccuggagcaguaacaguagcauggaaagccgauggaucucccguaaaagcaggaguagaaacaacaaaaccaucaaaacaaaguaauaacaaauacgcagcuucaaguuaucuaucucuaacaccagaacaauggaaaucacacagaucauacucaugucaaguaacacaugaaggaucaacaguagaaaaaacagucgcaccaacagaauguucauga

SEQ ID NO: 2656 - RNA, 2520 nt, Artificial Sequence
  O00206
augaugucagccagcagacucgcaggcacauuaauuccugcaauggcauucuuaucaugcguuagacccgaaucaugggaaccaugcguagaagucguaccuaacauaaccuaucaaugcauggaauuaaacuuuuauaaaauaccugacaauuuaccauuuucaacuaaaaaucuagaccuaucuuucaauccccuccgucacuuaggaucauacaguuucuuuucuuucccagaauuacaaguacuugaucuaucacgaugugaaauucaaacaauagaagauggagccuaccaauccuuaucacaucucucaaccuuaauacuaacaggaaaccccauccaaucucuagcccuuggcgcauucucaggcuuauccagccuacaaaagcuaguugccguagaaacaaaccucgcaucacuagaaaacuucccaauaggacaccuaaaaacacucaaagaacuaaacguugcucacaaucuaauccaaucuuucaaauuaccagaauacuuuucuaaucuuacaaaccuagaacaccuagaccucagcuccaauaaaauacaguccauauauugcacagauuuacgcguacuccaucaaaugccacucuuaaaucucucccuagaccuaucucucaauccaaugaacuucauacaaccaggcgcauuuaaagaaaucagacuccacaaacucacucuacguaauaauuucgacucauuaaacguuaugaaaacauguauacaagguuuagcaggucuagaaguucacagacuuguccuaggcgaauuucgaaacgaagguaaucuugaaaaauucgacaaaucagcgcuagaaggccuaugcaaccuaaccaucgaagaauuuagacuagcauaccuugacuacuauuuagacgacauaauagaucuauucaauugcuuaacaaauguaagcucauucaguuuagugucaguaacgauagaacguguuaaagacuuuucuuauaauuucgguuggcaacaucucgaacugguaaacugcaaauucggacaauuucccacacuaaaacuaaaaucucuaaaacgccuaacauucacgucaaacaaaggaggaaacgcauucucagaaguagaccuaccuucccuugaauuucucgacuuaucacgcaacggauuaucuuuuaaaggcuguugcucacaaucagauuucggaacuacuucucuaaaauauuuagaucucuccuuuaacggaguuauuacuaugucauccaacuuuuuaggacuggaacaacuugaacacuuagacuuccaacacucaaacuuaaaacaaaugucggaauuuucuguauucuuaucccucagaaaccucauauaccuagacauaucgcacacccacacccgaguagcauuuaacggaauauucaauggucucaguucccuugaaguccuuaaaauggcagguaacucuuuccaagaaaacuucuuacccgacauauuuacagaacuacgaaauuugacauuccucgaccuaucucaaugucaacuagaacaauuaucaccaacagcuuuuaauagcuuaucaucacuacaaguacuaaacaugucccacaacaacuucuucucacuagacaccuucccauacaaaugccuaaauucacuccaaguccuagacuacucacugaaccacaucaugacuucuaagaaacaagaacuucaacacuuuccaucaucacucgcuuucuuaaaucucacacaaaaugauuuugccuguacuugcgaacaccaauccuucuuacaauggauaaaagaucaacgccaacuauuaguagaaguagaaagaauggaaugugcuacccccucagacaaacaaggcaugccagucuuauccuuaaacauaacaugccaaaugaacaaaaccauaauuggagugagcguacuuucaguccucgucgucuccguagucgccguacuuguauacaaauucuauuuucacuuaauguuauuagcaggaugcauaaaauauggaagaggagaaaacauauaugaugcauucguuauuuacucaucccaagacgaagacuggguacguaaugaauuagugaaaaacuuagaagaaggcguaccaccauuucaacuaugucuacacuaccgugacuucauucccggaguagcaauagccgcaaauaucauacacgaaggauuccauaaaucacgaaaaguuaucguaguuguaucucaacauuucauacaaucuagaugguguauauuugaauaugaaauugcccaaaccuggcaauuucucucuucuagagcaggaauaauuuucaucguccuacaaaaaguugagaaaacacuacuccgucaacaaguagaauuauaccgcuuacuaaguagaaauaccuacuuagaaugggaagacuccguauuaggaagacacauauucuggagaagacuaagaaaagcccuauuagauggaaaaucauggaacccagaaggcacagucggcacagguuguaacuggcaagaagcuacaucaauauga

SEQ ID NO: 2657 - RNA, 1377 nt, Artificial Sequence
  P01730
augaacagagguguuccuuucagacacuuacuacucgucuuacaacuugcacuacuaccagcagcaacacaagguaaaaaagucguccuagggaaaaaaggagauacggucgaacuaacaugcacagcuucacagaaaaaauccauacaauuucauuggaaaaauagcaaccaaauaaaaauccuaggaaaucaaggaucauuccuaacaaaaggaccaucaaaacucaacgacagagcagacucaagaagaucacuaugggaccaaggaaauuucccacucaucaucaaaaaccuaaaaauagaagauucagauacauacaucugugaaguagaagaccaaaaagaagaaguacaauuauuagucuucggacucacagcaaacucagacacacauuuacuacaaggacaaucacuaacucuaacccuagaaaguccaccaggcucaagcccaaguguacaaugcagaucaccaagaggaaaaaauauacaaggcggaaaaacacuaucaguaucacaauuagaacuccaagacucaggaacauggacuugcacaguacuacaaaaccaaaaaaaaguagaauuuaaaauagacauagucguacuagcauuccaaaaggcaagcucaauaguauacaaaaaagaaggagagcaaguagaauucuccuucccacuagcauucacaguagaaaaauuaacaggaucaggagaacuaugguggcaagccgaacgagcuagcuccucaaaaucauggauaacauucgaccuaaaaaacaaagaaguaucagucaaaagaguaacucaagauccaaaacuccaaaugggaaaaaaauuaccauuacacuuaacucuaccucaagcccuuccacaauacgcagguucaggaaaccucacucuagcauuagaagccaaaacaggcaaacuacaucaagaaguaaaccuaguaguaaugagagccacgcaacuacaaaaaaacuuaacaugcgaaguauggggacccacuucacccaaacucaugcuaucacuaaaacucgaaaacaaagaagccaaaguaucaaaaagagaaaaagcaguauggguucuaaacccagaagcaggaauguggcaaugccuauuaucagacuccggucaaguacuauuagaaucaaacauaaaaguacucccaacauggucgacaccaguucaaccaauggcacuaaucguccuaggaggcguagcaggacuacuccuauuuauaggcuuaggaauauucuucugcguaagaugcagacauagaagaaggcaagcagaaagaaugucacaaaucaaaagauuacuaagugaaaaaaaaacaugccaauguccacauagauuccaaaaaacaugcucaccaauauga

SEQ ID NO: 2658 - RNA, 537 nt, Artificial Sequence
  P01850
auggaagauuuaaauaaaguauucccaccagaaguagcaguauuugaaccaagugaagccgaaauaucacacacacaaaaagcaacucuaguaugccuagcaacaggauuuuucccagaccaugucgaauuaucaugguggguaaauggaaaggaaguacacucaggaguaagcacagacccacaaccacuaaaagaacaaccugcacuaaaugacucaagauauugcuuaagcucaagacuaagaguaagcgcaacauuuuggcaaaacccaagaaaucacuuuagaugucaaguacaauuuuacggacuaucagaaaacgacgaauggacacaagauagagcuaaaccaguaacacaaauaguaucagcagaagcauggggcagagcagauugcggauucacaagcguuagcuaucaacaaggaguauuaucagcaacaauauuauacgaaauauuauuaggaaaagcaacauuauacgcaguauuaguaucggcauuaguauuaauggcaaugguaaaaagaaaagauuucuaa

SEQ ID NO: 2659 - RNA, 624 nt, Artificial Sequence
  P07766
augcaaucagggacacauuggagaguauuaggacuaugcuuauuaucaguaggaguauggggacaagacggaaacgaagaaaugggaggaauaacacaaacaccauauaaaguaagcauaaguggaacaacaguaauacuaacaugcccacaauauccaggaagugaaauauuauggcaacacaaugacaaaaacauaggaggagacgaagacgauaaaaauauaggaagcgaugaagaucaccuaaguuuaaaagaauuuagugaauuagaacaaagcggauacuauguauguuacccaagaggaagcaaaccagaagacgcaaacuucuacuuauauuuaagagcaagaguaugcgaaaacuguauggaaauggaugucaugagcguagcaacaauaguaauaguagacauaugcauaacaggaggauuauuacuauuaguauacuauuggagcaaaaauagaaaagcaaaagccaaaccaguaacaaggggagcaggagcaggaggacgacaaagaggacaaaauaaagaaagaccaccaccaguaccaaacccagacuaugaaccaauaaggaaaggacaaagagaccuauacucaggacuaaaccaaagaagaauauga

SEQ ID NO: 2660 - RNA, 3915 nt, Artificial Sequence
  P08575
auguaucucugguuaaaacuucuugcuuuuggauucgcuuuucuagacacugagguuuuuguaacagggcaaucgccaaccccuucaccaacaggcuuaacgaccgcuaaaaugccaucaguaccacuaagcagcgauccgcugccaacucauacuacagcauucagcccagcuaguacauucgaacgagaaaacgauuuuucugaaaccacuacuagccucucaccugacaacaccucaacucaaguaucaccugauuccuuagacaacgcaucugcuuucaacacaaccggcguaucaucaguucaaacaccccaccucccaacgcacgcagacagucaaaccccauccgcaggcacagacacccaaaccuucucagggucagcagccaacgcaaaauuaaauccuacuccugguucaaacgcaauaagcgauguaccaggagaaagaucgaccgccucaacuuuuccaacugauccaguaucaccccuaacgacaacauuaucauuagcacaccauuccucagcagcacuaccagcaaggacaucaaacacaacaauaaccgcaaacacaucagacgcauaccucaaugcuuccgagacgaccacuuuaagccccucaggcucagcaguaaucucaacuaccacaauugccacaaccccaucaaagccuacaugcgacgaaaaauaugccaauauaacaguagauuaucuauauaauaaagaaacaaaacuauucacagcaaaacucaauguaaacgaaaauguagaaugcggaaacaauacuuguacaaacaaugaaguucauaaucucacagaauguaaaaacgcuucaguauccauaagucacaacucaugcacagcuccagacaaaaccuuaauauuagacgucccacccggggucgaaaaauuucaacuacaugauugcacacaaguugaaaaagcugauacuacuaucugucucaaauggaagaauauagaaacauucacuugcgacacacaaaacauuacauacagguuucaaugcgguaacaugauauucgacaauaaagaaauuaaacuugaaaaccuagaaccggaacacgaauacaaaugcgauucugaaauucuauauaacaaccauaaauucacgaaugcaucuaaaauuauaaaaacugacuucgguucacccggcgaaccacaaauuauauucugucgaucugaagccgcccaccaaggaguaauaacuuggaaucccccacaaagaucuuuccauaauuucacucucugcuauauaaaagaaacagagaaggacugucuaaaccuugauaaaaauuuaauuaaauacgaccuucaaaaucuaaaaccauauacaaaauacguacugagccuacaugcguacauaaucgcaaaaguucaaagaaaugggucagcggccaugugucacuucacaacgaaaagcgcaccacccucacaagucuggaauaugacgguaagcaugaccucagacaacaguaugcacguuaagugccgaccaccaagagauagaaauggaccacacgaaagauaccaucuggagguagaagccggaaacacauuaguacgcaacgaaucacacaaaaacugugauuucaggguuaaagaucuucaauacucaaccgauuacaccuucaaggcauauuuccauaauggagacuacccaggugaaccuuucauuuuacaccauucaacuucauacaacuccaaagcacucauagcauuucuagcguuuuugaucauaguaacaucuaucgccuugcuagugguacuauacaagauuuaugaccuacauaaaaagcgaaguugcaaccuagaugaacaacaagaauuaguagaaagggaugacgaaaaacaacuaaugaacguagagccuauccaugcagacauacuccuagaaaccuacaaaagaaaaauagcagaugaaggaagacuauuucuugcagaauuucaauccauaccaagaguauuuucaaaauuccccauuaaagaagcgagaaaaccauucaaucaaaauaaaaauagauauguagauauucugccauacgacuacaaccguguagaauuaucagaaauaaacggugacgcagguuccaacuauauaaacgccucauauauagauggcuucaaagaaccgcgaaaauacauugcugcacaaggaccccgagaugaaacaguagacgauuucuggagaaugauaugggaacaaaaagcuacaguuauaguaauggucacucgaugugaagaaggaaacagaaacaaaugugcagaauacuggccuagcauggaagaaggcacuagagccuucggcgauguagucguaaaaauaaaucagcacaaaagaugcccugacuacauuauucaaaaacuaaacauugucaacaaaaaggaaaaagcuacaggacgggaaguaacgcacauccaauuuaccagcuggcccgaucacggcguaccugaggauccccaccuguuauuaaaauuacgacgacguguuaacgcauuuuccaacuuuuucuccggaccaaucguuguucauugcucagccggaguaggacgaacaggaaccuauaucgguauagaugcaaugcuagaaggccucgaggccgaaaauaaagucgauguuuacggcuacguaguuaaacugcgaagacagcgcuguuuaaugguucaaguagaagcccaauauaucuugauccaccaggcuuuaguugaauauaaucaauuuggagaaacagaagucaauuuaucagaauuacacccuuaccuacauaauaugaagaaaagagacccaccaucagagccaucaccucuagaagcagaguuccaaagacuaccaucauacagaucauggcgaacccaacacaucgguaaccaagaagaaaacaaauccaaaaaccgaaacucaaacgugauccccuaugauuauaacagaguaccauuaaaacacgaauuagaaaugucaaaagaaucagaacacgauagugacgaaaguucagaugaugauuccgacagugaagaaccuaguaaauacauaaaugcaucauuuauuaugaguuauuggaaaccagaagucaugauugcagcacaaggaccauuaaaagaaacuaucggagacuuuuggcaaaugaucuuccaaagaaaaguaaagguaauagucauguuaacugaauuaaagcacggagaccaagaaauaugugcacaauacuggggagaaggaaaacaaacauacggcgauaucgaaguagaucuaaaagacacagacaaaucauccacuuauacacuccgaguauuugaacuuagacacucaaaacgaaaagacucacgcacaguauaccaauaccaauacacuaacuggucagucgaacaauuacccgcugagccaaaagaauuaauauccaugauccaaguuguaaaacaaaaacuaccacagaaaaauucaucagaaggaaacaaacaucauaaaucaacaccucuacucauucacuguagagauggaucccaacaaacagggauauucugcgcuuuacuuaaucuucuagaauccgcagaaacagaagaaguaguugacauauuucaaguaguaaaagcauugagaaaagcacgcccugguauggucucaacuuuugaacaauaucaauuucuauacgacgucauagccaguaccuauccagcacaaaauggacaagucaaaaagaacaaccaccaagaagauaaaauagaauuugauaacgagguagacaaaguaaaacaagacgcuaacuguguaaacccucuaggagccccagaaaaauuacccgaagcuaaagaacaagcagaagguucagaaccaaccaguggcaccgaagguccagaacauucugucaauggaccugccucaccagcccuaaaccaaggaucauaa

SEQ ID NO: 2661 - RNA, 765 nt, Artificial Sequence
  P08637
auguggcaacuauuacuuccaacagcacuacuacuauuaguaucagcaggaaugagaacagaagaccuaccaaaagccguaguauuccucgaaccacaaugguauagaguacucgaaaaagacucaguaacauuaaaaugccaaggagcauacuccccagaagacaacucaacccaaugguuccacaaugaaucacuaauauccucacaagcauccucauacuuuauagacgcagcaaccguagacgacucaggagaauaccgaugccaaacaaaccuaucaacacuaucagacccaguacaacuagaaguacacauaggauggcuacuauuacaagcaccaagauggguauucaaagaagaggacccaauacaccuaagaugccauucauggaaaaauacagcacuacacaaaguaacauaccuacaaaacggcaaaggaagaaaauacuuccaucacaacuccgacuucuacauaccaaaagcaacacuaaaagacucaggcucauauuucugcagaggacuauucggcuccaaaaacguauccucagaaacuguaaacauaacaauaacacaaggauuagcaguauccacaauuucaucauucuuuccuccaggauaucaaguaucauuuugcuuagucaugguacuacuauucgcaguagacacaggacuauauuucucaguaaaaacaaauauaagauccucuacaagagacuggaaagaccauaaauucaaauggagaaaagacccacaagacaaauga

SEQ ID NO: 2662 - RNA, 663 nt, Artificial Sequence
  P10747
auguuaagacuacuacuagcauuaaaccuauucccuuccauacaagucacagguaacaaaauacuaguaaaacaaucuccaaugcuaguagcauaugacaacgcagucaaccuaucaugcaaauacucauacaaccuauucucacgagaauucagagccucccuacacaaaggauuagacucagcaguagaaguauguguaguauacggaaacuacucacaacaacuacaaguauacucaaaaaccggauucaacugcgacggaaaacuaggaaacgaaucaguaacauucuacuuacaaaaccuauacguaaaccaaacagacauauacuucugcaaaauagaaguaauguacccaccaccauaccuagacaacgaaaaauccaacggaacaauaauacacguaaaaggaaaacaccuaugcccaucaccacuauucccaggaccauccaaaccauucuggguacuaguaguagucggaggaguacuagcauguuacucauuacuaguaacaguagcauucauaauauucuggguaagaucaaaaagaucaagacucuuacacucagacuacaugaauaugacaccacgaagacccggaccaacaagaaaacacuaccaaccauacgcaccaccaagagauuucgcagcauacagaucauga

SEQ ID NO: 2663 - RNA, 681 nt, Artificial Sequence
  P11912
augccaggaggaccaggaguacuacaagcacuaccagcaacaauauuucuauuauuccuauuaucagcaguauacuuaggaccaggaugucaagcucuauggaugcacaaaguacccgcaucauuaaugguaucauuaggagaagacgcacacuuccaauguccacauaacucaucaaauaacgcaaacguaacaugguggagaguauuacacggaaacuauacauggccaccagaauuuuuagguccaggagaagauccaaauggaacacuaauaauacaaaacguaaacaaaucacauggaggaauauauguauguagaguacaagaaggaaaugaaucauaccaacaaucaugcggaacauauuuaagaguacgacaaccaccaccaagaccauucuuagauaugggagaaggaacuaaaaauagaauaauaacagcagaaggaauaauauuacuauuuugcgcuguaguaccaggaacauuacuauuauucagaaaaagauggcaaaaugaaaaauuaggauuagacgcaggagaugaauacgaagaugaaaacuuauaugaaggauuaaaucuagaugacuguucaauguacgaagauauuucaagaggacuacaaggaacauaucaagauguaggaaguuuaaacauaggagauguccaauuagaaaaaccauga

SEQ ID NO: 2664 - RNA, 1671 nt, Artificial Sequence
  P15391
augcccccaccaagauuauuauuuuuuuuauuauuucucacaccuauggaaguaagaccagaagaaccauuaguaguuaaaguugaagaaggagauaaugcuguacuacaaugccucaaagguacaagugauggaccaacacaacaauuaacauggaguagagaaucaccauuaaaaccauuucuaaaacuuucauuaggauuaccaggauuaggaauucauaugagaccucuagcaauauggcuauuuaucuuuaauguaucacaacaaaugggaggauuuuaccucugucaacccggaccaccuuccgaaaaagcauggcagccaggauggaccguaaauguagaagguucaggagaauuauuucgauggaauguuucagaucuaggagguuuagguugcggcuuaaaaaauagaucaucggaaggaccaucuucaccaucaggaaaauuaauguccccaaaauuauacguaugggcaaaagacagaccagaaauuugggaaggugaaccacccuguuuaccaccaagagacagucuaaaucaaaguuuaagccaagaucuaacuauggcaccaggaaguacguuauggcuaucauguggaguaccuccggauucaguaucaagaggaccucuuaguuggacucauguccaucccaaagguccaaaaucacuauuaucucuagaacuaaaagaugauagaccagcuagagacauguggguaauggaaacaggacuguuacuaccuagagcuacagcucaggaugcaggaaaauauuauugccauagaggcaacuuaacaaugucauuccacuuagaaauuacagcuaggccaguucuuuggcauugguuauuaagaacuggaggauggaaaguaucugcaguuacacuagcauauuuaauauuuugcuuauguaguuuaguaggcauacuucaccuacaaagagcacuaguauuaagacgaaaaagaaaaagaaugacagauccaacacgaagauucuuuaaaguaaccccaccuccaggauccgguccacaaaaucaguaugguaauguacuaagucuaccgacaccuacaucaggacuuggaagagcacaaagaugggcagcaggauuagguggaacagcaccaucauauggaaauccuucaucugacguacaagcagauggagcauuaggaucuagaucaccacccggaguaggaccugaagaagaagaaggcgaaggauacgaagaaccugauagugaagaggauagugaauuuuacgaaaacgauaguaauuuaggacaagaucaacucagucaagacgguuccggauacgaaaauccagaagaugaaccacuaggaccagaagacgaagacagcuuuucaaaugcagaaucauacgaaaaugaagaugaagaauugacacaaccaguagcucguacaauggauuuuuuaaguccgcauggaagugcaugggauccaucuagagaagccacaaguuuaggaagucaaucauaugaagauaugcgaggaauauuauacgcagcuccacaauuaagaucuauaagaggacaaccaggaccaaaucacgaagaagacgcagacaguuaugaaaacauggauaauccagauggaccagauccagcauggggcggaggaggaagaaugggaacuuggucaacuagauaa

SEQ ID NO: 2665 - RNA, 672 nt, Artificial Sequence
  P16410
auggcaugucuaggauuccaaagacacaaagcacaauuaaaccuagcaacaagaacauggccaugcacacuauuauuuuuccuauuauucauaccagucuucugcaaagcaaugcacgucgcccaaccagcaguaguacucgcaucuucacgaggaauagccucauucgucugcgaauacgcaucaccaggaaaagcaacagaagucagaguaacaguacuacgccaagcagacucacaaguaacagaaguaugcgcagcuacauacaugaugggaaacgaauuaacauuucuagacgauuccauaugcacaggaacaucaucaggaaaccaaguuaaucuaacaauacaaggacuuagagcaauggacacaggacuauacauauguaaaguagaacuaauguacccaccaccauacuaccucggaauaggaaauggaacacaaauauacguaauagauccagaaccaugcccagacucagacuucuuacuauggauacuagccgcaguaucaucaggauuauucuucuacucauuucuauuaacagcaguaucacuaucuaaaaugcuaaaaaaaagaucaccacuaacuacaggaguauacguaaaaaugccaccaacagaaccagaaugcgaaaaacaauuucaaccauauuucauaccaauaaacuga

SEQ ID NO: 2666 - RNA, 1419 nt, Artificial Sequence
  P16671
augggcugcgaucgaaacugcggacuaauagcaggagcaguaauaggagcuguauuagcaguuuucggggguauacuaaugccaguaggagaccuuuuaauacagaaaacaaucaaaaaacaaguaguauuagaagaaggcaccauagcuuucaaaaacuggguaaaaacaggaaccgaaguauacagacaauucuggauauucgacguacaaaauccacaagaaguuaugaugaacucauccaacauacaaguaaaacaacgcggaccauacacauacagaguaagauuucuagcaaaagaaaacguaacacaagaugcagaagacaacacagucaguuuccuacaaccaaauggagccauauucgaaccaucauuauccguagguaccgaagcagauaauuucacaguacuaaacuuagcaguugcugcagcuagucacaucuaccaaaaccaauucguacaaaugauacucaauucccuaaucaacaaaucaaaaucaaguauguuccaaguacgaacacuaagagaacuauuauggggauauagagauccauuucuaucacuaguaccauauccaguaacaacaacaguaggacucuucuauccauacaauaacacagcugacggcguauauaaaguauucaauggaaaagauaauauaucuaaaguugcaauaauagauacuuacaaaggaaaaagaaaccuaucauacugggaaucgcauugcgauaugaucaacggaacagacgccgcauccuucccacccuuugucgaaaaaucacaaguacuacaauucuucaguucagacaucugcagaucaauauacgcaguguucgaauccgacguaaauuuaaaaggaauaccagucuacagauucguauuaccaucaaaagcauucgcuucaccagucgaaaacccagauaauuauugcuucugcacagaaaaaauaauauccaaaaauuguacaucauauggaguauuagacauaucaaaaugcaaagaaggacgaccaguauacauaucacuaccacacuuuuuauacgcaucaccagauguaucagaacccauagacggucucaaucccaaugaagaagaacauagaacauauuuagacauagaaccaaucacaggcuuuacccuacaauucgcaaaaagacuacaaguaaaucucuuaguaaaaccaucagaaaaaauacaaguauuaaaaaauuuaaaaaggaauuauauagucccaauacucuggcuaaacgaaacaggaacaauaggagacgagaaagcaaacauguucagaagccaaguaacuggaaaaaucaaucuauuaggccuuauagaaaugauacuauuaaguguagguguaguaauguuuguagcauucaugauaucauacugcgcaugcagaaguaaaaccauaaaauga

SEQ ID NO: 2667 - RNA, 651 nt, Artificial Sequence
  P26718
augggauggauacgaggaagaagaagccgacacucaugggaaaugucagaauuccauaacuacaaccuagaccuaaaaaaaucagacuucagcacaagauggcaaaaacaaagaugcccaguaguaaaaucaaaaugcagagaaaacgcaucaccauucuucuucugcuguuucauagcaguagcaaugggaauaagauucauaauaaugguagcaauauggucagcaguauuccuaaacucacuauucaaccaagaaguacaaauaccacuaacagaaucauacugcggaccaugcccaaaaaacuggauaugcuacaaaaacaacugcuaccaauucuucgacgaaucaaaaaacugguacgaaucacaagcaucauguaugucacaaaacgcaucacuacuaaaaguauauucaaaagaagaccaagaccuacuaaaauuaguaaaaucauaccacuggaugggauuaguacacauaccaacaaacggaucauggcaaugggaagacggaucaauacuaaguccaaaccuacuaacaauaauagaaaugcaaaaaggagacugcgcacuauaugcauccucauucaaaggauacauagaaaacugcucaacaccaaacacauauauaugcaugcaaagaacaguauaa

SEQ ID NO: 2668 - RNA, 261 nt, Artificial Sequence
  P30273
augauaccagcaguaguacuccuacuacuacuacuaguagaacaagcagcagcacuaggagaaccacaacuaugcuacauacuagacgcaauacuauuccuauacggaauaguacuaacacuacuauacugcagacuaaaaauacaaguaagaaaagcagcaauaacaagcuacgaaaaaagcgacggaguauacacaggacuaagcacaagaaaccaagaaacauacgaaacacuaaaacacgaaaaaccaccacaauag

SEQ ID NO: 2669 - RNA, 1137 nt, Artificial Sequence
  P32248
auggaccuaggaaaaccaaugaaaucaguuuuagucgucgcacuauuaguaauauuucaaguaugucuuugccaagaugaaguaacagacgacuacauaggagauaacacaaccguagacuacacacuauuugaaucauuaugcucaaaaaaagacguuagaaacuucaaagcaugguucuuaccuauaauguacucaauaaucugcuucguaggacuacuuggaaacggccucgugguauuaaccuauauauacuucaaaagauuaaaaaccaugaccgacacauaccuacuaaaccuagcaguugcagauauacuauuccuccuaacauuaccauucugggcauacucagcagcaaaauccuggguauucggaguccauuucuguaaauuaauuuucgcaauauauaaaaugucauucuuuuccggaaugcuacuucuacuaugcauaucaauagauagauacguagcaauaguacaagcuguuucugcacauagacaccgcgcaagaguauuacucauaucaaaacuaucaugcguagguauauggauucucgcaacaguuuuaucuauacccgaauuauuauauucagauuuacaaagaucaucaucagaacaagcaaugagaugcucacuaauaaccgaacacguagaagcauucauaacaauacaaguagcacaaaugguaauaggauuucuagucccauuacuagccaugucauucugcuaucuaguaauaauaagaacacucuuacaagcaagaaacuuugaaagaaacaaagcaauuaaagucauaaucgcaguaguaguaguauucauaguuuuccaacuaccauacaacggaguaguacuagcacaaacaguagcaaauuucaacauaaccucaucaacaugcgaacuaucaaaacaauuaaacauagccuacgacguaacauacucccucgcaugcguacgauguugcguaaacccauuccuauacgcauucauuggaguaaaauucagaaacgaccuauucaaacuauuuaaagaccuaggaugccuaucccaagaacaacuaagacaauggucaucauguagacauauaagaagaucuucuaugucuguagaagccgaaaccaccacaacauucuccccauga

SEQ ID NO: 2670 - RNA, 690 nt, Artificial Sequence
  P40259
auggcaagacuagcccuaaguccaguaccaucacauuggaugguagcacuauuacuacuacuaucagcagaaccaguaccagcagcaagaucagaagaccgauacagaaacccaaaaggaucagcaugcucaagaauauggcaaagcccaagauucauagccagaaaaagaggauucacaguaaaaaugcacugcuacaugaacucagcaucaggaaacguaagcuggcuauggaaacaagaaauggacgaaaacccccaacaacuaaaacuagaaaaaggaagaauggaagaaucacaaaacgaaucauuagcaacauuaacaauacaaggaauaagauucgaagacaacggaauauacuucugccaacaaaaaugcaacaacacaucagaaguauaccaaggaugcggaacagaacuaagaguuaugggauucucaaccuuagcacaacuaaaacaaagaaacacacuaaaagacggaauaauaaugauacaaacacuauuaauaauccuauucauaauaguucccauauucuuacuacuagacaaagacgacucaaaagcaggaauggaagaagaccauacauacgaaggacuagauauagaccaaacugcaacauacgaagacauaguaacauuaagaacaggagaaguaaaauggagcguaggagaacacccaggacaagaauga

SEQ ID NO: 2671 - RNA, 990 nt, Artificial Sequence
  P42081
auggacccacaauguacaaugggccuauccaacauauuauucguaauggcauucuuacuaucaggagcagcaccacuaaaaauccaagcauauuucaacgaaacagcagaccuaccaugccaauuugcaaacucacaaaaccaaucacuaucagaauuaguaguauuuuggcaagaccaagaaaaccuaguacuaaacgaaguauaccuaggcaaagaaaaauucgacucaguacacaguaaauacaugggccgaacaucauucgacuccgacucauggacacuaagacuacauaaccuccaaauaaaagacaaaggccuauaccaaugcaucauccaccacaaaaaaccaacaggcaugauaagaauacaccaaaugaacucagaacucucagucuuagccaacuuuucccaaccagaaauaguaccaauauccaacauaacagaaaacguauacauaaaccuaaccuguagcucaauacauggauaccccgaacccaaaaaaaugucaguacuauuaagaacaaaaaacuccacaauagaauaugacggaguaaugcaaaaaucacaagacaauguaacagaauuauacgacguaucaauaucacuauccguaucauuccccgauguaacaucaaacaugaccauauucuguauacucgaaacagacaaaacaagacuacuaucaucaccauuuucaauagaacuagaagacccccaacccccaccagaccacauaccauggauaaccgcaguauuaccaaccguaauaauaugcguaaugguauucugccucauacuauggaaauggaaaaaaaaaaaaagaccaagaaauucauacaaaugcggaacaaacacaauggaaagagaagaaucagaacaaacaaaaaaaagagaaaaaauacacauaccagaaagauccgacgaagcacaaagaguauucaaaucaucaaaaaccucaucaugcgacaaaucagacacaugcuucuga

SEQ ID NO: 2672 - RNA, 1011 nt, Artificial Sequence
  Q15762
auggacuacccaacuuuacuccuugcacuucuacauguauauagagcacuaugugaagaaguauuauggcauacaucaguaccauucgcagaaaacaugucacuagaaugcguauacccaagcaugggaauacucacacaaguagaaugguuuaaaauaggaacccaacaagauagcauagcaauauucucuccaacacacggaaugguaauaagaaaaccauacgcagaaagaguauauuucuuaaauuccacaauggccucaaacaauaugacacuauuuuucagaaaugcaucagaagaugacgucgguuacuauucaugcagcuuauacacuuacccccaaggaacauggcaaaaaguaauacaaguaguacaaucagauucauuugaagcagcaguaccaucaaacucacacauaguaucagaaccaggaaaaaacguaacauuaacaugucaaccacaaaugacauggccaguacaagcagucagaugggaaaaaauacaaccaagacaaauagaucuuuuaacauauugcaaucuaguacacggaagaaauuucacuaguaaauuuccacgacaaauaguuagcaauugcucacacggucgcuggagcguuauaguuauaccagauguaacaguaagugauucaggucuauaucgauguuacuuacaagcaagcgcaggcgaaaacgaaacuuuuguaaugcgauuaacagucgcugaaggaaaaacagauaaccaauacacauuauuuguagccgguggcacaguucuauuacuauuauucguaauuucaauaacaacaauaauaguaaucuuucuaaauagaagaagaagaagagaacgaagagacuuauucacagaaucaugggacacccaaaaagcaccaaauaacuauagaucaccaauaagcacaucacaacccaccaaccaaagcauggacgauacaagagaagauauauauguaaacuacccuacauuuucaagaagaccaaaaacaagaguauga

SEQ ID NO: 2673 - RNA, 13482 nt, Artificial Sequence
  Q685J3
augccccgcccagguaccauggcucugugccuucugacccucguuuuaagucuccuuccaccccaagccgcugccgaacaagauuuaucggucaaccgagcagucugggacgggggaggaugcauaucacagggggauguuuuaaacagacagugccaacaacucagucaacauguacgaacagggucugcagcaaauaccgcaacugguaccacuuccacuaacguuguugaacccagaauguaccuuucuugcagcaccaaccccgaaaugacaaguauagaaucuucaguaacuucagauacgcccggcgucuccucuacuagaaugacuccuaccgaaucaagaaccacuucugaaucaaccucagacucuaccacucuuuucccgaguucuaccgaagacaccucaucgccaaccacccccgaagggacugaugucccuauguccacuccuucugaagaaucuauuagcucaacuauggcauucguaucgacugcuccucucccguccuucgaagcauacacuucccucaccuauaagguggacauguccacccccuugacuacaaguacgcaggccaguucaucaccaaccacgccugaaucgaccacuauaccaaaaucaaccaacucagaaggaagcacaccccuaacuagcaugccggcaucaaccaugaaaguagcuagcucagaagcaauaacccuccucaccacuccugucgaaauauccacgccugucaccaucagugcccaagccucuucaucccccaccaccgcagaagguccuuccuugagcaacuccgcacccucaggagggucgacuccauuaaccagaaugccucuuucagucaugcuggucgucucuuccgaggcuucuacccuuagcaccaccccggcagcaaccaauaucccagucaucacaucaaccgaagcuagcucauccccaacaaccgcagaaggcacaucaaucccaacaucaaccuacacggaaggaucaacuccacuuacuagcacacccgcaucaaccaugcccguggccacgucugaaaugucgacacuauccauuacacccgucgauaccaguacacuuguaaccacaucuacggaaccuucuucuuugccgacuacugccgaagccaccaguaugcucaccucuacucugucugaaggaucuacuccucucacgaacaugcccgugagcaccauccuuguugcuuccucagaagcuaguacuacaagcaccaucccaguagacuccaaaacauuuguaaccaccgccuccgaagccucaucaagcccuacuacagcugaagauacuucaauugcaacaucaacucccucagaagguucuacaccucuuacaucgaugccugucucaacuaccccuguggcuucauccgaagccuccaacuuaucaacaacuccgguggacucuaaaacucaagucacaacgaguacggaagcaucaaguucaccacccaccgcagagguaaauucgaugccaacaucaacaccaucagaagguaguacgccacuuaccaguaugagcgugucaacuaugccaguugcguccucugaagcaucgacacucaguaccacccccguagacacguccacaccugugacuaccaguucagaagcgaguagcucaucaacgacucccgaagguacaucaauacccacaucuaccccaucggaaggaucaacaccacucacgaauaugccagugagcacaagacucguugucucguccgaggccagcacaacaaguaccacuccugccgauuccaacacauucguuaccacuuccucggaggcuuccaguucaucgacuacagccgagggcacauccaugccuaccuccacuuauagcgaacguggcacaaccauuacguccauguccguaagcaccacucucguggcuaguucugaagccucuacacuuucuacuacacccguagacucaaacacaccugugacuacaucgaccgaggcgacaaguucaucaacaacggccgaagguaccuccaugccuaccucuacauacacugaagguuccaccccuuuaacaaguaugccuguuaacacgacgcucguagcaaguuccgaggcuucgacauuaucuacuacuccuguagacacuucgacacccguuaccacaucaacugaagcaaguucaucuccuacuacggcugauggcgccaguaugccuacaucuaccccuagcgagggaucgacuccacucacaucuaugcccguauccaaaacccuucuuacguccucugaggcaucuacuuuaucuacuacaccccucgacacuucuacucacauaaccacuuccaccgaagcuagcugcucgcccacaacgacggaaggaaccagcaugccaauuucaacaccgucagaaggcucucccuuacuuaccucaauaccuguaucuauuacuccgguaacaucacccgaagccucaacacucucaaccacccccguugacaguaauucuccgguaacuacuucgacugaagucucauccucuccaaccccugcagaaggcacaucaaugccuacuucaacauauucagaaggaagaacgcccuuaacaucuaugcccgugaguacuacacucgucgccacauccgcuauaucuacucucucaaccacccccguugauacaucgacaccaguaaccaacucuaccgaagcuagaucuucaccaacgacuucagaaggaacaucaaugccuacuucgacccccggagaagguucuacaccccuuacuucgaugccagacucuacuacacccguuguuucuucagaagcacguacucuaucggcuacgcccguagauacaucaacuccagugacgacgagcacggaagccacaaguucccccacaacagcagaaggaacgucgaucccaaccagcacuccgagugaaggaacaaccccucuuaccucaacacccguaagccacacucugguggcuaauucagaagccucuacucuuucuacuaccccaguugacuccaacacgccauuaacaacauccacagaagcauccuccccaccuccuacagcagaaggaacauccaugcccacgucaacacccagugaaggguccaccccuuuaacgcgcaugccugucucuacgacgaugguugcuucuagugagacauccacacuaucaacgacuccagccgauacgagcacgccugucacgacguacucucaagccuccucaucaucaaccacagcugauggcacuucuaugccgacgucuacauauuccgaaggaagcacuccauugacaucugugccaguuuccacucgucucguuguuaguucugaggcuucuacacucucgaccacucccgucgacacaagcauuccagugacaaccuccaccgaagcaucaucgucaccuaccaccgcagaaggaacauccauaccuacaucgcccccuucugaagguacgacaccccuagcuucaaugccagucaguaccacucuagucguuagcucugaagcgaacacauuaucaacaacuccaguggauagcaaaacacaaguugcaacgaguacugaggcuucaaguccaccgccaaccgccgaaguaacuagcaugcccacaucaacuccaggcgagagauccacgccccuuacuucgaugccaguucggcauacgccugucgcuucuucugaagcaagcacacuuucuacauccccaguagacacaucuaccccggucacaaccucagccgaaacauccucaaguccaacaacugccgagggaacaucucucccgacuagcaccaccucagaagguucuacucuacuaacuucuaucccagucuccaccacucuagucacaucccccgaagcaucaacccuacucacgacacccguugacacaaaagggccuguagugacuagcaaugaagucucaucuucaccuacaccagcagaaggaacaucuaugccaaccucaacauauucugaaggucgaacuccucuuacaaguaucccaguaaauaccacucucguggccucaucugcuaucucuauacuaagcacaacaccuguggacaacucuacuccuguaaccacgucaacagaggccuguucgucuccuacuacuagcgaaggcacaaguaugccuaauagcaaccccucugaagggacgacaccacucacgucuauaccagugagcaccacccccgucgucagcucggaagcguccacucuuuccgcuacucccguugacaccucuacaccuggcaccacaucagccgaagcaacgaguaguccuacaacugcugagggaauaucaauuccuaccucuacacccucggaaggcaaaacaccuuugaaaucuauacccguaaguaacacacccguggcaaacucggaagcaucuacucugucaaccacgccugucgacuccaauucaccuguaguaacuucaacagcggucagcucgaguccgacacccgccgaggguacaucaauagcgauuagcacucccucugaaggguccacggcacuuacgucuauuccgguuucgacuaccacaguugcaaguuccgaaauaaacagccuuucaacuacacccgcuguaaccuccacuccuguaacaacauauucccaagcgucaagcucaccgacaacggccgaugggacuucgaugcaaaccucuaccuacucagaagguaguacaccccuuacaucuuugccugucagcaccauguuaguaguaaguagcgaagcgaauacacuuucaacaacucccauugauaguaaaacucaaguaacugcaucuacagaagcaaguucgucuacuaccgcagagggcuccucaaugacaauaagcacacccuccgaagggucuccauuacuuacguccauaccgguaucaacaacaccggucgcguccccggaggcuucaaccuuaaguacgacaccgguagauucaaauucaccuguuaucacuucaacagaagugaguucgaguccaacuccugccgaggguaccucaaugccaacgucaacuuacaccgagggcagaacaccccuuacuuccauuacaguucgaacuacucccgucgcaagcagcgcaaucaguacguuaaguacuacaccaguagauaauuccacaccugucaccaccucaacagaagcucgaucuucgccaaccacgucagaagggacgagcaugcccaacucaacaccuuccgagggaacuacuccacuuaccucuauacccguuucgacuaccccagugcuauccucagaagccucgacuuuaucagcaacuccaauagauacaaguacgcccgucacaacauccaccgaagcaacaagcucuccaaccaccgcagaaggcaccucgauuccaacaucuacucuaucugaaggaaugacuccgcuaacuucuaccccaguuagucauacgcugguggcuaacucagaagccagcacccugucaacaacaccuguugacagcaauucaccaguagucacauccaccgcaguuucgagcucgcccacaccggccgagggcacuucuauagccacaucuacccccucagaaggcuccacggccuuaaccuccauaccgguuucuacaacuaccgucgcuucuucggagacuaacacauuaucaacuacuccugcaguaaccaguacaccugucacuacauacgcacaaguaucuucuucccccacaacugcggacgggucaucuaugccuacguccacgcccagagaagggcguccaccacuuacaucaauaccagucuccacaacaacgguugcuagcagugagauaaauacgcuaucuacaacacuagcugacacgagaacacccguuacuacguacucccaagcuaguagcaguccuacaacagccgacggaacaaguaugccuacacccgcguauucugaaggcaguacaccccuuaccucaaugccuuuaaguacgacccucgugguaucaagcgaggcaucuacguuaaguacuacuccggucgacacaucuacaccagcgaccacaucuaccgaagguuccucgagcccaacaacagccgguggaaccucuauucaaacaagcacuccaagugaaagaacuacaccacuagccggaaugccggucuccacaacucuaguugugaguuccgaagguaacacucucucaacgacaccaguugacuccaaaacacaaguaacaaauuccacagaggcauccucuuccgccacagcagagggcuccuccaugacgaucucugcuccauccgaaggcucuccucuccucacuucaauaccauuauccacgacuccuguagcgucuccugaagcuaguacauuauccacaacgccgguugauagcaauuccccagucaucacaucuacugaggucucuuccuccccaauucccacugaaggcacaucaaugcagacgucaacauacagugauagaagaacaccccuaacgucaaugccuguuucuaccacaguaguugcuaguucagcuauuucaaccuuaagcaccacuccgguugauaccaguacacccgugacaaacucgacagaagcacguuccucaccuacuacuuccgaaggaaccuccaugccaaccuccacuccuagcgaaggcuccacuccuuuuacaucuaugccaguuaguacaaugcccguaguaacgagugaggccaguacauuauccgcaaccccgguagauaccucuaccccugucacuacaaguacagaagcgaccucgaguccaaccacagcagaggguacgucuauccccacuucgacacuaagugaaggcacaaccccuuugacguccauaccaguaucgcauacccuaguugcaaauucugaaguauccacucuuaguacgaccccuguggauagcaacaccccuuucacuacuuccaccgaagcaucuucaccaccacccacugcugaaggcaccucuaugccgacauccacuagcagugaagguaauacaccacuaacgagaaugccgguuucuacaaccauggucgcaucuuucgaaacuagcacgcuuucaaccacaccggcggacaccagcacuccuguuacaaccuauucccaggcuggaaguuccccuaccacggccgaugauacuucuaugccuacaaguaccuacucagaagggagcaccccacucacuagcguaccugugucuaccaugcccgucgucucuucagaagcgagcacgcauucaaccacgccugucgacaccucuacuccaguaacuacaucuacagaagcaucgagcucaccaacuacugcugaaggaacuucuauuccaaccucaccgccuagugaaggaacaacucccuuagccucuaugccgguaucgacaaccccuguuguguccucggaagcaggaaccuuaucuacaaccccuguggacacaucaacuccaaugacaacaucaacugaagcaagcuccuccccaacgacagcagaagauauuguugugccgauuucuaccgcuagcgaaggcuccacauuacuuaccucaauaccgguuuccacuacaccgguggcuucacccgaggcaucuacccuaagcacgacccccgucgacucuaacucacccguaguuacuucuacugagauaaguagcagugcgacaagcgccgaaggaaccucaaugccuacaucaacuuauuccgaaggaucuaccccacuccgcucgaugccagucucaaccaagccacucgcaucuagcgaagcaucuacccugagcacaaccccuguagauacaucuauaccuguuacgacaucgacagaaacguccucaucgccaaccacagcgaaagacaccucaaugcccauaucaacacccucagaaguaucaacaucacucacuuccauucucguauccacaaugcccguugcaucaagugaagcuagcacucucuccacaaccccgguggauacacgaacuuuagugacaaccagcaccggcacaucuucgucaccuacgacugcggaaggaucaucaaugcccaccaguacuccaggcgagcggucaacaccacuaacaaauauccuaguaucaacuacacugcuggccaauucagaggcuucuacccuaaguacaacaccaguugauacgaguaccccggugacaaccucagccgaagcgagcucaucgcccacaacugcagaagguacaagcaugcgaauaucuacaccuagcgauggaucaacaccauuaaccaguauucuugugucaacauuaccgguagcuuccucagaggcuaguacaguaucuaccaccgcuguugacacuucaauaccuguuacuacuagcacagaggccucgaguaguccuaccacagcagagguaacgucgaugcccacgagcacuccuagcgaaacuucgacgcccuuaaccagcaugcccgucaaccauacgccaguugcgucuuccgaagccgggacuuuaucaacaacucccguagacacauccacgccuguaacaaccucgacaaaagccuccucgucucccacaacagcagaaggcauaguuguucccauaucaaccgccucagagggcucuacccuauuaacauccaucccagucuccacuacaccggucgccucgagugaagcaagcacauuaucuacaacaccuguugauacaaguauaccagugacuacaucuacugaagggaguucaucacccaccacagcagaagggaccucuaugcccaucaguacaccaucugaaguaagcacaccauugaccucaauccuggucucaacuguuccagucgcaggaucggaagcgagcacuuuauccaccacgccaguugacacucgaacgccaguaacuacaucugcugaggccuccagcuccccuaccacugcagaagguaccucuaugccaauuucaaccccaggcgaacggcguacaccguugacaucuaugucaguaucuacaaugccggucgcgaguagugaagcgucuacccuuuccaggacuccagcggauacuagcacccccguuacgacaucuacagaagcgagcucaagccccaccaccgccgaaggcaccgggauuccgaucuccacccccucugaagguaguaccccucuuacgucaaucccuguaucaaccacgccaguggccauuccugaggcuucaacccuauccacaacaccgguagauuccaacucgccaguaguuacaaguacagaaguuucaaguagcccaacucccgcugaaggaacgucaaugccaauuucgacauacuccgaagguaguacaccauuaacugguguaccaguuuccaccacuccgguaacaaguagugcuauauccacacucucuacuacucccguagauacuucuacaccaguaacgacuucgacugaagcccauaguucucccacuaccucagaggguacuuccaugcccaccucaacaccguccgagggauccacuccuuuaacuuauaugccaguauccacgauguugguaguaucauccgaggacucuacucuauccgcgaccccgguugacacaaguacacccguaaccacuagcacagaggcaaccucaagcacgacagcggaagguacuucuauaccuacuucaacacccuccgaaggcaugacgccauuaaccucuguccccguuucaaacacccccgucgcauccuccgaagcgucgauccucuccaccacuccugucgauuccaauacgccacuuacuacaaguacagaggcgucaucuucuccuccuaccgccgagggcacguccaugcccacuucaacuccuucugaaggaucaacaccccuaacaaguaugccaguguccacaacaacaguugccucguccgagacuuccacucuaucuacuacuccggcagacacuucgacaccggucaccacauauagccaagcaucuuccagcccacccauagcagacgggacuagcaugccaacguccaccuacucagaagguuccacuccucucacaaauaugucguuuucaaccacuccugucgugucuagugaggccucaacacuuucuaccacuccaguugauaccaguacaccaguuacaacaucaacagaagcaucucucaguccaacaacugcagaagguacuuccaucccgacaucauccccaucagaaggaacgacgccuuuagcgucaaugccagugucaacaacaccugugguuucaucugaagugaauacacuuuccacuacuccaguagauucuaacacucugguuacaacaagcacugaagccucgagcucaccuaccauugcagagggaacuucgcuacccaccucaacaacaagugaagggagcaccccucucuccauuaugccuuugaguacuaccccaguagccucuucugaagcaucaacacucuccaccacacccguggacacuagcacuccaguuacuacuagcuccccuaccaacucuuccccuaccaccgcagaaguuacaucaaugccaacaucaacagcaggagaaggaucuacaccucugacuaauaugccgguuaguacaacgccaguugcaucaagugaggccucgacgcuuuccacaacuccuguagacuccaauacauuuguaaccuccaguucucaagcuaguucuuccccagcuacucuccaaguuacaacaaugagaaugucaacacccucagagggaagcaguagccuaacuacaauguuacucucauccacauaugugaccucaucagaagccucgacgccgucaaccccaucaguagacaggagcacuccaguaacaacuucaacucaaaguaacucaacaccuacaccgcccgaaguuaucacguugcccaugagcacacccucugaaguaucuaccccgcuuacuauuaugcccguuucuacgacuucagucacaaucucugaagccggaacugccagcacucugccaguggacacuagcaccccagugauaacuucuacacaaguaucuaguucgccaguaacuccggaaggcacaaccaugccaauauggacacccucagaaggauccacuccucugaccacuaugccgguuucgaccacacgcguaacaaguucggaaggguccaccuuauccacuccuucuguuguaaccucaacuccugugaccacgucaaccgaagcuauaaguucuucagcaacccucgauucaacuacaaugaguguuucuaugccuauggaaauaucuacccuugggacuacaaucuuggucucuacuacuccuguaacuagauuuccagaaucuucgaccccaucuauacccucuguuuacaccuccaugucaaugacgacagccagcgaaggauccuccaguccaacgacacucgaaggaacaaccacgaugccaaugagcacuacuucggaacgaucgacgcugcucacgacugucuuaauuucuccgauaagcgucaugucaccaucggaagccucaaccuuaucuacaccgccaggcgauacuucuaccccucuuuuaacuucuaccaaagcaggaucauucucaauaccagccgagguuacaacaauccgcauuucuauaacuucggaaagaucaacuccucuuaccacacuccuuguguccacaacgcucccuacaucuuuuccaggugcaucaauagcgucuacaccgccacuggacacaagcacaacauucacgccaagcacagauaccgccucaacaccuaccauccccguugcuacgacaauauccguuucuguuauuacagagggauccacaccgggcaccaccauuuuuauccccucuacccccgucaccucuucgacagccgacguuuuucccgcuacuacuggugcgguaucaacuccaguaauaaccucgacggaacuaaacacccccucuacuucuucgucauccacuacgaccagcuuuucaacaacuaaagaguucaccacaccagcaaugacaacugcagcaccucucacauacguaacuauguccacugcuccgaguacaccccguaccaccagucgggguugcacaaccuccgcuagcacccuuucagcaacuucuacuccacauaccucuacuucuguuacuacacguccuguaacaccgucuucagaauccucuaggcccagcacuaucacaagucacacgauuccacccacauucccgcccgcccauaguaguacuccuccgacaacauccgcaagcaguacuacuguuaauccugaagcagucacaaccaugacgacccgaacaaaacccucaacacgcacaaccagcuuuccaacaguaacaacaacugccgucccuacaaacacuaccauaaaaucaaauccaacaucaaccccgacaguaccaagaaccacaaccugcuucggugacggaugucagaauacagcgucaaggugcaagaacgguggcacaugggauggccuaaagugccaaugcccaaaccuuuacuacggagaauugugugaagaaguaguuuccucaauagauauagguccacccgaaacuauaucagcacaaauggaauuaacugugacaguuaccuccgucaaguuuacagaagaacucaaaaaucacagcagucaagaguuccaggaauuuaaacaaaccuucacagaacaaaugaauaucguauacuccgggauuccugaauacgucggcgucaauauuacuaaauugagauuagggaguguuguuguagagcaugauguacuacuucguaccaaauauacuccagaauacaagaccguacuugacaaugcuacagaggugguuaaagagaaaauuacgaaggucacaacucaacaaauuaugauuaacgauauauguuccgauaugauguguuucaauacuaccgguacucagguucaaaauauaacgguuacgcaauacgaucccgaagaagauugucgaaagauggccaaagaguacggcgacuacuucgucguggaauauagggaucagaaaccuuauuguauaucccccugugaaccaggauucagcguaucuaaaaauuguaaucuaggaaaaugccaaaugagccucuccggaccccaaugucucugugucacuacggagacgcacugguacagcggugaaacaugcaaucaagguacucaaaaaucacucgucuacggccuaguuggcgcuggugucguacuuaugcucauaauauuaguagcuuuacucaugcucgucuuucgaaguaagcgcgagguaaaaaggcaaaaauaucgucucagucaauuauacaaauggcaagaagaggauucagggcccgcucccggcacuuuccagaauauaggauuugacaucugucaagacgacgauucaauacacuuggaaaguaucuauucaaauuuucaaccuuccuugagacauaucgauccagaaacuaaaauaaggauucagcgaccucaagucaugacaacuuccuuuuga

SEQ ID NO: 2674 - RNA, 1215 nt, Artificial Sequence
  Q9NNX6
augucagacucaaaagaaccaagguuacaacaacuaggauuauuagaagaagaacaacucagaggacuaggauucagacaaaccagagguuacaaaagccuagcaggauguuuaggacacggaccauuaguacuacaacuacucagcuucaccuuauuagcaggacuauuaguacaaguaucaaaaguacccuccaguauaagccaagaacaaucaaggcaagacgcaaucuaccaaaacuuaacacaauuaaaagcagcuguaggcgaacuaucagaaaaaucaaaacuacaagaaaucuaccaagaacuaacacaacuaaaagcagcaguaggagaauuaccagagaaaagcaaauuacaagaaauauaucaagaacuaaccagacuaaaagcagcaguaggcgaacuaccagaaaaaucaaaauuacaagaaauauaucaagaauuaacauggcuaaaagccgcaguaggagaacuaccagaaaaaucaaaaaugcaagaaauauaccaagaacuaacaagauuaaaagcagcaguaggagaacucccagaaaaaucaaaacaacaagaaauauaccaagaauuaaccagacuaaaagcagcaguaggcgaacuaccagaaaaaucaaaacaacaagaaauauaccaagaacucacacgauuaaaagcagcaguaggcgaacuuccagaaaaaucaaaacaacaagaaauauaccaagaacuaacacaacuaaaagcggccguagaaagauuaugucaucccuguccaugggaauggacauuuuuccaaggaaacuguuacuucaugagcaacagccaacgcaauuggcacgauucaauaacagccuguaaagaaguaggcgcacaauuaguaguaauuaaaucagccgaagaacaaaauuuucuccaauuacaaagcagcagaucaaaucgauucacauggaugggacuaucagacuuaaaccaagaaggaacauggcaauggguagauggcucuccacuauuaccaucauucaaacaauauuggaacagaggagaaccgaauaacguuggcgaagaagacugcgcagaauuuucaggaaacggauggaacgaugacaaaugcaauuuagcaaaauuuuggauauguaagaaaucagcagccucauguucaagagacgaagaacaauuuuuaagccccgcaccagcaaccccaaauccaccaccagcauga

SEQ ID NO: 2675 - RNA, 3126 nt, Artificial Sequence
  Q9NR97
auggaaaacauguucuuacaaucaucaauguuaacauguauauuucuccuuauauccggaucuugcgaauuaugcgccgaagaaaacuucucacgaucuuaccccugugaugaaaagaaacaaaacgauucagugauugcagaaugcucaaaucgacgacuccaagaaguuccacaaaccguuggcaaauacgucacggaacuagaucucucggauaauuucaucacccauauaacuaacgaaucuuuccaaggguuacaaaacuuaacaaaaauaaaucucaaucacaacccaaauguacaacaccaaaacggaaaccccgggauacaaucaaacggacucaacauaaccgacggcgcauuucucaauuuaaagaaucuacgcgagcuacuauuagaagacaaccaacuaccccaaaucccaaguggacuuccugaaucccuaacugagcuuucauuaauacaaaauaauauauacaacauaaccaaagaaggaauaucaagguuaauuaaccuuaaaaaccuauaccuugcuuggaauugcuacuucaacaaaguaugcgaaaagaccaacauagaagacggaguuuuugaaacauuaacuaaucuagaacuccuauccuuaucauuuaacucccucucucacguaccucccaaacuaccaucaaguuuaagaaaacuauuccuaucaaacacccaaauaaaauauauuagcgaagaagauuucaaaggacugauuaaccuaacacuacucgauuuaucgggcaauuguccccgauguuucaacgcacccuucccauguguuccuugugacgguggcgcauccauaaacauagacagauucgcauuccaaaacuuaacccaacuccgcuaccuaaaccucuccuccaccucacuacgaaaaauaaaugcagccugguuuaaaaacaugccacaccuaaaaguacuagaucuugaauuuaacuaccuggucggagaaaucgcaucuggcgcuuuccuaacaaugcuaccccgcuuagaaauauuagauuuaucuuuuaacuauauaaaaggcucauacccacaacauauaaacauauccagaaacuuuucaaaacuccucucauuaagagcccuucaucuuagaggauauguauuccaagaacuccgcgaagacgacuuccaacccuuaaugcaauuaccaaaccuuucaaccauaaaccucggaauaaacuucauuaaacaaaucgauuuuaaacuuuuucaaaauuucuccaacuuagaaauaaucuaucucucagaaaacagaaucuccccauuagucaaagacacucgccaauccuaugccaacuccucaucauuccaaagacacaucagaaaaagacguucaaccgacuucgaauuugacccacauuccaauuuuuaccacuuuacccgaccucuuauaaaaccacaaugugccgcauacggaaaagcacuagaucucuccuuaaacucaauauucuuuaucggucccaaucaauucgaaaaccucccagauauagcaugcuuaaauuuaucugccaacaguaaugcacaaguccuaucaggaaccgaauuuucagcuaucccccacgucaaauaucuagaccucacaaacaacagauuagauuucgacaaugcaucagcacuaacugaacucuccgauuuagaaguacuugaccucagcuauaacucucacuauuuccgcaucgcaggagugacacaccaccuugaguucauccaaaauuuuaccaaccuuaaaguacuaaacuuaucccacaauaacauauacacucucacagauaaauacaaucucgaauccaaaucucucguagaacuuguauuuucaggaaaccgccuagauauucuauggaaugacgaugacaaucgauacauaucaaucuuuaaaggacucaaaaaccucacccgacucgaucucaguuuaaacagauuaaaacacaucccuaacgaagccuuuuuaaaucuaccagcaucacucacagaacuacacauuaacgauaacauguugaaauucuuuaacuggaccuuacuccaacaauucccucgacuagaauuacucgaccuaagaggaaauaaacuucuauuccucacagauagccuaucagacuuuacaucuucccuccgcacacuccuuuuaucacacaaccgcauaucccaucuacccuccggcuuccuaagugaagucagcucauuaaaacaccuugacuuauccuccaaucugcuaaaaacuauuaauaaaucugcacucgaaacaaaaacuaccacaaaacuaucuaugcucgaacugcacggcaaccccuuugaaugcacaugugacauaggugacuuuagacgauggauggacgaacacuuaaacguuaaaauaccacgacuugucgacgucaucugcgccucacccggcgaucaaagggggaaaucaauaguaagucuagaauuaacaaccugcguuuccgauguaaccgcagucauucucuucuuuuucacuuucuucaucaccacuaugguaaugcuagcugccuuagcgcaucaucucuuuuacugggauguuugguucaucuacaaugucugccuagcaaaaguaaaaggauacagaucauuaucuaccucccaaaccuuuuaugaugcauacaucucauacgacacuaaagacgcuucuguaacugauugggucaucaaugaacucagauaccaucuagaagaaagcagagauaaaaauguauuacuuugccuagaagaacgagacugggacccaggacuagccaucauagacaaccucaugcaauccauaaaccaaucaaagaaaacugucuuuguccuuacuaagaaauacgcaaaaucauggaacuucaaaacagcauuuuaucucgccuuacaaagauuaauggacgaaaacauggauguaaucaucuucauacuccuagaaccaguacuccaacacucacaauauuuaagacuaagacaacgcauauguaaauccucaauccuacaauggccagacaauccuaaagcugaaggcuuauuuuggcaaacucuccgaaacguuguauuaaccgaaaaugacucaagauacaacaauauguacguagauucaaucaaacaauacuaa

SEQ ID NO: 2676 - RNA, 66 nt, Artificial Sequence
  P16671_TM_1_8-29
ggauuaauagcaggagcaguaauaggagcaguauuagcaguauuuggaggaauauuaaugccagua

SEQ ID NO: 2677 - RNA, 81 nt, Artificial Sequence
  P32248_TM_1_60-86
uuucuuccuauuauguauucuauuauuuguuuuguuggucuucuugguaauggucuuguuguucuuacuuauauuuauuuu

SEQ ID NO: 2678 - RNA, 66 nt, Artificial Sequence
  P16671_TM_2_440-461
uuguuagguuuaauugaaaugauauuguuaucuguagguguaguuauguuuguagcuuuuaugaua

SEQ ID NO: 2679 - RNA, 63 nt, Artificial Sequence
  P32248_TM_2_96-116
uauuuacuuaaucuugcuguugcugauauucuuuuucuucuuacucuuccuuucugggcuuau

SEQ ID NO: 2680 - RNA, 66 nt, Artificial Sequence; identical to SEQ ID NO: 1640
  P32248_TM_3_131-152

SEQ ID NO: 2681 - RNA, 63 nt, Artificial Sequence; identical to SEQ ID NO: 1641
  P32248_TM_4_171-191

SEQ ID NO: 2682 - RNA, 84 nt, Artificial Sequence
  P32248_TM_5_220-247
uuuauaacuauacaaguagcucaaaugguaauuggauuucuaguuccacuucuagcuaugucuuucuguuaccuuguaauuaua

SEQ ID NO: 2683 - RNA, 78 nt, Artificial Sequence
  P32248_TM_6_264-289
guaauuauagcuguaguuguaguuuuuauuguauuucaacuuccauauaacgguguaguuuuagcucaaacuguagcu

SEQ ID NO: 2684 - RNA, 54 nt, Artificial Sequence; identical to SEQ ID NO: 1644
  P32248_TM_7_314-331

SEQ ID NO: 2685 - RNA, 69 nt, Artificial Sequence
  A0A5B9_TM_145-167
acaauucuauaugaaauucuacuuggaaaagcaacucuauaugcaguucuaguuucagcucuaguucua

SEQ ID NO: 2686 - RNA, 69 nt, Artificial Sequence; identical to SEQ ID NO: 1646
  B7Z8K6_TM_130-152

SEQ ID NO: 2687 - RNA, 63 nt, Artificial Sequence
  O00206_TM_632-652
acgauaauaggagugaguguguuaucgguauugguagugagugugguagcgguauugguauau

SEQ ID NO: 2688 - RNA, 66 nt, Artificial Sequence; identical to SEQ ID NO: 1648
  P01730_TM_397-418

SEQ ID NO: 2689 - RNA, 63 nt, Artificial Sequence; identical to SEQ ID NO: 1649
  P01850_TM_151-171

SEQ ID NO: 2690 - RNA, 78 nt, Artificial Sequence; identical to SEQ ID NO: 1650
  P07766_TM_127-152

SEQ ID NO: 2691 - RNA, 66 nt, Artificial Sequence; identical to SEQ ID NO: 1651
  P08575_TM_576-597

SEQ ID NO: 2692 - RNA, 63 nt, Artificial Sequence
  P08637_TM_209-229
guaucuuucugucuaguuaugguuuuacuuuuugcuguagauacaggucuauauuuuucugua

SEQ ID NO: 2693 - RNA, 81 nt, Artificial Sequence; identical to SEQ ID NO: 1653
  P10747_TM_153-179

SEQ ID NO: 2694 - RNA, 66 nt, Artificial Sequence; identical to SEQ ID NO: 1654
  P11912_TM_144-165

SEQ ID NO: 2695 - RNA, 66 nt, Artificial Sequence
  P15391_TM_292-313
guuucugcugucacucuugcuuauuuaauuuuuuguuuauguucucuuguuggcauucuucaucuu

SEQ ID NO: 2696 - RNA, 63 nt, Artificial Sequence; identical to SEQ ID NO: 1656
  P16410_TM_162-182

SEQ ID NO: 2697 - RNA, 63 nt, Artificial Sequence; identical to SEQ ID NO: 1657
  P26718_TM_52-72

SEQ ID NO: 2698 - RNA, 63 nt, Artificial Sequence; identical to SEQ ID NO: 1658
  P30273_TM_24-44

SEQ ID NO: 2699 - RNA, 63 nt, Artificial Sequence; identical to SEQ ID NO: 1659
  P40259_TM_160-180

SEQ ID NO: 2700 - RNA, 63 nt, Artificial Sequence; identical to SEQ ID NO: 1660
  P42081_TM_248-268

SEQ ID NO: 2701 - RNA, 63 nt, Artificial Sequence; identical to SEQ ID NO: 1661
  Q15762_TM_255-275

SEQ ID NO: 2702 - RNA, 63 nt, Artificial Sequence; identical to SEQ ID NO: 1662
  Q685J3_TM_4394-4414

SEQ ID NO: 2703 - RNA, 63 nt, Artificial Sequence; identical to SEQ ID NO: 1663
  Q9NNX6_TM_38-58

SEQ ID NO: 2704 - RNA, 63 nt, Artificial Sequence
  Q9NR97_TM_828-848
gcuguuauucuuuuuuuuuuuacuuuuuuuauuacuacuaugguuaugcuugcugcucuugcu

SEQ ID NO: 2705 - RNA, 48 nt, Artificial Sequence
  P14207_1-16
augguauggaaauggaugccuuuauuauuauuauuaguuuguguugca

SEQ ID NO: 2706 - RNA, 48 nt, Artificial Sequence
  O75787_1-16
auggcaguauuuguaguauuauuggcauuaguagcaggaguauuagga

SEQ ID NO: 2707 - RNA, 48 nt, Artificial Sequence; identical to SEQ ID NO: 1459
  P07359_1-16

SEQ ID NO: 2708 - RNA, 48 nt, Artificial Sequence
  P08637_1-16
auguggcaauuacuuuuaccuacugcuuuacuuuuacuugucucugcc

SEQ ID NO: 2709 - RNA, 51 nt, Artificial Sequence; identical to SEQ ID NO: 1461
  P07237_1-17

SEQ ID NO: 2710 - RNA, 51 nt, Artificial Sequence; identical to SEQ ID NO: 2502
  O60911_1-17

SEQ ID NO: 2711 - RNA, 51 nt, Artificial Sequence; identical to SEQ ID NO: 1463
  P20138_1-17

SEQ ID NO: 2712 - RNA, 51 nt, Artificial Sequence; identical to SEQ ID NO: 1464
  P27797_1-17

SEQ ID NO: 2713 - RNA, 54 nt, Artificial Sequence
  P10747_1-18
augcuacgucuacuucuagcucuaaaucuauuuccaucuauacaaguaacugga

SEQ ID NO: 2714 - RNA, 54 nt, Artificial Sequence
  O75487_1-18
auggcaagauuuggauugccagcacuauuauguacauuagcagucuuaagugca

SEQ ID NO: 2715 - RNA, 54 nt, Artificial Sequence; identical to SEQ ID NO: 1467
  P07996_1-18

SEQ ID NO: 2716 - RNA, 54 nt, Artificial Sequence; identical to SEQ ID NO: 1468
  P22748_1-18

SEQ ID NO: 2717 - RNA, 54 nt, Artificial Sequence; identical to SEQ ID NO: 1469
  Q15762_1-18

SEQ ID NO: 2718 - RNA, 54 nt, Artificial Sequence
  P30273_1-18
augauuccagcuguaguucuauuacuauuacuauuaguagaacaagcugcagcu

SEQ ID NO: 2719 - RNA, 54 nt, Artificial Sequence; identical to SEQ ID NO: 1471
  P38570_1-18

SEQ ID NO: 2720 - RNA, 54 nt, Artificial Sequence; identical to SEQ ID NO: 1472
  Q01638_1-18

SEQ ID NO: 2721 - RNA, 54 nt, Artificial Sequence; identical to SEQ ID NO: 2513
  Q9NZQ7_1-18

SEQ ID NO: 2722 - RNA, 57 nt, Artificial Sequence; identical to SEQ ID NO: 1474
  P13591_1-19

SEQ ID NO: 2723 - RNA, 57 nt, Artificial Sequence; identical to SEQ ID NO: 2515
  P26842_1-19

SEQ ID NO: 2724 - RNA, 57 nt, Artificial Sequence; identical to SEQ ID NO: 1476
  P15391_1-19

SEQ ID NO: 2725 - RNA, 57 nt, Artificial Sequence; identical to SEQ ID NO: 1477
  Q8NI17_1-19

SEQ ID NO: 2726 - RNA, 57 nt, Artificial Sequence; identical to SEQ ID NO: 1478
  P08571_1-19

SEQ ID NO: 2727 - RNA, 57 nt, Artificial Sequence; identical to SEQ ID NO: 1479
  P05154_1-19

SEQ ID NO: 2728 - RNA, 57 nt, Artificial Sequence; identical to SEQ ID NO: 1480
  P02787_1-19

SEQ ID NO: 2729 - RNA, 57 nt, Artificial Sequence; identical to SEQ ID NO: 1481
  P02671_1-19

SEQ ID NO: 2730 - RNA, 57 nt, Artificial Sequence
  P04216_1-19
augaaucuagcuauaucuauagcucuacuucuaacuguacuucaaguuucacgugga

SEQ ID NO: 2731 - RNA, 57 nt, Artificial Sequence; identical to SEQ ID NO: 1483
  P00747_1-19

SEQ ID NO: 2732 - RNA, 57 nt, Artificial Sequence; identical to SEQ ID NO: 2524
  P01764_1-19

SEQ ID NO: 2733 - RNA, 57 nt, Artificial Sequence; identical to SEQ ID NO: 2525
  P16150_1-19

SEQ ID NO: 2734 - RNA, 57 nt, Artificial Sequence
  Q6DN72_1-19
auguuauuauggacagcuguauuauuauuuguaccuuguguuggaaaaacaguuugg

SEQ ID NO: 2735 - RNA, 57 nt, Artificial Sequence; identical to SEQ ID NO: 1487
  Q01151_1-19

SEQ ID NO: 2736 - RNA, 57 nt, Artificial Sequence; identical to SEQ ID NO: 1488
  P07093_1-19

SEQ ID NO: 2737 - RNA, 57 nt, Artificial Sequence
  Q8WWQ8_1-19
augauguuacaacaucuaguuauauuuugccuuggauuaguaguucaaaauuucugu

SEQ ID NO: 2738 - RNA, 60 nt, Artificial Sequence; identical to SEQ ID NO: 1490
  Q13291_1-20

SEQ ID NO: 2739 - RNA, 60 nt, Artificial Sequence; identical to SEQ ID NO: 1491
  P35225_1-20

SEQ ID NO: 2740 - RNA, 60 nt, Artificial Sequence; identical to SEQ ID NO: 1492
  P25942_1-20

SEQ ID NO: 2741 - RNA, 60 nt, Artificial Sequence; identical to SEQ ID NO: 1493
  P52803_1-20

SEQ ID NO: 2742 - RNA, 60 nt, Artificial Sequence; identical to SEQ ID NO: 1494
  Q15116_1-20

SEQ ID NO: 2743 - RNA, 60 nt, Artificial Sequence; identical to SEQ ID NO: 1495
  P05556_1-20

SEQ ID NO: 2744 - RNA, 60 nt, Artificial Sequence; identical to SEQ ID NO: 1496
  Q12891_1-20

SEQ ID NO: 2745 - RNA, 60 nt, Artificial Sequence; identical to SEQ ID NO: 1497
  Q8IV16_1-20

SEQ ID NO: 2746 - RNA, 60 nt, Artificial Sequence
  Q03167_1-20
augacuucucauuauguuauugcuauuuuugcucuuaugucuucuugucuugcuacugcu

SEQ ID NO: 2747 - RNA, 60 nt, Artificial Sequence; identical to SEQ ID NO: 2539
  Q14246_1-20

SEQ ID NO: 2748 - RNA, 60 nt, Artificial Sequence; identical to SEQ ID NO: 1500
  P16871_1-20

SEQ ID NO: 2749 - RNA, 60 nt, Artificial Sequence; identical to SEQ ID NO: 1501
  P61769_1-20

SEQ ID NO: 2750 - RNA, 60 nt, Artificial Sequence; identical to SEQ ID NO: 1502
  Q9Y6W8_1-20

SEQ ID NO: 2751 - RNA, 63 nt, Artificial Sequence; identical to SEQ ID NO: 1503
  P10966_1-21

SEQ ID NO: 2752 - RNA, 63 nt, Artificial Sequence
  Q9BZW8_1-21
augcuagggcaagugguaacgcuaauacuauugcuauugcuaaagguauaucaagggaaaggg

SEQ ID NO: 2753 - RNA, 63 nt, Artificial Sequence
  P02778_1-21
augaaccaaacagcuauauuaauauguugccuuauauuucuaacucuaucugguauucaagga

SEQ ID NO: 2754 - RNA, 63 nt, Artificial Sequence; identical to SEQ ID NO: 1506
  P18564_1-21

SEQ ID NO: 2755 - RNA, 63 nt, Artificial Sequence; identical to SEQ ID NO: 1507
  O14525_1-21

SEQ ID NO: 2756 - RNA, 63 nt, Artificial Sequence; identical to SEQ ID NO: 1508
  P01130_1-21

SEQ ID NO: 2757 - RNA, 63 nt, Artificial Sequence; identical to SEQ ID NO: 1509
  P01732_1-21

SEQ ID NO: 2758 - RNA, 63 nt, Artificial Sequence
  P48061_1-21
augaaugcaaaaguaguaguaguauuaguauuaguacugacagcauuauguuuaagugaugga

SEQ ID NO: 2759 - RNA, 63 nt, Artificial Sequence; identical to SEQ ID NO: 1511
  P01589_1-21

SEQ ID NO: 2760 - RNA, 63 nt, Artificial Sequence; identical to SEQ ID NO: 1512
  Q86T13_1-21

SEQ ID NO: 2761 - RNA, 63 nt, Artificial Sequence; identical to SEQ ID NO: 1513
  Q5DID0_1-21

SEQ ID NO: 2762 - RNA, 66 nt, Artificial Sequence; identical to SEQ ID NO: 2554
  P40189_1-22

SEQ ID NO: 2763 - RNA, 66 nt, Artificial Sequence; identical to SEQ ID NO: 1515
  Q86YL7_1-22

SEQ ID NO: 2764 - RNA, 66 nt, Artificial Sequence; identical to SEQ ID NO: 2556
  P55075_1-22

SEQ ID NO: 2765 - RNA, 66 nt, Artificial Sequence; identical to SEQ ID NO: 1517
  Q30201_1-22

SEQ ID NO: 2766 - RNA, 66 nt, Artificial Sequence; identical to SEQ ID NO: 1518
  P07766_1-22

SEQ ID NO: 2767 - RNA, 66 nt, Artificial Sequence; identical to SEQ ID NO: 1519
  P18827_1-22

SEQ ID NO: 2768 - RNA, 66 nt, Artificial Sequence; identical to SEQ ID NO: 1520
  P55290_1-22

SEQ ID NO: 2769 - RNA, 66 nt, Artificial Sequence; identical to SEQ ID NO: 1521
  P37173_1-22

SEQ ID NO: 2770 - RNA, 66 nt, Artificial Sequence
  Q07325_1-22
augaaaaaaucaggaguacuauuccuacuaggaauaauacuacuaguacuaauaggaguacaagga

SEQ ID NO: 2771 - RNA, 66 nt, Artificial Sequence; identical to SEQ ID NO: 1523
  P04156_1-22

SEQ ID NO: 2772 - RNA, 66 nt, Artificial Sequence; identical to SEQ ID NO: 2564
  P31785_1-22

SEQ ID NO: 2773 - RNA, 69 nt, Artificial Sequence; identical to SEQ ID NO: 1525
  P01579_1-23

SEQ ID NO: 2774 - RNA, 69 nt, Artificial Sequence; identical to SEQ ID NO: 1526
  P23229_1-23

SEQ ID NO: 2775 - RNA, 69 nt, Artificial Sequence
  O60494_1-23
augaugaacaugucauuaccauuucuauggucauuacuaacucuauuaauauuugcagaaguaaacgga

SEQ ID NO: 2776 - RNA, 69 nt, Artificial Sequence; identical to SEQ ID NO: 2568
  P08575_1-23

SEQ ID NO: 2777 - RNA, 69 nt, Artificial Sequence; identical to SEQ ID NO: 1529
  Q8IWY4_1-23

SEQ ID NO: 2778 - RNA, 69 nt, Artificial Sequence; identical to SEQ ID NO: 1530
  Q08431_1-23

SEQ ID NO: 2779 - RNA, 69 nt, Artificial Sequence; identical to SEQ ID NO: 1531
  Q99665_1-23

SEQ ID NO: 2780 - RNA, 69 nt, Artificial Sequence; identical to SEQ ID NO: 1532
  Q6Q8B3_1-23

SEQ ID NO: 2781 - RNA, 69 nt, Artificial Sequence; identical to SEQ ID NO: 2573
  Q07011_1-23

SEQ ID NO: 2782 - RNA, 69 nt, Artificial Sequence; identical to SEQ ID NO: 1534
  Q8NHL6_1-23

SEQ ID NO: 2783 - RNA, 69 nt, Artificial Sequence; identical to SEQ ID NO: 2575
  P36894_1-23

SEQ ID NO: 2784 - RNA, 69 nt, Artificial Sequence
  Q16552_1-23
augaccccaggcaaaacaucacucguaucccuacuccuacuccuaucccuagaagcaauaguaaaagca

SEQ ID NO: 2785 - RNA, 69 nt, Artificial Sequence
  P42081_1-23
auggacccacaauguacaaugggauuaaguaauauauuauucguaauggcauucuuacuaucaggagca

SEQ ID NO: 2786 - RNA, 69 nt, Artificial Sequence; identical to SEQ ID NO: 1538
  P43121_1-23

SEQ ID NO: 2787 - RNA, 69 nt, Artificial Sequence
  O00206_1-23
augaugagugcaaguagauuagcaggaacauuaauaccagcaauggcauuuuuaaguuguguaagacca

SEQ ID NO: 2788 - RNA, 69 nt, Artificial Sequence; identical to SEQ ID NO: 2580
  P42701_1-23

SEQ ID NO: 2789 - RNA, 72 nt, Artificial Sequence; identical to SEQ ID NO: 1541
  P06729_1-24

SEQ ID NO: 2790 - RNA, 72 nt, Artificial Sequence; identical to SEQ ID NO: 1542
  P15328_1-24

SEQ ID NO: 2791 - RNA, 72 nt, Artificial Sequence; identical to SEQ ID NO: 2583
  P05112_1-24

SEQ ID NO: 2792 - RNA, 72 nt, Artificial Sequence; identical to SEQ ID NO: 2584
  P06127_1-24

SEQ ID NO: 2793 - RNA, 72 nt, Artificial Sequence; identical to SEQ ID NO: 1545
  P32248_1-24

SEQ ID NO: 2794 - RNA, 72 nt, Artificial Sequence
  Q7Z7D3_1-24
auggcuagcuuaggacaaauauuauucuggagcauuauaucuauaauuauaauucuagcuggagcuauagcu

SEQ ID NO: 2795 - RNA, 72 nt, Artificial Sequence; identical to SEQ ID NO: 1547
  P54756_1-24

SEQ ID NO: 2796 - RNA, 72 nt, Artificial Sequence; identical to SEQ ID NO: 1548
  Q92823_1-24

SEQ ID NO: 2797 - RNA, 72 nt, Artificial Sequence; identical to SEQ ID NO: 1549
  P19320_1-24

SEQ ID NO: 2798 - RNA, 72 nt, Artificial Sequence; identical to SEQ ID NO: 1550
  Q86UN2_1-24

SEQ ID NO: 2799 - RNA, 75 nt, Artificial Sequence; identical to SEQ ID NO: 2591
  P33151_1-25

SEQ ID NO: 2800 - RNA, 75 nt, Artificial Sequence
  P17813_1-25
auggacagaggaacacuaccacuagcaguagcacuauuacuagcaagcuguagcuuaagcccaacaucacuagca

SEQ ID NO: 2801 - RNA, 75 nt, Artificial Sequence; identical to SEQ ID NO: 2593
  P25445_1-25

SEQ ID NO: 2802 - RNA, 75 nt, Artificial Sequence; identical to SEQ ID NO: 1554
  P01730_1-25

SEQ ID NO: 2803 - RNA, 75 nt, Artificial Sequence; identical to SEQ ID NO: 1555
  Q685J3_1-25

SEQ ID NO: 2804 - RNA, 75 nt, Artificial Sequence; identical to SEQ ID NO: 1556
  P17787_1-25

SEQ ID NO: 2805 - RNA, 75 nt, Artificial Sequence; identical to SEQ ID NO: 1557
  Q6UQ28_1-25

SEQ ID NO: 2806 - RNA, 75 nt, Artificial Sequence; identical to SEQ ID NO: 1558
  P13987_1-25

SEQ ID NO: 2807 - RNA, 75 nt, Artificial Sequence; identical to SEQ ID NO: 1559
  P10721_1-25

SEQ ID NO: 2808 - RNA, 75 nt, Artificial Sequence; identical to SEQ ID NO: 1560
  P12319_1-25

SEQ ID NO: 2809 - RNA, 78 nt, Artificial Sequence; identical to SEQ ID NO: 1561
  Q9BZR6_1-26

SEQ ID NO: 2810 - RNA, 78 nt, Artificial Sequence; identical to SEQ ID NO: 1562
  P25063_1-26

SEQ ID NO: 2811 - RNA, 78 nt, Artificial Sequence; identical to SEQ ID NO: 1563
  Q9NR97_1-26

SEQ ID NO: 2812 - RNA, 78 nt, Artificial Sequence; identical to SEQ ID NO: 1564
  Q8N131_1-26

SEQ ID NO: 2813 - RNA, 78 nt, Artificial Sequence; identical to SEQ ID NO: 2605
  P49771_1-26

SEQ ID NO: 2814 - RNA, 78 nt, Artificial Sequence; identical to SEQ ID NO: 1566
  P02679_1-26

SEQ ID NO: 2815 - RNA, 78 nt, Artificial Sequence
  P14784_1-26
auggcagcuccagcuuuaucuuggcguuuaccuuuacuuauacuuuuacuuccacuugcaacuucaugggcaucugca

SEQ ID NO: 2816 - RNA, 81 nt, Artificial Sequence
  P05362_1-27
auggcaccaucaucaccaagaccagcacuaccagcauuauuaguacuauuaggagcacuauuuccaggaccaggaaaugca

SEQ ID NO: 2817 - RNA, 81 nt, Artificial Sequence
  Q13740_1-27
auggaaucaaaaggagcaucaucauguagacuauuauucugucuauuaauaucagcaacaguauuuagaccaggacuagga

SEQ ID NO: 2818 - RNA, 84 nt, Artificial Sequence; identical to SEQ ID NO: 1570
  Q13443_1-28

SEQ ID NO: 2819 - RNA, 84 nt, Artificial Sequence; identical to SEQ ID NO: 1571
  P14151_1-28

SEQ ID NO: 2820 - RNA, 84 nt, Artificial Sequence; identical to SEQ ID NO: 1572
  P56199_1-28

SEQ ID NO: 2821 - RNA, 84 nt, Artificial Sequence
  P11279_1-28
auggcugcaccuggaucugcacguagaccucuacuucuauuauuauuauuauuauuacuuggacuuaugcauugcgcuucagcu

SEQ ID NO: 2822 - RNA, 84 nt, Artificial Sequence
  P40259_1-28
auggcacguuuagcuuuaucuccaguuccaucucauuggaugguugcacuuuuacuuuuacuuucagcugaaccuguaccugca

SEQ ID NO: 2823 - RNA, 84 nt, Artificial Sequence; identical to SEQ ID NO: 1575
  P43681_1-28

SEQ ID NO: 2824 - RNA, 84 nt, Artificial Sequence; identical to SEQ ID NO: 1576
  P18627_1-28

SEQ ID NO: 2825 - RNA, 84 nt, Artificial Sequence; identical to SEQ ID NO: 1577
  Q5ZPR3_1-28

SEQ ID NO: 2826 - RNA, 84 nt, Artificial Sequence; identical to SEQ ID NO: 1578
  P23415_1-28

SEQ ID NO: 2827 - RNA, 84 nt, Artificial Sequence
  Q8TD46_1-28
augcuuuguccuuggcguacagcuaaucuuggacuuuuacuuauacuuacaauuuuucuuguagcugcaucuucaucuuuaugu

SEQ ID NO: 2828 - RNA, 87 nt, Artificial Sequence; identical to SEQ ID NO: 1580
  P17301_1-29

SEQ ID NO: 2829 - RNA, 87 nt, Artificial Sequence; identical to SEQ ID NO: 1581
  P12821_1-29

SEQ ID NO: 2830 - RNA, 87 nt, Artificial Sequence
  Q14118_1-29
augcguaugucuguagguuuaucuuuacuuuuaccuuuauggggacguacauuuuuacuuuuacuuucaguuguaauggcacaauca

SEQ ID NO: 2831 - RNA, 87 nt, Artificial Sequence; identical to SEQ ID NO: 1583
  P05231_1-29

SEQ ID NO: 2832 - RNA, 87 nt, Artificial Sequence; identical to SEQ ID NO: 1584
  O00602_1-29

SEQ ID NO: 2833 - RNA, 87 nt, Artificial Sequence; identical to SEQ ID NO: 1585
  Q9Y6Q6_1-29

SEQ ID NO: 2834 - RNA, 87 nt, Artificial Sequence; identical to SEQ ID NO: 2626
  Q9ULI3_1-29

SEQ ID NO: 2835 - RNA, 90 nt, Artificial Sequence; identical to SEQ ID NO: 1587
  Q8NBP7_1-30

SEQ ID NO: 2836 - RNA, 90 nt, Artificial Sequence
  P02675_1-30
augaaaagaaugguaagcuggagcuuucacaaacuaaaaacaaugaaacaccuacuacuauuacuauuaugcguauucuuagucaaaagc

SEQ ID NO: 2837 - RNA, 90 nt, Artificial Sequence
  P06756_1-30
auggcuuuuccuccacguagacguuuacguuuagguccacguggacuuccacuuuuacuuucagguuuacuuuuaccuuuauguagagcu

SEQ ID NO: 2838 - RNA, 93 nt, Artificial Sequence
  O60609_1-31
augguacguccacuuaacccuagaccucuaccuccaguuguacuuaugcuucuacuucuacuuccaccuucaccucuaccucuagcugcaggu

SEQ ID NO: 2839 - RNA, 93 nt, Artificial Sequence; identical to SEQ ID NO: 1591
  P50895_1-31

SEQ ID NO: 2840 - RNA, 93 nt, Artificial Sequence; identical to SEQ ID NO: 1592
  P28906_1-31

SEQ ID NO: 2841 - RNA, 93 nt, Artificial Sequence; identical to SEQ ID NO: 1593
  P08514_1-31

SEQ ID NO: 2842 - RNA, 93 nt, Artificial Sequence; identical to SEQ ID NO: 1594
  P00742_1-31

SEQ ID NO: 2843 - RNA, 96 nt, Artificial Sequence; identical to SEQ ID NO: 1595
  P26006_1-32

SEQ ID NO: 2844 - RNA, 96 nt, Artificial Sequence; identical to SEQ ID NO: 1596
  P13726_1-32

SEQ ID NO: 2845 - RNA, 96 nt, Artificial Sequence; identical to SEQ ID NO: 2637
  P11912_1-32

SEQ ID NO: 2846 - RNA, 96 nt, Artificial Sequence; identical to SEQ ID NO: 1598
  Q9H6X2_1-32

SEQ ID NO: 2847 - RNA, 99 nt, Artificial Sequence; identical to SEQ ID NO: 1599
  Q8IWK6_1-33

SEQ ID NO: 2848 - RNA, 99 nt, Artificial Sequence; identical to SEQ ID NO: 1600
  P58335_1-33

SEQ ID NO: 2849 - RNA, 102 nt, Artificial Sequence; identical to SEQ ID NO: 1601
  P06731_1-34

SEQ ID NO: 2850 - RNA, 102 nt, Artificial Sequence
  P33681_1-34
augggacacacaagaagacaaggaacaucaccaucaaaaugcccauaccuaaacuucuuccaacuacuaguacuagcaggacuaucacacuucugcucagga

SEQ ID NO: 2851 - RNA, 105 nt, Artificial Sequence
  P38567_1-35
auggguguacuuaaauuuaaacauauauuuuuccguucauuuguaaaaucaucuggaguuucacaaauaguuuucacuuuccuucuaauuccauguugccuuaca

SEQ ID NO: 2852 - RNA, 105 nt, Artificial Sequence; identical to SEQ ID NO: 1604
  P16410_1-35

SEQ ID NO: 2853 - RNA, 111 nt, Artificial Sequence; identical to SEQ ID NO: 1605
  P15814_1-37

SEQ ID NO: 2854 - RNA, 114 nt, Artificial Sequence; identical to SEQ ID NO: 1606
  Q92956_1-38

SEQ ID NO: 2855 - RNA, 123 nt, Artificial Sequence
  Q86VB7_1-41
augucaaaacuaagaaugguacuacuagaagacucaggaucagcagacuucagaagacacuucguaaaccuaucaccauucacaauaacaguaguacuacuacuaucagcaugcuucguaaca

SEQ ID NO: 2856 - RNA, 123 nt, Artificial Sequence
  P08648_1-41
augggaucaagaacaccagaaagcccacuacaugcaguacaauuaagauggggaccaagaagaagaccaccauuacuaccacuauuacuacuacuauuaccaccaccaccaagaguaggagga

SEQ ID NO: 2857 - RNA, 123 nt, Artificial Sequence
  P16109_1-41
auggcaaacugccaaauagcaauacuauaccaaagauuccaaagaguaguauucggaauaucacaacuacuaugcuucucagcacuaauaucagaacuaacaaaccaaaaagaaguagcagca

SEQ ID NO: 2858 - RNA, 132 nt, Artificial Sequence; identical to SEQ ID NO: 1610
  O75326_1-44

SEQ ID NO: 2859 - RNA, 135 nt, Artificial Sequence; identical to SEQ ID NO: 1611
  Q8N2Q7_1-45

SEQ ID NO: 2860 - RNA, 138 nt, Artificial Sequence; identical to SEQ ID NO: 1612
  Q86UN3_1-46

SEQ ID NO: 2861 - RNA, 540 nt, Artificial Sequence
  A0A5B9
auggaccucaaaaacguauucccaccagaaguagcaguauuugaaccaucagaagcagaaauaucacacacacaaaaagcaacauuagucugccuagcaacaggauuuuacccagaccacguagaacuaucaugguggguaaacggaaaagaaguacacucaggaguaagcacagacccacaaccacuaaaagaacaaccagcacuaaacgacucaagauauugccuaucaucaagacuaagaguaucagcaacauucuggcaaaacccaagaaaccacuuccgaugccaaguacaauucuacggacuaucagaaaacgacgaauggacacaagacagagcaaaaccaguaacacaaauaguaucagcagaagcauggggcagagcagacugcggauucacaucagaaucauaccaacaaggaguauuaucagcaacaauacuauacgaaauacuacuaggaaaagcuacacuauacgcaguccuaguaucagcccuaguacuaauggcaauggucaaaagaaaagacucacgaggauaa

SEQ ID NO: 2862 - RNA, 465 nt, Artificial Sequence
  B7Z8K6
augucacaaccacacacaaaaccaucaguauucguaaugaaaaacggaacaaacguagcaugccuaguaaaagaauucuacccaaaagacauaagaauaaaccuaguaucaucaaaaaaaauaacagaauucgacccagcaauaguaauaucaccauccggcaaauacaacgcaguaaaauuaggaaaauacgaagacucaaacucaguaacaugcucaguacaacacgacaacaaaacaguacacucaacagacuucgaaguaaaaacagacucaacagaccacguaaaaccaaaagaaacagaaaacacaaaacaaccaucaaaaucaugccacaaaccaaaagcaauaguacacacagaaaaaguaaacaugaugucacucacaguacuaggacuaagaaugcuauucgcaaaaacaguagcagucaacuuccucuuaacagcaaaacuauucuuccuauaa

SEQ ID NO: 2863 - RNA, 645 nt, Artificial Sequence
  B9A064
augagaccaaaaacaggacaaguaggaugcgaaacaccagaagaauuaggaccaggaccaagacaaagauggccauuauuacuacuuggauuagcaaugguagcacacggacuauuaagaccaaugguagcaccacaaucuggagauccagauccaggagcaucaguuggaaguucaagaucaagucuaagaucacuauggggcagauuauuacuacaaccaucuccacaaagagcagacccaagauguuggccaagaggauucuggucagaaccacaaucauuaugcuauguauucggaacaggaacaaaaguaacaguacuaggacaaccaaaagcaaacccaacaguaacauuauucccacccucaucagaagaacuacaagcaaacaaagcaacauuaguaugcuuaauaucagacuuuuacccaggagcaguaacaguagcauggaaagcagauggaucaccaguaaaagcaggaguagaaacaacaaaaccaucaaaacaaagcaauaauaaauacgcagcaucaucauacuuaucacuaacaccagaacaauggaaaagucacagaagcuauucaugccaaguaacacaugaaggaucaacaguagaaaaaacaguagcaccaacagaauguucauga

SEQ ID NO: 2864 - RNA, 2520 nt, Artificial Sequence
  O00206
augaugucagcaucuagauuagcagguacacuaauaccagccauggcauuucuuucaugcguuagaccagaaucuugggaaccaugugucgaaguuguuccuaauauaacauaccaaugcauggaauuaaacuuuuauaaaauaccagacaaucuaccauuuuccacaaaaaacuuagacuuaucuuucaacccccuuagacacuuaggaucauauucauucuucucuuucccagaacuccaaguccuagaucucagcagaugcgagauacaaacaauagaagauggcgcauaucagucauuaucucaccuaucuacauuaauacuaacuggaaauccaauucaauccuuagcucuaggagcuuuuucuggauuaucaucauugcaaaaacucguugcaguagaaaccaauuuagcaucauuagaaaacuucccaauaggccaccuaaaaacucuaaaagaacuaaacgucgcacauaaccuaauacaauccuuuaaauuaccagaauauuucucuaacuuaacuaaucuagagcacuuagauuuaagcucaaauaaaauacaaucaauauacugcacagauuuacgaguacuacaucaaaugccucuacuaaacuuaagccuugaccucucacuaaacccaaugaacuucauucaaccgggagcauucaaagaaauacgcuuacacaaacuuacucuaagaaacaacuucgacagucuuaauguaaugaaaaccuguauacaggguuuagcaggucuugaaguucacagacucguccucggugaauucagaaaugaaggaaauuuagaaaaauucgauaaaucagcacucgagggauuaugcaaucuaacaauugaagaauucagacuagccuaucuagacuacuaucuagaugauauaauagacuuauuuaacugcuuaacaaaugucuccucuuucagccucguauccguaacaauagaaaggguaaaagacuucucauacaauuucggauggcaacacuuagaacuuguaaauuguaaauucggccaauuuccuacucuaaaauuaaaaucacuuaaacguuuaacauucacaucaaacaaaggaggaaaugcauucucagaaguugauuuaccaucucuagaauucuuagaccuuucacguaacgguuuaucauuuaaaggaugcugcucacaauccgacuuuggcaccaccuccuuaaaauacuuagaccuaucauucaacggagucauaacuaugagcucuaauuuccuuggccuagaacaauuagaacacuuagacuuccaacauuccaacuugaaacaaauguccgaauucuccguauucuuaagcuuacgaaaucuuauauaucuagacaucucacauacccauaccagaguagccuucaauggaauuuucaacggauuaucaucucuagaagucuuaaaaauggcggguaacuccuuccaagaaaacuucuugccugacauuuuuacagaacuaagaaaccucacauuccuugaccucucacaaugccaauuagaacaauuguccccaacagcauuuaacucucuaucaagccuacaaguccuuaacaugucucacaacaauuucuuuucucuugauaccuuccccuacaaaugccuaaacucccuacaaguucuagauuacucuuuaaaucacauaaugacuucaaaaaaacaagaacuacaacauuucccuucuuccuuagcuuucuuaaaccuaacacaaaaugacuucgccuguaccugugaacaccaauccuuccuacaauggauaaaagaccaaagacaacuacuaguagaaguagaacguauggaaugugcaaccccguccgauaaacaaggaaugccaguauuauccuuaaacaucacaugccaaaugaacaaaaccaucauaggaguuaguguccucucuguacuaguaguuucaguaguagcaguccuuguuuacaaauuuuacuuucacuuaaugcuacuagccggcugcaucaaauacggaagaggagagaauauauacgaugcauuuguaauuuacuccagccaagacgaagauuggguacguaaugaacuuguaaaaaacuuagaagaaggcguucccccauuucaacuaugccuacacuacagagauuucauacccggcguugcaauagcugcaaauaucauucaugaaggcuuccacaaaucacgcaaaguaaucguaguaguaucucaacauuuuauacaaucucgauggugcauauuugaauaugaaauugcacaaacauggcaauucuuaucaucccgugcaggaauaauuuucauaguauuacaaaaaguugaaaaaacauuacugagacaacaaguagagcucuacagauuauuaucacgcaauacuuaucucgaaugggaagacucaguucuaggccgccacauauucuggcgucgccuaagaaaagccuuacuugacggaaaaucguggaaucccgaagguacuguagggacuggaugcaauuggcaagaagcgaccucaaucuga

SEQ ID NO: 2865 - RNA, 1377 nt, Artificial Sequence
  P01730
augaacagaggaguuccauucagacaccuauuacuaguacuccaacuagcacuacuaccagcagccacacaagguaaaaaaguuguccuaggaaagaaaggagauacaguagaacuuacaugcaccgcgucacaaaagaaaucaauucaauuccacuggaaaaauaguaaccaaauaaaaaucuuaggcaaccaaggaagcuuucuuacuaaaggaccaagcaaauuaaacgacagagcagacagcagacgaucauuaugggaccaaggaaauuucccccuaauaauaaaaaauuuaaaaauagaagacagugauaccuauauaugugaaguagaagaccaaaaagaagaaguacaauuacuaguauucggacucacagccaacagcgacacacaccuacuacaaggacaaucacuaacacuaacacuagaaucacccccaggcucuagccccuccguacaauguagaaguccaagaggcaagaacauacaaggaggcaaaacacuauccguaucacaauuagaauuacaggacaguggaacauggaccugcacaguacuacaaaaucaaaagaaaguagaauuuaaaauugacauaguaguacuagcuuuccaaaaagcauccagcauagucuauaaaaaagaaggagaacaaguagaauucagcuucccuuuagccuucacagucgaaaaacuaacaggaagcggcgaauuaugguggcaagcagaaagagcaagcucaaguaaaaguuggauaaccuucgauuuaaagaauaaagaaguaucaguaaaaagagucacacaagacccaaaacuacaaaugggaaaaaaauuaccuuuacaccucacacuaccacaagcacuaccacaguacgcaggaagcggaaacuuaacacuagcccuagaagcuaaaacaggaaaauuacaccaagaagucaaccuaguagucaugagagcaacacaauuacaaaaaaaccuaacaugcgaaguauggggaccaacaucaccuaaacuaauguuaaguuuaaaacuagaaaacaaagaagcaaaaguaucaaaaagagaaaaagcaguauggguucuaaacccagaagccggaauguggcaaugccuucuauccgacucugggcaaguacuacuagaauccaacauaaagguacuaccaacuuggucaacaccuguacaaccaauggcauuaauagucuuaggaggcguagccggauuacuauuauucauaggauuaggaauauucuucuguguaagaugcagacacagaaggagacaagcagaaagaaugagucaaaucaaaagauuauugagugaaaaaaaaacaugucaaugcccacacagauuccaaaaaacauguucaccaauauga

SEQ ID NO: 2866 - RNA, 537 nt, Artificial Sequence
  P01850
auggaagacuuaaacaaaguauucccaccagaaguagcaguauucgaaccaucagaagcagaaauaagccacacacaaaaagcaacacuaguaugccuagcaacaggauucuucccagaccacguagaacuaucaugguggguaaacggaaaagaaguacacucaggaguaucaacagacccacaaccacuaaaagaacaaccagcacuaaacgacucaagauacugcuuaucaucaagacuaagaguaagcgcaacauuuuggcaaaacccaagaaaccacuuuagaugccaaguacaauucuacggauuaucagaaaacgaugaauggacacaagacagagcaaaaccaguaacacaaauaguaucagcagaagcauggggaagagcugacugcggauucacaucaguaucauaccaacaaggaguccuaucagcaacaauauuauacgaaauacuacuaggaaaagcaacacuauacgcaguauuaguaucagcacuaguauuaauggcaaugguaaaaagaaaagacuucuaa

SEQ ID NO: 2867 - RNA, 624 nt, Artificial Sequence
  P07766
augcagagcggaacacauuggagaguauuaggauuaugcuuauuaucaguaggaguauggggacaagacggaaaugaagaaaugggaggaauaacacaaacaccauauaaaguaagcauaagcggaaccacgguaauacuaacaugcccacaauauccaggaagcgaaauacuauggcaacauaaugacaaaaacauaggaggagacgaagacgauaaaaauauaggaagcgaugaagaucacuuaucauuaaaagaauuuucagaauuagaacaaagcggauacuauguauguuacccaagaggcagcaaaccagaagaugcaaacuucuacuuauacuuaagagcaagaguaugcgaaaacuguauggaaauggauguaaugaguguagcaacaauaguaauaguagacauaugcauaacaggaggauuacuauuauuaguauacuauuggagcaaaaauagaaaagcaaaagcaaaaccaguaacaagaggagcaggagcaggaggaagacaaagaggacaaaauaaagaaagaccaccaccagucccaaacccagacuaugaaccaauaagaaaagggcaaagagacuuauauaguggauuaaaucaaagaagaauauga

SEQ ID NO: 2868 - RNA, 3915 nt, Artificial Sequence
  P08575
auguaccuaugguuaaaacuacuagccuucggguucgcauucuuagauacagaagucuucguaaccggacaaucaccaacaccaagcccaacagguuuaacuacagcuaaaaugccauccgugcccuuaucaucagacccauuaccuacacacaccacagcuuuuucacccgcuucgacuuucgaaagagaaaacgauuuuagugaaacuacaacaucucuauccccugacaacaccuccacacaaguaagcccagacucuuuagacaacgccagugcauucaauaccacuggaguaucauccguccaaacuccucacuugcccacacacgcugacucacaaacgccuuccgcugguacagacacucaaacuuucagcggcucagcagccaacgcaaaacucaacccuacaccugguaguaacgcuauuagcgacguuccaggagaacgauccacagcaucuaccuuuccuacagauccagucaguccucucacaaccacgcuaucccucgcacaccacucaucagccgcacuaccugcacgcacuuccaauacaacaauaacagcuaacacuucagaugcauaccuaaacgcaucagaaaccaccacacucucaccaucaggaucagcaguaaucucgacuacuacaaucgcaacaacaccaucuaaaccuacaugugaugaaaaauacgcuaauauaacaguagacuacuuauauaauaaagaaacaaaauuauucacagccaaacuaaacguaaaugaaaauguagaauguggaaauaacacauguaccaacaaugaaguacauaauuuaacugaaugcaagaaugcaucgguuaguauaucacacaacucaugcacagccccagacaaaacucuaauauuagacgucccuccaggaguagaaaaauuucaacuacacgauuguacucaaguugaaaaagcagauacaacaauuugccuaaaguggaaaaauauugaaaccuuuacuugcgacacacaaaacauaacauaccguuuccaaugugguaacaugaucuuugacaacaaagaaauuaaauuggaaaacuuagaaccagaacacgaauacaaaugugacucagaaauacuauacaauaaccauaaauuuaccaaugcauccaaaauaauaaaaacagacuucggaucaccaggagaaccucaaauuaucuuuugccguucagaagcagcacaucaaggaguaauaaccuggaauccaccgcaacgauccuuccauaauuucacacuaugcuauauaaaagaaacagaaaaagauugucucaauuuagacaaaaaucuaaucaaauacgaccuucaaaauuuaaaaccguacacuaaauacguccuaucacuccaugcuuacauuaucgccaaaguacaaagaaauggguccgccgcaaugugccacuuuacaacaaaaagugcaccuccaagccaagucuggaacaugacaguaucaaugacaucagauaauagcaugcauguaaaaugcagaccgccgagggauagaaacggaccacaugaacgguaucaccucgaaguugaagcuggaaauacauuaguuagaaaugaaagccauaaaaacugugacuuucgaguaaaagauuuacaauauucaacugacuauacauuuaaagccuacuuucauaauggggauuacccaggagaaccguuuauauuacaucauucuacaucguacaauucaaaggcuuugauagcguuuuuagcauuccuaauaauuguuacuucgaucgccuuauuaguaguacuuuauaaaaucuacgacuuacauaagaaacguucgugcaaucuagaugaacaacaggaacuuguagaaagggacgacgaaaaacaauuaaugaacguagaaccuauacaugcugacauacuauuagaaaccuacaaacgaaaaauagcagaugaaggaagacuauuucuggcagaguuucaauccauaccgagaguguuuucgaaauuuccaauuaaagaagcacgaaaaccauuuaaucaaaacaagaaucgauacguugauauauuaccguacgauuacaaucgcgucgaacuaucagagauaaauggcgacgcagguucaaacuacaucaaugcaucauauaucgauggauucaaagaaccucgaaaauacaucgcagcgcaaggucccagagacgaaacaguagaugacuuuuggcgaaugauaugggaacaaaaagcaacaguaaucguuaugguaaccagaugugaagaaggaaauagaaauaaaugugcggaauauuggccaucaauggaagaaggaacacgugcauuuggcgacguuguagucaaaauaaaccaacacaaacggugcccagauuacauaauccaaaaacuaaacauaguaaauaagaaagaaaaagcaacaggaagggaggucacgcacauccaauuuaccagcuggccagaccacggaguuccagaagacccacaucuccuuuuaaaauuaaggcgcagaguuaacgcauucuccaauuucuuuucgggcccaauaguuguucauuguagcgcuggugugggucggacagguaccuacaucggcaucgacgcaaugcuggaaggacucgaagccgaaaauaaaguagacguauauggcuacguaguaaaacuacgaagacagagaugucuaaugguacaaguagaggcacaauacauauuaauccaucaagcauugguagaauauaaucaauucggagaaacagaaguuaaccuuucggagcuacaccccuaucuucauaauaugaagaaaagagauccuccuucagaaccuucacccuuagaggcagaauuucaaagauuacccucauaccgaucuuggcgaacacaacacaucggcaaucaggaagaaaacaaaucuaaaaaucgcaacucaaauguuauaccauaugauuacaaccgcguuccguugaaacaugagcuugaaaugucaaaagaaagcgaacaugauucugaugaaucaagcgaugacgacucagacagugaagaaccuucgaaauacauuaaugcuucauuuauuaugucuuauuggaaacccgaaguaaugauagccgcacaagggccacuaaaagaaacaauaggagauuucuggcaaaugauauuucagcgaaaaguaaaagucauagucaugcuuaccgaacucaagcacggagaccaagaaauaugugcacaauauuggggagaagguaaacaaacauacggcgacauugaaguugaucugaaagacaccgacaagagcucaacauacacauuacguguauucgaacuaagacacuccaaaagaaaagauucaagaacaguuuaucaauaccaauauacaaacuggucaguagaacaauuaccagccgaaccaaaggaacuaauaucuaugauccaagucguaaaacaaaaauuaccccagaaaaauaguagcgaaggaaacaaacaucacaaaucaacaccccucuuaauccacugccgagauggcagucaacaaacaggcauauuuugugcccuauuaaacuugcuagagucugcagaaacagaggaaguaguugacauauuucaaguagucaaagcauuacgaaaagcacgcccggggaugguaaguacuuuugaacaauaucaauuucuauaugaugucauagcaaguaccuacccagcgcaaaacggccaaguaaagaaaaacaaucaucaagaagauaaaauagaguucgacaaugaaguagacaagguuaagcaagaugcgaauugcguaaauccccuaggagcuccggaaaaauuaccggaagcaaaagaacaagccgaaggaagugaaccuacaucagguacagaaggaccagaacauucaguaaauggccccgccagucccgcuuuaaaccaaggaucauaa

SEQ ID NO: 2869 - RNA, 765 nt, Artificial Sequence
  P08637
auguggcaacuauuacuaccaacagcucuacuacuauuaguaucagcaggaaugagaacagaagaucuaccaaaagcaguaguauuccuagaaccacaaugguacagaguacuagaaaaagacaguguaacacuaaaaugccaaggcgcauauucaccagaagacaacucaacacaaugguuucacaacgaaucacuaauaucaucacaagcaucaucuuacuucauagacgcagcaacaguagacgacucuggcgaauacagaugccaaacaaaccuauccacccuaucagacccaguacaauuagaaguacacauaggcuggcuacuacuacaagcaccacgauggguauucaaagaagaagacccaauacaccuacgaugccacucauggaaaaacacagcauuacacaaaguaacauaccuacaaaacggaaaaggcagaaaauacuuccaccacaacucagacuuuuacauuccaaaagcaacacuaaaagauucaggaucauacuucugcagaggacuauucggaucuaaaaacguaucaucagaaacaguaaauauaacaauaacacaaggacuagcaguaucaacaauaucaucauucuucccaccaggauaccaaguaucauucugccuaguaaugguacuacuauucgcuguagacacaggauuauacuucucaguaaaaacaaacauaagaucaucaacacgagacuggaaagaccacaaauucaaauggagaaaagauccacaagacaaauga

SEQ ID NO: 2870 - RNA, 663 nt, Artificial Sequence
  P10747
auguuaagacuccuacuagcacuaaaccuauuccccucaauacaaguaaccggaaacaaaauauuaguaaaacaaucaccaaugcuaguagcauacgacaacgcaguaaaccuauccugcaaauacucauacaaccuauucucaagagaauuucgagcaucacuacacaaaggccuagacucagcaguagaaguauguguaguauacggaaacuacucccaacaacuccaaguauacucaaaaacaggcuucaacugugacggaaaacucggaaacgaaucuguaacauucuaccuacaaaaccuauaugucaaccaaacagacaucuacuucugcaaaauagaaguaauguauccaccaccauaccuagacaacgaaaaaucaaacggaacaauaauacacguaaaaggaaaacaccuaugcccaucaccauuauucccaggaccaucaaaaccauucuggguccuaguaguaguaggaggaguacuagccugcuacucacuccuaguaacaguagcauucauaauauucuggguaagaucaaaaagaucaagacuacuacauucagacuacaugaacaugacaccaagaagaccaggcccaacaagaaaacacuaccaaccauacgcaccaccaagagacuucgcagcauacagaucauga

SEQ ID NO: 2871 - RNA, 681 nt, Artificial Sequence
  P11912
augccaggaggaccaggaguauuacaagcacuaccagcaacaauauucuuacuauuccuacuaucagcaguauacuuagguccaggaugccaagcauuauggaugcauaaaguaccagcaucauuaaugguaucauuaggagaagacgcacacuuucaaugcccacacaacucaucaaacaacgcaaacguaacaugguggagaguacuacacggaaacuacacauggccaccagaauuuuuaggaccaggagaagacccaaacggaacacuaauaauacaaaauguaaacaaaucacauggcgguaucuacguaugcagaguacaagaaggaaaugaaucauaccaacaaucaugcggaacauauuuaagaguaagacaaccaccaccaagaccauuccuagacaugggcgaaggaaccaaaaauagaauaauaacagcagaaggaauaauauuauuauuuugcgcaguaguuccaggaacauuauuauuauucagaaaaagauggcaaaacgaaaaauuaggacuagacgcaggcgacgaauacgaagacgaaaaucuauacgaaggauuaaaucuagacgacugcucaauguacgaagacaucucaagaggauuacaaggaacauaccaagacguaggcucacucaacauaggagacguacaacuagaaaaaccauga

SEQ ID NO: 2872 - RNA, 1671 nt, Artificial Sequence
  P15391
augccaccaccuagauuauuauucuuuuuauuguucuuaacaccaauggaaguaaggcccgaagaacccuuaguaguaaaaguagaagaaggagauaacgcuguacuccaaugucucaaaggaaccucagaugguccaacacaacaauuaacauggagcagagaaaguccauuaaaaccauucuuaaaacucucucuuggauuaccaggacuagguauacauaugagaccauuagcaauuuggcuuuuuauauuuaauguaucacaacaaaugggaggauuuuacuuaugucaaccuggaccaccuucagagaaggcuuggcaaccaggauggacaguaaauguagaaggaucaggagaacucuucagauggaauguaagugaucuaggaggauugggauguggccuuaaaaaucguucaagugagggaccaucaucaccuucaggaaaauuaaugucuccaaaauuauacguaugggcuaaagauagaccagaaauaugggaaggagaaccaccuuguuuaccaccaagagacaguuuaaaucaaucacuaagucaagaccuaaccauggcuccaggaucaacauuaugguuaagcuguggaguaccaccagauucuguauccagaggaccauuaucauggacucacguacauccgaaaggcccuaaaucauuacuaucauuggaacuaaaagaugauagaccagcaagagacauguggguaauggaaacaggauuauuacuaccaagagcuacagcgcaagacgcaggcaaauauuauugucauagaggaaauuuaacaaugagcuuucauuuagaaauaacagcacgaccaguauuauggcauugguuacuacgaacaggaggauggaaaguaucagcaguaacacuugcauaucuaauauucuguuuaugcucauuaguagguauucuacaucuacaacgagcgcucguauuacgaagaaaacgaaaaagaaugacugauccaacaagaagauucuuuaaaguaacucccccaccaggaucgggaccucaaaaccaauacgguaacguacuaucauuaccaacaccuaccucugguuuaggacgagcacaaagaugggcagcaggucuaggagguacagccccuucuuaugguaacccaucaucugauguacaagcagauggugcacuaggcuccagaucaccaccagguguaggaccggaagaagaagaaggugaaggauacgaagaaccagauucagaagaagauagugaauuuuacgaaaaugauagcaaucucggacaagaccaacucucacaagaugggucaggauaugaaaacccagaagaugaaccauuagguccagaagaugaagauucauucuccaacgccgagucauaugaaaaugaagaugaagaauuaacucagccaguagcaagaacaauggauuuucuaucaccgcaugggucagcaugggauccaucaagagaagcaacaucacuaggaagccaaucauaugaagauaugagaggaauuuuauaugcagcaccccaauuaagaagcauacgaggacaaccaggaccaaaucaugaagaagacgcagacucauaugaaaauauggauaacccggacggaccagauccagcauggggaggugguggaagaaugggaacaugguccacacgauaa

SEQ ID NO: 2873 - RNA, 672 nt, Artificial Sequence
  P16410
auggcauguuuaggauuccaaagacacaaagcacaacuaaacuuagcaacaagaacauggccaugcacacuacuauucuuucuacuauucauaccaguauucuguaaagcaaugcacguagcacaaccagcaguaguacuagcaucaucaagaggaauagcaucauucguaugcgaauacgcaucaccaggaaaagcaacagaaguaagaguaacaguacuaagacaagcagacucacaaguaacagaaguaugcgcagcaacauacaugaugggcaacgaacuuacauuccuagaugacucaauaugcacaggcacaucaucaggaaaccaaguaaaccuaacaauacaaggacuaagagcaauggacacaggauuauacauaugcaaaguagaacuaauguacccaccaccauacuaucucggaauaggaaacggaacacaaauauauguaaucgacccagaaccaugcccagacucugacuuccuauuauggauacuagcagcaguaucaucaggacuauucuucuacucauucuuacuaacagcaguaucacuaucuaaaaugcuaaaaaaaagaucaccacuaacaacaggaguauacguaaaaaugccacccacagaaccagaaugugaaaaacaauuccaaccauacuucauaccaauaaacuga

SEQ ID NO: 2874 - RNA, 1419 nt, Artificial Sequence
  P16671
augggaugugacagaaauugcggauuaauagcaggagcaguuauaggcgcaguacuugccguauuuggcggaauccuaaugccaguaggagacuuacuaauacaaaaaacaaucaaaaaacaaguuguccuagaagaaggaacaauagcauucaaaaauuggguaaaaacaggaacagaaguauaucgacaauuuuggauauuugacguacaaaacccacaagaaguaaugaugaacucauccaauauucaaguaaaacaacgaggcccauauacauauagaguaagauuccuugccaaagaaaacguaacacaagaugcagaagacaacacagucucauuccuucaaccaaauggugcaauuuucgaacccucccuuucaguaggaacagaagccgacaacuucacuguacuaaaucuagcugucgcagcagcaucacacauauaccaaaaccaauucguucaaaugauauuaaacucauuaauuaauaaaaguaaaucaucuauguuucaagucagaacucuaagagaacuacuaugggguuaccgagacccauucuuaucauuaguaccuuacccuguaacaacaacaguaggacuauuuuauccauacaauaacacagcagacggcgucuacaaaguauuuaauggaaaagacaacauaucaaaaguagcuauaaucgauacauacaaaggcaaacgaaacuuaucauacugggaaucacacugcgacaugaucaacggaacagacgcagcaucauucccaccauuugucgaaaaaucacaaguacuacaauucuuuuccucagauauauguagaucaauauaugcaguuuucgaaucagacguaaauuuaaaaggaauaccagucuacagauucguccuacccucaaaagcauuugcaucaccaguagaaaauccugauaacuacuguuuuuguaccgaaaaaauaauuagcaaaaacugcacuucauacggaguacuagacaucucaaaaugcaaagaaggaaggccaguauauauaucccuaccacacuucuuauacgcaucccccgauguaucagaaccaauagauggacuuaacccaaacgaagaagaacacagaacauacuuagauauugaaccaauaaccggcuucacacuacaauuugcuaaaagauuacaaguuaaccuacuaguaaaaccaucagaaaaaauacaaguccuaaaaaaccuuaaaagaaacuacauuguaccaauauuauggcuaaacgaaacaggaacaaucggagaugagaaagcaaauauguucagaucacaaguuacaggaaaaauaaauuuauuaggccucauagaaaugauacuacuauccgucggaguaguaauguucguagcauucaugauaucauauugcgcaugcagaucaaaaacaauaaaauga

SEQ ID NO: 2875 - RNA, 651 nt, Artificial Sequence
  P26718
augggauggauaagaggaagaagaucaagacacucaugggaaaugucagaauuccauaauuacaaccuagaccuaaaaaaauccgacuuuagcacaagauggcaaaaacaaagaugcccaguaguaaaaucaaaaugcagagaaaacgcaucaccauucuucuucugcugcuucauagcaguagcaaugggaauaagauucauaauaauggucgcaauauggucagcaguauuccuaaacagccuauucaaccaagaaguacaaaucccauuaaccgaaucauacugcggaccauguccaaaaaacuggauaugcuacaaaaacaacugcuaucaauucuucgacgaaaguaaaaacugguacgaaagccaagcaucaugcaugucacaaaacgcaucacuauuaaaaguauacucaaaagaagaccaagaccuacuaaaacuagucaaaucauaucacuggaugggacuaguacacauaccaacaaacggaucauggcaaugggaagacggaucaauauuaucaccaaaccuacuaacaauaauagaaaugcaaaaaggagacugcgcacuauacgcaucaucauucaaaggauacauagaaaacugcucaacaccaaacacauacauaugcaugcaaagaacaguauaa

SEQ ID NO: 2876 - RNA, 261 nt, Artificial Sequence
  P30273
augauaccagcaguaguacuacuacuacuacuacuaguagaacaagcagcagcacuaggagaaccacaacuaugcuacauacuagacgcaauacuauuccuauacggaauaguacuaacacuacuauacugcagacuaaaaauacaaguaagaaaagcagcaauaacaucauacgaaaaaucagacggaguauacacaggacuaucaacaagaaaccaagaaacauacgaaacacuaaaacacgaaaaaccaccacaauag

SEQ ID NO: 2877 - RNA, 1137 nt, Artificial Sequence
  P32248
auggaccuaggaaaacccaugaaaucaguacuaguagucgcauuauuaguaauuuuccaagucugucuaugccaagacgaaguaacagacgacuacauaggagacaacacaaccgucgacuauacacuauuugaaucauuauguucaaaaaaagauguacguaauuucaaagcaugguuccuaccaaucauguauuccauaauaugcuuuguaggucuauuaggcaacggacuuguaguauuaacauauauauacuucaaacgacuaaaaacuaugaccgauacuuauuuacuaaaccuugcaguagccgacauacuauuccuacuaacucuaccauucugggcauauucugcagcaaaaucaugggucuuuggaguacacuucugcaaauuaaucuuugcaauauacaaaaugucauucuucucaggaaugcuacuccuacuaugcauaucaauugacagauauguagcaauaguacaagcaguaucagcacacagacacagagcacgaguacuacuuauuuccaaauuaucaugcgucggaauauggauucuagcaacagucuuaucaauaccagaauuauuauacucugaccuacaaagaucaucauccgaacaagccaugagauguucccucauaacagaacacguagaagcuuuuauaaccauucaaguagcacaaauggucauaggauuccuaguaccauuauuagcaaugucauucuguuaccuaguaauaauaagaacccuccuacaagcaagaaacuucgaaagaaacaaagcaauaaaaguaauaauagcaguaguaguagucuucauaguauuucaacuaccauacaacggaguaguauuagcacaaacagucgcaaacuucaacaucacuucauccacaugcgaauuaucaaaacaauuaaacauagcauacgacguuaccuacucauuagcauguguacgauguuguguaaauccauuccuauacgcauucauaggcguaaaauuccguaacgaccuauuuaaauuauucaaagacuuaggcugccucucacaagaacaacuaagacaauggucaucaugccgacacauacgcagauccucaaugucaguagaagccgaaacaacaaccacauucucuccauga

SEQ ID NO: 2878 - RNA, 690 nt, Artificial Sequence
  P40259
auggcaagacuagcauuaucaccaguaccaagccacuggaugguagcacuacuacuauuacuaucagcagaaccaguaccagcagcaagaucagaagauagauacagaaacccaaaaggaucagcaugcucacgaauauggcaaaguccaagauuuauagcaagaaaaagaggauucacaguaaaaaugcacugcuacaugaacucagcaagcgguaauguaagcugguuauggaaacaagaaauggacgaaaacccacaacaacuaaaacuagaaaaaggaagaauggaagaaucacaaaacgaaucacuagcaacacuaacaauacaaggaauaagauucgaagacaauggaauauacuucugccaacaaaaauguaacaacacaucagaaguauaccaaggaugcggaacagaacuaagaguaaugggauucagcacacuagcccaacuaaaacaaagaaacacauuaaaagacggaauaauaaugauacaaacacuacuaauaauauuauuuauaauaguaccaauauuccuacuauuagacaaagacgacucaaaagcaggaauggaagaagaccacacauacgaaggacuagacauagaccaaacagcaacauacgaagacauaguaacacuaagaacaggagaaguaaaauggucaguaggagaacacccaggccaagaauga

SEQ ID NO: 2879 - RNA, 990 nt, Artificial Sequence
  P42081
auggacccacaaugcaccaugggacuauccaauauacucuuuguaauggccuuccucuuauccggagcagccccacucaaaauacaagcauacuucaacgaaacagcagaccuaccaugccaauuugccaacucacaaaaccaaucacucuccgaauuaguaguauucuggcaagaucaagaaaacuuaguacuuaacgaaguauaucuaggaaaagaaaaauucgacucaguacauucaaaauacaugggacgaacaucauuugacuccgacuccuggacacuaagacuacacaaccuacaaauaaaagacaaaggucuauaccaaugcauaauacaucauaaaaaaccaacaggaaugauaagaauacaccaaaugaacuccgaacuaucaguccuagcaaauuucucacaacccgaaauaguacccauauccaacauaaccgaaaacgucuacaucaaccuaacaugcaguucaauacacggauacccugaaccaaaaaaaaugagcguauuauuaagaaccaaaaauucaacaaucgaauacgacgguguaaugcaaaaaucacaagacaacguaacagaacuauaugacguaucaauaucacuaucaguaucauucccagacguaaccucaaacaugacaaucuucugcauacucgaaacagacaaaacuagacuacuaucauccccauucaguauugaacuagaagacccacaacccccaccagaccacauaccauggauaaccgcaguccuaccaacaguaauaauaugcguaaugguauucugccucauccuauggaaauggaaaaaaaaaaaaagaccuagaaacucauacaaaugcggaacaaacacaauggaaagagaagaaucagaacaaacaaaaaaaagagaaaaaauacacauaccagaaagaucagacgaagcacaaagaguauucaaaucaucaaaaacaucaucaugcgacaaaucagacacaugcuucuga

SEQ ID NO: 2880 - RNA, 1011 nt, Artificial Sequence
  Q15762
auggacuacccaacacuauuacucgcacuacuccauguauaccgagccuuaugugaagaaguacuauggcauaccuccgucccauucgcagaaaacaugucccuagaaugcguauacccuucaaugggaauacuaacacaaguagaaugguucaaaaucggaacccaacaagacaguauagcaauauucucaccaacacauggaaugguaauaagaaaaccauacgcagaaagaguauacuucuuaaacucaaccauggcaucaaacaacaugacccuauuuuucagaaacgcuagcgaagacgacguaggauacuauucauguucacucuacacauacccucaaggcacauggcaaaaaguaauacaaguaguucaaagcgacucauucgaagcagcaguaccaucuaacucacacauaguauccgaaccaggaaaaaauguaacauuaaccugccaaccacaaaugacuuggccaguacaagcaguaagaugggaaaaaauacaacccagacaaauagaccuacuaaccuacuguaacuuaguucacggacgaaacuucacaucaaaauucccaagacaaauaguaucuaacuguucacacggaagaugguccguaauuguaauaccagacguaacaguuucagacucaggacuauauagauguuaccuacaagcaagcgcaggagaaaacgaaacuuucguaaugagacuaaccguagcagaaggcaaaacugauaaccaauacacauuauuuguagcaggcggaacaguacucuuacuacuauucguaauaucaauaacaacaauaauaguaauauuucuaaacagaagaagaagaagagaaagaagagacuuauucacagaaucaugggacacacaaaaagcaccaaauaacuacagaucuccaauaagcacaucacaaccaacaaaccaaucuauggacgauacccgagaagauauauacgucaacuacccaacauuuucaagaagaccaaaaacaagaguauga

SEQ ID NO: 2881 - RNA, 13482 nt, Artificial Sequence
  Q685J3
augccuagaccgggaacuauggcauuaugucuauuaacucuggucuuaucacuacuuccaccccaagcagcagcugaacaagaucugucagucaauagagcugucugggauggcggagguuguaucucacaaggugauguauugaaucgacaaugucaacagcuuucucaacaugucagaacaggcagcgcugcuaacacugcuacugguacuacuuccaccaacguagucgaaccucguauguacuuauccugcaguaccaacccugaaaugacuagcauugaauccucaguuacgucugauacuccggguguuuccucaaccaggaugacuccgacugaaucacguaccacuagcgaaucaacuucugacucaaccacguuauuccccucaaguacugaagauacgucaucacccaccacuccggaaggcaccgauguacccaugucuacucccucagaagaauccauuuccucaacgauggcauuuguaucaaccgcgcccuuaccaucuuuugaagcguacaccagcuuaaccuauaaaguagauaugucuacaccucucacuacaucaacucaagcuagcucaaguccaacuaccccagaaucuaccaccauuccaaaaucaacaaauucugaaggcaguacacccuugaccuccaugccugcgucgacgaugaaaguagcaaguuccgaagcuauaacuuuacuuacuacuccaguagaaauaaguacccccgugacuaucucagcacaagcaaguucaucuccuacuaccgcugaaggaccaucuuugagcaauuccgcacccucagggggauccacuccacuuacaagaaugccacuuucagucauguugguuguuucuucagaagcaucgacguuauccaccacaccggcagcgacgaacauaccugucauuaccuccacagaagcguccucuucacccacuacugcggaaggcacuuccaucccuacauccacuuacaccgaagguucaacaccccuuacaagcacuccugcgagcacaaugccaguggcaaccuccgaaaugagcacccuuucaauaacuccuguugauacgucgacccucgugaccacgucgacugaaccgucaucgcuaccuacgaccgcagaagcuaccuccaugcucacgaguaccuuauccgaaggcucaacuccacucacaaacaugccagucucuacaaucuuagucgcaagcucagaagccagcaccacgaguacgauacccguagacucuaaaacauuugugacaaccgccucggaagccucuucaucaccaacgacugcagaagacacaucaauagcaacauccacgccuucggaaggaucuacaccacuuaccagcaugcccguaucgacuacaccagucgccucuucagaagccucgaaucuaucaacuaccccugucgacuccaagacccaagucaccaccucuaccgaggcaucguccucgccacccacagccgaagucaacucuaugccuaccagcacuccuucagaagggagcacacccuuaacuagcaugagcgucucuacgaugcccguugcaucaagcgaggcuucuaccuugucaacaacgccgguagauaccucuaccccaguuacuacuucuagcgaagcaucaucuagcucgacgaccccugaagguacgaguauaccuacgucaaccccuucagaagguuccacaccccugacaaacaugccuguaaguacaagguuagugguaucgucugaagcguccaccaccucuacgacccccgcugacucaaauaccuucgugacaacgucgucagaagcaagcaguucuucaacaacugccgaagggacgucuaugcccacuagcaccuauucagaaagagguacuaccaucaccucaaugagcguaucuacgaccuuagucgcaucaucagaggcuucaacauugucaacaacucccgucgauaguaacacuccugucacuaccucaacugaggcaacaucaucuucuaccacagcggaaggaacuucgaugcccacuuccacguacaccgagggcuccaccccacuaacgagcaugccugucaauacaacccuagucgcuucuuccgaagcaucuacccuauccacaacaccgguagacacauccacgccagucacaacaaguaccgaagcaucgagcucuccaacuacggcugauggagcgucgaugccaacaucgacuccgagugaggguuccaccccguuaacauccaugcccgucuccaagacucuauuaacaaguucagaagccagcacgcuauccacuaccccacuugauacaucuacucauaucacuaccagcacagaagcguccuguucaccaaccacaacugaaggcacuucuaugccgauuuccacuccuucagaaggaucgccucuucuaacaagcauuccaguaucuauuaccccagugacgucuccagaagcaucuacucugagcacuacccccguagacucuaauucccccguaaccacuucuacugagguaucguccucuccgacgccugcagaaggcacaucuaugcccacaucaacuuacucagaaggucguacgccacugacaucuaugccagucaguaccacacucguugcaacauccgcgauaucgacacuaaguacuacacccgucgauaccuccacuccaguuacuaauucaacugaagcaaggucaucucccacaacaucagaggguacgucaaugccaacaucaacacccggggaagguucuacaccauuaacauccaugccugauuccacgacccccguagucucauccgaggcaagaacgcuaagcgccacaccuguagauacaucaacuccaguuaccaccucaacagaagcgacuuccucaccuacuacugcggaagguacaucuauaccaacguccacccccucagaaggcacaacaccacuaacaaguacgccaguaucacauacccuuguugcaaacucugaggcguccacauuaagcacaacuccuguugacuccaacacaccacuaaccacgagcacggaagcuaguucuccacccccuacagccgaaggcacgaguaugccuaccagcacaccgucagaagguucuacuccccuuaccagaaugccagucaguacaaccauggucgccucguccgagaccucaacgcuuucuacaacuccagcagacacaucgaccccgguuacaaccuauucccaggcuucauccuccaguacgacagccgacggaacuuccaugccuaccuccacguacucugagggcagcacgccacucacaucuguccccguuucuaccaggcucguuguuagcucagaagccaguacucuauccaccaccccaguggacacaucgauuccaguuacaaccaguacugaggcuucgagcucccccacuaccgcugaagggacuagcauuccuaccaguccaccuagugaaggcaccacuccccuggccuccaugcccguaaguaccaccuuaguuguuucaucagaagcuaauacacucucuacuacaccaguugauucuaagacacaaguagccacaucaacagaagcauccuccccaccuccuaccgccgagguuaccucaaugccaacgucuacccccggcgaacgguccacaccucuuaccagcaugccugucagacacaccccuguagcauccuccgaggcaaguacucuuucgacauccccuguugacacuuccaccccuguaacaaccagugcagaaacaaguucuagucccacuacggcugaaggcacgucauugccaacaucuaccaccuccgaaggaagcacgcuauuaacuucgauacccguaucaacgacccuaguaacaucaccagaagcaaguacucugcuaacuacaccaguggauacaaaaggacccguuguuacaucaaaugaaguaucuucuucuccuacuccugcagagggaaccuccaugccuacuucaaccuauagugagggacgaaccccgcuaaccucaauaccuguaaacacaacuuuaguagcgagcuccgcuaucaguaucuugucuacuacuccagucgauaacucuacuccagucacuacuucuacugaagccuguucgucaccaacaacuucugaagguacauccaugccuaacucuaauccuucugaagguaccacaccucuuacaaguauaccugucaguacuaccccuguuguaagcucggaagccagcacacuaucggccacuccuguugauacauccacgccaggaacaacuagcgcagaagcgacgucaucaccaacgacggccgaagguauaucgauuccuaccucuacaccauccgagggaaaaacaccucuaaaaucaauucccguauccaauaccccuguggcaaauucggaagcaucaacucuaaguacgacuccagucgauucgaauagcccggucguuacuuccacugccgucuccucauccccgacuccugcagaaggaaccaguauagcgaucaguacgccaagcgaaggcaguacagcacuaacuuccauaccagucucgacaaccacaguugccuccucagaaaucaauuccuuaaguacgacgccggcugucacaagcaccccuguuaccacuuauucucaagcuagcaguucacccaccaccgcugacgguaccuccaugcaaacaucaacauauucggaggguuccacuccccuaacuucucuaccagucucaacuauguugguuguuucuagcgaagcaaacacccuaaguacuacuccgauugauuccaaaacacaaguaaccgcaucaacugaggcuucuucgucaacgacugcagaaggaucuucuaugaccauauccaccccgucugaaggcuccccauuacucacaaguauccccguaucuacuacacccguagcgagcccggaggcuuccacguuauccaccaccccuguggauucaaacucccccgucaucaccuccaccgaaguuucaaguucuccaacacccgccgaaggaaccucaaugccgacaucaacguacacggaggggcgaacgccgcuaaccucaauuacaguucguacuacgccggucgcaaguucagcaaucucuacacuuucaaccacaccuguagacaauucaacaccgguuacaacaucaacagaggcacguucaagcccaacuaccagcgaaggcacuucuaugcccaacagcacuccaucugaaggaaccacaccccucacaucuaucccuguuaguacgacaccaguacuuucuucggaggcuucuacauuguccgcaacccccaucgacacuucaacaccggugacaaccaguacggaagccacaucuagucccacaacugccgaaggaaccucaauaccgaccucuacccuaucugaaggaaugacaccacucaccucaaccccuguuucucauacucuagucgcuaauagugaagccucaacuuuauccaccacaccgguugauucuaauucuccaguaguaacgucaacagccguaaguucaucuccaacacccgcugaaggaaccucgauagcaacaucuacucccucagaagggaguaccgcccuaaccuccauacccgugucaaccacaacugucgccucuagcgaaacaaauacccucuccacgacucccgcugucacaucuacaccggucacaacguaugcucaaguuuccucgucuccuacuacugccgacgguuccucgaugcccacaucuacuccccgugagggucgaccuccucuaacaucaaucccgguuucaacaacaacaguugcuucaucagaaaucaauacacuaucgacaacuuuagcggacacaaggacuccagucaccacauauucucaggcuucuucuagccccacuacagcagaugguacaaguaugccuacacccgcguauucugagggaaguaccccauugacuucuaugccucuaucuaccacgcuuguuguuaguucagaagcaaguacauuaaguacaacuccggucgauacaucaacuccggcaacaaccaguaccgaaggcaguucuagucccacgacugccgguggaaccucuauacaaaccucuacaccgucagagcgaacuacuccucuggccgguaugcccgucucuacaacccucguuguuucuuccgaagguaacacauuaucaacaacucccguggauucuaagacucaaguuacaaauucaacagaagcauccucaucagccacugcugaagggucaaguaugaccauuagugccccaagugaaggaagcccgcucuugacauccauuccauuaucaacuacacccguugcaucuccagaggcuuccacauuaucaaccacaccaguggauaguaauucucccguaauaacuucaacugaaguaucaagcucuccuaucccaacagaaggaacaucaaugcaaacuucaacuuauagugaucgcaggaccccgcuuaccuccaugccuguuucaacaaccgucguagccucuagcgcaaucucaacucucucaaccacuccuguggacacgucgacgccugucacuaauucgacugaggcuagauccuccccgacaacaucggaaggaaccucuaugccgacaagcacacccucggaaggcucgacccccuuuacaucaaugcccgugucgacaaugccaguaguaacuuccgaggcuaguacuuuaucagcuacucccguugauacuucaaccccugucacaacaucaaccgaagcuaccucgucaccaacaacggcugaaggcaccucaauuccaacuuccaccuuaucagagggaacaacgccacuuacuucgauuccagucucucacacucuaguagccaauuccgaagucucaacucuuucaacuacaccuguugauucaaacaccccuuucacgacaucaacagaagcgucaucaccaccaccaaccgcagaggguaccagcaugccaacguccacgucauccgaaggaaacacuccacugacaagaaugccugucucaaccacaaugguagccucauucgagaccucuacccuuuccacgacuccugcugacacuucuacuccaguaacuacauacucccaagccgggucaagucccaccaccgccgaugacaccaguaugccuaccucuacuuacucugaagggucuacgcccuugacgagcguuccaguauccacaaugccaguuguaucaucugaagccucuacucacucgaccacgccuguagauacgaguaccccgguuacaaccucaaccgaggcuucaucaaguccuacuaccgcugaaggcaccuccauccccacuuccccaccguccgaagggacuacacccuuagcaagcaugccaguauccacaacccccguuguaucaucagaagccgguacauuaucaaccacgccaguugauaccucaacacccaugaccacaucuacagaggcuucaucgucucccacaacagcugaggacauugucguuccuauauccacagcgucggaaggguccacacuacucaccucuauuccaguuuccacaacuccuguagccucccccgaagccucaacauugaguaccacuccaguggauagcaacagucccgucguaacaaguacugaaauaucuucuucagccacaagugccgaggguacaucaaugccuaccaguacuuauucugaaggauccacuccguuacgcuccaugccaguauccacgaaaccccucgccucuuccgaggcuaguacuuugucgaccacaccuguagacaccaguauuccaguuaccacaaguacugaaacgucuucuucaccaacuaccgcaaaagauaccucuaugccuauauccacacccucugaagucucuaccucccucacaagcauucucgucucuacaaugccgguagcuuccucugaagccaguacacuaucuacaacuccaguugauacaagaacccuaguaaccacgucaacuggcacgucgucguccccaaccacagcagaggguucguccaugccaaccuccacuccaggugaacgcucgacuccacuuacaaacauccucgugagcacaacucuuuuagcaaauucagaggcuucaacucuuucaacgacaccuguagacaccucuacccccguaaccacaucagccgaggcuucgucaucacccacuacagcugaggguacaucgaugcgaauaaguacgcccucagacgguucuacuccgcucacaucgauacugguaucaacuuuaccggucgcaaguuccgaggcuagcacuguuucuacaacagcaguagauacuuccauaccagucacaacaucgacggaagcaucuaguuccccaaccacagcggagguuaccucuaugcccacaaguacaccuagcgaaacgucaaccccgcuaacuucgaugccgguaaaccauacuccagucgccucuagcgaagccggaacccuaucuacgaccccaguugacacauccacgccuguuacaacaagcacgaaagcuaguucaucaccgacaacagcagaaggcauaguuguaccaauaagcacagcaagcgaaggcucuacccuuuuaacaagcauccccguauccacuacacccguugcauccagugaagccaguacuuuaucuaccacacccguggauacuagcauaccuguuacuacaucuacugaagguaguucuucaccuacuacagccgaaggcacaaguaugccuauauccacuccgagcgaaguaagcacaccccugacuagcauccucguaagcacuguuccaguugcgggauccgaggcgucuacgcucagcaccacuccaguugauacacgaacacccgugaccaccagugcagaggcaaguuccucgcccacuacggcugaaggcacauccaugccgauaagcaccccuggggaaagacguacaccauugacuagcaugucgguauccacuaugccuguugcuagcucagaagcuaguacacucagcagaaccccugcagauacuucgacacccguaacaaccuccacugaggccuccucauccccuacaaccgccgaaggcacaggcauucccaucuccacuccgucggaaggauccacaccauuaacuucgauaccaguaaguacaaccccuguugcuauccccgaggccagcacccucaguacuacucccguagauaguaacucacccgucguuaccucuacggaaguuaguuccucucccacucccgcggaaggaaccagcaugccaauuuccacauauucggaggguucuacuccauuaacuggugucccagucucuacaacccccgugacuuccucagcaauauccacucugucaacaacgccagucgacacgucaaccccaguaacuaccuccacagaggcacauucaucaccuacaacaucugaaggaacaaguaugccgacuagcacgccaucugaggguuccacaccccuaacauacaugcccguaaguacaauguuagucguuaguucggaagacuccacacugagcgcaacgccaguugauacaagcacucccguaacaacuuccacagaagccacuucuucaaccacugcggaaggcacgaguauucccaccucgacacccuccgaagggaugaccccacuaacaucuguaccaguaagcaacacucccguugcaaguucggaggcauccaucuugucuaccacacccguagauucaaacaccccauuaacgaccaguacagaagcuaguucgucaccacccacagcugaaggaaccucaaugccuaccucuacucccuccgaagggagcaccccguugacaaguaugcccguaagcacaacaacaguagcgagcuccgagacgucuacgcuaucaaccacuccagccgacacgaguacuccaguaacaacguauucacaagcuagcagcucuccucccauugcagaugguacuucaaugccuacaaguacguacuccgaggggaguaccccucugacuaacauguccuuuuccaccacccccgugguuucuucugaagcgaguacucuaucaacuacuccuguagauaccucuaccccuguaacaaccagcacugaggcuucacucuccccgacuacagccgaagguaccagcauuccaaccagcagcccaagugaggggacaacccccuuagcaucgaugcccgugucuacaacccccgugguuaguucagaggucaauacauuaucaacaacucccguagauucgaacacucuaguuacaacaagcacagaggcuucaucaaguccaacaauagcugaagggacaaguuugccuacaucgacgacuuccgaagguaguacgccuuuaaguauuaugccacuaucuacaacgcccguugccucaagugaggcuucuacacucucaaccacaccuguagauacuuccaccccagucacaaccucaagucccaccaacaguucuccaacgacugcagagguuaccucaaugcccacauccacugcuggugagggcucuacaccucuaacuaauaugccugucuccacaacuccaguggcuuccucugaggcuagcacacucucgaccacaccuguugauuccaacacauuugucaccagcucuagucaagcaucaagcagccccgcuacacuucaagucacaacaaugcguaugaguacaccuuccgagggaaguucuucuuuaacaaccauguuauuaucuucgaccuacgucacuucuucugaagcaaguacuccauccacuccaucaguagaucguucaacuccagugacuacaucuacacaaaguaacaguacaccgacaccaccagaaguuaucacacuaccuaugucaacacccuccgaaguuucaacacccuuaacuauuaugcccguaagcacuaccucuguuacaauaucggaagcagguacagcuagcacguuaccaguagauacuucaacaccaguaauuacuucaacucaaguuaguagcucccccgucacacccgaagguacuaccaugccaauauggacgcccagcgaaggauccaccccacuuaccacaaugccggucuccacaacacguguuaccucaucggaaggcucaacgcuuaguaccccguccgucgucacgucaaccccagucaccacaucaaccgaagcaauaagcuccucagcaacacucgauucuacaacuaugucaguuagcaugcccauggaaauuagcacgcuagguacuacuauccuugucagcacaacccccguaacccguuuuccagaaagcucuaccccaagcaucccaagcguauacacuagcaugucgaugacaacugcuagugaagguucaucuucaccuacuacccuagaaggaacuacaacgaugccuauguccacuacgagcgaaagguccaccuuacucacgaccguucuaaucuccccaauuucugucaugucaccaucagaggccucaacuuuaaguacuccucccggcgauacaucaacgccucucuuaacaucuacuaaagcgggaucuuucagcaucccagccgaagugacaacaauaaggauuuccauaaccagcgagcgcagcaccccgcuuaccacucuauuagucucaaccacgcuaccuacaaguuuccccggcgcgucuauagcuucuacgccuccgcuagacacgucaacaacuuucacaccuagcacugauaccgcgucaaccccuacuauacccguggcaaccacgauuucaguuucuguaauaacagaggguucgaccccuggcacaacuauauucauacccagcacaccugucacaagcucaaccgcugacguauuuccggcaacaaccggugcuguguccacuccaguuaucacaagcacagaauuaaacacaccgaguacaagcucaucuucuacaaccacgaguuucucuacaaccaaagaauuuacuaccccggccaugacuaccgcggcaccguuaaccuacguaaccauguccacagcgccaaguacuccucgaacgacaucccgagggugcacaaccucagcauccaccuuaucagcaaccucaacaccgcacacuucuacguccgucacuacacguccgguuaccccaucguccgaaucuucucguccuucaacaauaacgagucacaccaucccaccgacauucccucccgcgcacuccucaacaccacccacaaccucugcaaguucaaccaccguaaacccagaagcagucaccacaaugacuacuaggacaaaacccaguacgcguacuacauccuucccuacuguuacuacuacagcuguaccaacgaacaccacgaucaaaagcaauccuaccucaaccccgacggucccuaggaccacaacaugcuuuggugacggaugccaaaauacagcuucucgcuguaagaaugguggcacaugggaugguuuaaagugucagugucccaaccuauacuacggggaacugugugaggaagucguuucuucgauagacaucgggccaccggaaaccauaagcgcucaaauggaacugacuguaacugucaccucaguuaaauuuacggaagaacucaaaaaucauucuucacaagaguuucaagaguuuaaacaaaccuuuacagaacaaaugaacaucguguacagcggcaucccagaauacgucgguguuaacauaacgaaacuucgauuagguaguguggugguugaacaugauguucuacuccggacuaaguacacuccugaauacaagacgguucuagacaacgcuaccgaaguuguaaaagagaaaaucacaaaaguuacuacacaacaaaucaugauuaaugauauaugcucagacaugauguguuuuaacacuacgggaacgcaaguacagaacaucacgguaacucaauacgaccccgaagaggacuguaggaaaauggcaaaggaauacggugauuauuucguaguagaauacagagaucagaaaccuuauuguauaucuccuugcgagccagguuuuaguguuagcaaaaauugcaaccuuggaaaaugccaaaugucauuaucagggccucaaugccuaugcguuaccacggaaacacacugguauucaggagagaccugcaaucaaggcacucaaaagagcuuaguguauggacuuguuggagcaggagucguguuaauguuaauuauucuuguagcgcuauuaauguuaguuuucagaucaaagcgagaagucaaacggcagaaauaccgccugucacaacuauauaaguggcaagaagaagauucugggccugcgcccgguacauuccagaacaucggguuugacauuugucaagacgacgauuccauccaccuugaaucuauauacucaaacuuccagcccucucugaggcacaucgauccugaaacuaaaauacguauucaacgaccacaaguuaugacuacaucuuucuga

SEQ ID NO: 2882 - RNA, 1215 nt, Artificial Sequence
  Q9NNX6
augagcgacuccaaagaaccaagacuacaacaacuaggacuguuagaagaagaacaauuaagaggauuaggauucagacaaacaagaggauacaaaaguuuagcgggaugcuuaggacacggaccauuaguauuacaacuccuaaguuucacacuauuagcaggacuauuaguacaaguaucaaaaguaccaaguagcauaagccaagaacaaagcagacaagaugcaauauaccaaaaccuaacacaacuaaaagcugcuguaggagaacucucagaaaaaucaaaacuacaagaaauauaccaagaacuaacacaauuaaaagccgcuguaggcgaacuaccagaaaaaucuaaacuacaagaaauauaccaagaauuaacaagacuaaaagcagcaguuggcgaacuaccagaaaaaucuaaauuacaagaaauauaccaagaacuaaccugguuaaaagcagcaguaggagaauuaccagaaaaaucaaaaaugcaagaaauauaccaagaacuaaccagacuaaaagcugcaguaggagaauuaccugaaaaaucaaaacagcaagaaauauaucaagaacuaacaagacuaaaagcagcaguaggagaacuaccagagaaaagcaaacaacaagaaauauaccaagaauuaacaagauuaaaagcagcagucggagaauuaccagaaaaaucaaaacaacaagaaauauaccaagaauuaacacaacuaaaagcagcaguagaaagacuaugccacccaugcccaugggaauggacauucuuucaaggcaacugcuacuuuaugagcaauagccaaagaaauuggcacgauucaauaacagcaugcaaagaaguaggagcacagcuaguagugauaaaaagcgcagaagaacaaaauuucuuacaacuacaaucauccagauccaacagauucacauggaugggacuaucagauuuaaaccaagaaggaacauggcaauggguagacggaucaccacuacuaccuagcuucaaacaauauuggaauagaggagaaccaaacaacguaggagaagaagacugcgcagaauuuucaggcaauggauggaacgacgauaaaugcaauuuagccaaauucuggauaugcaagaaaagcgcagcuuccugcagccgcgacgaagaacaauuccuaagcccagcaccagcaacaccaaacccaccaccagcauga

SEQ ID NO: 2883 - RNA, 3126 nt, Artificial Sequence
  Q9NR97
auggaaaacauguucuuacagucaucaaugcuuacuugcaucuuuuuauuaauuucaggaucuugcgaauuaugugccgaagaaaacuuuucacgaucauaccccugugaugaaaagaaacaaaaugacuccguuaucgcugaauguucaaauagacgauuacaagaaguaccacaaacaguuggcaaauacgucaccgaauuagacuuaucagacaacuucauaacucacauaacaaacgaauccuuccaaggccuucaaaacuuaaccaaaauaaaccuaaaucauaacccuaacgugcaacaccaaaacggcaacccuggcauucaaucaaacggucucaauauaacagacggagccuuccuaaaccucaaaaaccuccgcgaacuacucuuagaagacaaccaacuuccucaaauaccuuccggucugccagaaucccucacggaacuaagccuaauucaaaacaacauauacaauaucacaaaagaaggaaucucaagauuaauaaacuugaaaaaccucuacuuagcuuggaauugcuacuucaauaaaguaugcgagaaaaccaacauagaagacggaguauucgaaacauuaaccaaucuagaauuacuaucauuaucauucaauucccuaucccacgugcccccaaaacuacccucgucuuuacguaaacuauuucuaucuaacacacaaauuaaauauauuucagaagaagacuucaaaggucuaauaaauuuaacacuauuagaccucucagguaacuguccacgauguuucaaugcacccuucccaugcgucccaugugauggaggcgcaucaauaaauauagacagauuugcuuuucaaaacuuaacucaauuaagauaucuuaaucucaguuccacuuccuuacgcaaaauuaaugcagcuugguuuaaaaacaugccccaccuuaaagugcucgaucuagaauuuaauuauuuaguaggagaaauugccuccggugcauuccuuacuaugcucccuagacucgaaauuuuagaccuaucauuuaacuauauuaaaggauccuacccacaacauaucaacauaucaagaaacuuuucaaaauuacucuccuugcgagcauuacacuuacguggauauguauuccaagaacuaagagaagaugacuuucaaccacuaaugcagcugccaaaccucucaacuaucaacuuaggcaucaacuucauaaaacaaauagauuuuaaacucuuccaaaacuuuucaaaucucgaaauaauauaccuaucagaaaauagaauauccccauuaguaaaagacaccagacaaagcuaugcaaauucaucaucuuuucaaagacauauucgcaaaagaagaucaacagacuucgaauuugacccacacucuaacuucuaccacuucacucguccuuuaauaaaaccucaaugugcagcauaugguaaagcacuagaucucucuuuaaauucuaucuuuuucauaggacccaaucaauuugaaaauuuacccgauauugcuugucuaaaccucucugccaacucaaaugcucaaguacucucaggaacagaauuuuccgccauaccacauguaaaauaucuagaucuaacaaacaaucgccuagacuucgacaacgcaucagccuuaacagaacucucugacuuagaaguacuugacuuaucauacaacagccauuacuuccgcauagccggaguaacucaucaucuagaauuuauacaaaacuucacuaaucucaaaguccucaacuuaucccacaauaacaucuauacauuaacagacaaauacaaucucgaaucaaaaucacucgucgaacucguauucucuggcaaccgccuugauauucuuuggaaugacgacgacaacagauacauaaguauauuuaaaggauuaaagaaccuaacccgccuagaucucucacuuaacagauuaaaacauauaccaaaugaagcauuccuaaauuuaccugccucacuaacagaacuacacaucaaugauaauauguuaaaauucuucaauuggacucucuuacaacaauucccaagacucgaacuacuagaccuaagaggcaacaaauuacuauuuuuaacugauucccuaucagacuucacuuccagcuuaagaaccuuacuccucucccacaacagaauaucucaucuaccuuccggauuucuaucugaaguuucaucauuaaaacaccuagaccuuucuucaaaccuuuuaaaaaccauaaauaaaucggcacuagaaacaaagacuaccacaaaacuuucaauguuagaauuacacggaaacccuuuugaauguacaugugauauaggagacuuuagaagauggauggacgaacaucuaaacguaaaaaucccucggcuaguagauguaauaugcgcaucuccaggagaucaaagagggaaauccaucgucucauuagaacuaaccacauguguaucagauguaacagcaguaauacuauucuuuuucacauucuuuauaacaacgauggucaugcuagccgcauuagcacaccaccucuucuauugggauguuugguucauauacaacguuugccuugccaagguaaaaggcuaucgaucauuaucaacaagucaaacuuucuacgacgccuacauaagcuacgacacaaaagaugcuucagucaccgacugggucaucaaugaacucagauaccaucucgaagaaucaagagauaaaaauguacuucucugccuagaagaaagagauugggaccccggguuagccauaauugacaaccuaaugcaaaguaucaaccagucuaagaaaacaguuuucguccucacuaagaaauaugcuaaauccuggaacuucaaaaccgccuuuuaucucgcauuacaaagacucauggacgaaaauauggacguaaucauauucauacuccuugaacccguauuacaacauucacaguaucuccgauuaagacaacggauaugcaaaucuucaauccuacaauggccagauaauccuaaagcugaaggccuauuuuggcaaacacuuagaaacguuguucucacagaaaacgacucccguuacaauaacauguacgucgacucuauuaaacaauauuaa

SEQ ID NO: 2884 - RNA, 66 nt, Artificial Sequence; identical to SEQ ID NO: 2676
  P16671_TM_1_8-29

SEQ ID NO: 2885 - RNA, 81 nt, Artificial Sequence; identical to SEQ ID NO: 2677
  P32248_TM_1_60-86

SEQ ID NO: 2886 - RNA, 66 nt, Artificial Sequence
  P16671_TM_2_440-461
cuuuuagguuuaauugaaaugauacuuuuaucuguagguguaguuauguuuguagcuuuuaugaua

SEQ ID NO: 2887 - RNA, 63 nt, Artificial Sequence; identical to SEQ ID NO: 1639
  P32248_TM_2_96-116

SEQ ID NO: 2888 - RNA, 66 nt, Artificial Sequence; identical to SEQ ID NO: 1640
  P32248_TM_3_131-152

SEQ ID NO: 2889 - RNA, 63 nt, Artificial Sequence; identical to SEQ ID NO: 1641
  P32248_TM_4_171-191

SEQ ID NO: 2890 - RNA, 84 nt, Artificial Sequence; identical to SEQ ID NO: 1642
  P32248_TM_5_220-247

SEQ ID NO: 2891 - RNA, 78 nt, Artificial Sequence; identical to SEQ ID NO: 1643
  P32248_TM_6_264-289

SEQ ID NO: 2892 - RNA, 54 nt, Artificial Sequence; identical to SEQ ID NO: 1644
  P32248_TM_7_314-331

SEQ ID NO: 2893 - RNA, 69 nt, Artificial Sequence; identical to SEQ ID NO: 1645
  A0A5B9_TM_145-167

SEQ ID NO: 2894 - RNA, 69 nt, Artificial Sequence; identical to SEQ ID NO: 1646
  B7Z8K6_TM_130-152

SEQ ID NO: 2895 - RNA, 63 nt, Artificial Sequence
  O00206_TM_632-652
acuauaauuggaguuucaguuuuaucuguauuaguaguuucaguuguagcuguauuaguauau

SEQ ID NO: 2896 - RNA, 66 nt, Artificial Sequence
  P01730_TM_397-418
auggcguuaauaguuuugggugggguugcggguuuguuauuguuuauagguuuggguauauuuuuu

SEQ ID NO: 2897 - RNA, 63 nt, Artificial Sequence; identical to SEQ ID NO: 1649
  P01850_TM_151-171

SEQ ID NO: 2898 - RNA, 78 nt, Artificial Sequence; identical to SEQ ID NO: 1650
  P07766_TM_127-152

SEQ ID NO: 2899 - RNA, 66 nt, Artificial Sequence
  P08575_TM_576-597
gcccuuauagcuuuccuugcauuucuaauuauaguuacaucuauagcucuacuuguaguucuauau

SEQ ID NO: 2900 - RNA, 63 nt, Artificial Sequence; identical to SEQ ID NO: 2692
  P08637_TM_209-229

SEQ ID NO: 2901 - RNA, 81 nt, Artificial Sequence; identical to SEQ ID NO: 1653
  P10747_TM_153-179

SEQ ID NO: 2902 - RNA, 66 nt, Artificial Sequence; identical to SEQ ID NO: 1654
  P11912_TM_144-165

SEQ ID NO: 2903 - RNA, 66 nt, Artificial Sequence; identical to SEQ ID NO: 1655
  P15391_TM_292-313

SEQ ID NO: 2904 - RNA, 63 nt, Artificial Sequence; identical to SEQ ID NO: 1656
  P16410_TM_162-182

SEQ ID NO: 2905 - RNA, 63 nt, Artificial Sequence; identical to SEQ ID NO: 1657
  P26718_TM_52-72

SEQ ID NO: 2906 - RNA, 63 nt, Artificial Sequence
  P30273_TM_24-44
cuauguuacauucuagaugcaauucuauuucuauauggaauuguacuuacacuucuauauugc

SEQ ID NO: 2907 - RNA, 63 nt, Artificial Sequence
  P40259_TM_160-180
ggcauuaucaugauccaaacccuccucauuauccucuucauuaucguccccauuuuccuccuc

SEQ ID NO: 2908 - RNA, 63 nt, Artificial Sequence
  P42081_TM_248-268
uggauaacugcaguuuuaccuacaguuauaauuugcguuaugguuuucugucuaauucuaugg

SEQ ID NO: 2909 - RNA, 63 nt, Artificial Sequence; identical to SEQ ID NO: 1661
  Q15762_TM_255-275

SEQ ID NO: 2910 - RNA, 63 nt, Artificial Sequence
  Q685J3_TM_4394-4414
cuuguuggugcugguguuguuuuaauguuaauuauuuuaguugcuuuacuuaugcuuguuuuu

SEQ ID NO: 2911 - RNA, 63 nt, Artificial Sequence; identical to SEQ ID NO: 1663
  Q9NNX6_TM_38-58

SEQ ID NO: 2912 - RNA, 63 nt, Artificial Sequence; identical to SEQ ID NO: 2704
  Q9NR97_TM_828-848

SEQ ID NO: 2913 - RNA, 886 nt, Artificial Sequence
  HsCTLA4(1-105)-(G4S)3-GgOva(792-827)-(G4S)3-PADRE-(G4S)3-HsCTLA4( 484-672)
ggggcgcugccuacggagguggcagccaucuccuucucggcaucaagcuuaccauggccugccugggcuuccagcgccacaaggcccagcucaaccuggcgacccggaccuggcccugcacgcugcucuucuuccugcuguucauccccguguucugcggcgggggcgggagcggcgggggcggcuccgggggcgggggcagccuggagucgaucaucaacuucgagaagcugaccgagggcgggggcgggagcggcgggggcggcuccgggggcgggggcagcgccaaguucguggccgccuggacccugaaggcggccgccggcgggggcgggagcggcgggggcggcuccgggggcgggggcagcuuccuccuguggauccuggccgccgucuccagcggccucuucuucuacuccuuccugcugaccgcggugagccucuccaagaugcugaagaagcgcagcccccugacgaccgggguguacgucaagaugccgcccaccgagcccgagugcgagaagcaguuccagcccuacuucauccccaucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2914 - RNA, 877 nt, Artificial Sequence
  HsCTLA4(1-105)-(G4S)3-MmTrp2(942-968)-(G4S)3-PADRE-(G4S)3-HsCTLA4 (484-672)
ggggcgcugccuacggagguggcagccaucuccuucucggcaucaagcuuaccauggccugccugggcuuccagcgccacaaggcccagcucaaccuggcgacccggaccuggcccugcacgcugcucuucuuccugcuguucauccccguguucugcggcgggggcgggagcggcgggggcggcuccgggggcgggggcagcuccguguacgacuucuucguguggcugggcgggggcgggagcggcgggggcggcuccgggggcgggggcagcgccaaguucguggccgccuggacccugaaggcggccgccggcgggggcgggagcggcgggggcggcuccgggggcgggggcagcuuccuccuguggauccuggccgccgucuccagcggccucuucuucuacuccuuccugcugaccgcggugagccucuccaagaugcugaagaagcgcagcccccugacgaccgggguguacgucaagaugccgcccaccgagcccgagugcgagaagcaguuccagcccuacuucauccccaucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2915 - RNA, 504 nt, Artificial Sequence
  HsCTLA4(1-105)-(G4S)3-GgOva(792-827)-(G4S)3-PADRE-(G4S)3-HsCTLA4( 484-672)
auggccugccugggcuuccagcgccacaaggcccagcucaaccuggcgacccggaccuggcccugcacgcugcucuucuuccugcuguucauccccguguucugcggcgggggcgggagcggcgggggcggcuccgggggcgggggcagccuggagucgaucaucaacuucgagaagcugaccgagggcgggggcgggagcggcgggggcggcuccgggggcgggggcagcgccaaguucguggccgccuggacccugaaggcggccgccggcgggggcgggagcggcgggggcggcuccgggggcgggggcagcuuccuccuguggauccuggccgccgucuccagcggccucuucuucuacuccuuccugcugaccgcggugagccucuccaagaugcugaagaagcgcagcccccugacgaccgggguguacgucaagaugccgcccaccgagcccgagugcgagaagcaguuccagcccuacuucauccccaucaacuga

SEQ ID NO: 2916 - RNA, 495 nt, Artificial Sequence
  HsCTLA4(1-105)-(G4S)3-MmTrp2(942-968)-(G4S)3-PADRE-(G4S)3-HsCTLA4 (484-672)
auggccugccugggcuuccagcgccacaaggcccagcucaaccuggcgacccggaccuggcccugcacgcugcucuucuuccugcuguucauccccguguucugcggcgggggcgggagcggcgggggcggcuccgggggcgggggcagcuccguguacgacuucuucguguggcugggcgggggcgggagcggcgggggcggcuccgggggcgggggcagcgccaaguucguggccgccuggacccugaaggcggccgccggcgggggcgggagcggcgggggcggcuccgggggcgggggcagcuuccuccuguggauccuggccgccgucuccagcggccucuucuucuacuccuuccugcugaccgcggugagccucuccaagaugcugaagaagcgcagcccccugacgaccgggguguacgucaagaugccgcccaccgagcccgagugcgagaagcaguuccagcccuacuucauccccaucaacuga

SEQ ID NO: 2917 - RNA, 504 nt, Artificial Sequence
  HsCTLA4(1-105)-(G4S)3-GgOva(792-827)-(G4S)3-PADRE-(G4S)3-HsCTLA4( 316-504)
auggcuugccuuggauuucagcggcacaaggcucagcugaaccuggcuaccaggaccuggcccugcacucuccuguuuuuucuucucuucaucccugucuucugcggaggugguggauccggcgguggcgguucugguggagguggaucucuugagaguauaaucaacuuugaaaaacugacugaaggaggugguggauccggcgguggcgguucugguggagguggaucugccaaauuuguugcugccuggacccugaaagcugcugcuggaggugguggauccggcgguggcgguucugguggagguggaucuuuccuccucuggauccuugcagcaguuaguucgggguuguuuuuuuauagcuuucuccucacagcuguuucuuugagcaaaaugcuaaagaaaagaagcccucuuacaacaggggucuaugugaaaaugcccccaacagagccagaaugugaaaagcaauuucagccuuauuuuauucccaucaauuga

SEQ ID NO: 2918 - RNA, 495 nt, Artificial Sequence
  HsCTLA4(1-105)-(G4S)3-MmTrp2(942-968)-(G4S)3-PADRE-(G4S)3-HsCTLA4 (316-504)
auggcuugccuuggauuucagcggcacaaggcucagcugaaccuggcuaccaggaccuggcccugcacucuccuguuuuuucuucucuucaucccugucuucugcggaggugguggauccggcgguggcgguucugguggagguggaucuagcguguaugacuuuuuuguguggcucggaggugguggauccggcgguggcgguucugguggagguggaucugccaaauuuguugcugccuggacccugaaagcugcugcuggaggugguggauccggcgguggcgguucugguggagguggaucuuuccuccucuggauccuugcagcaguuaguucgggguuguuuuuuuauagcuuucuccucacagcuguuucuuugagcaaaaugcuaaagaaaagaagcccucuuacaacaggggucuaugugaaaaugcccccaacagagccagaaugugaaaagcaauuucagccuuauuuuauucccaucaauuga

SEQ ID NO: 2919 - protein, 167 aa, Artificial Sequence
  HsCTLA4(1-35)-(G4S)3-GgOva(256-267)-(G4S)3-PADRE-(G4S)3-HsCTLA4(1 62-223)
MACLGFQRHKAQLNLATRTWPCTLLFFLLFIPVFCGGGGSGGGGSGGGGSLESIINFEKLTEGGGGSGGGGSGGGGSAKFVAAWTLKAAAGGGGSGGGGSGGGGSFLLWILAAVSSGLFFYSFLLTAVSLSKMLKKRSPLTTGVYVKMPPTEPECEKQFQPYFIPIN

SEQ ID NO: 2920 - protein, 164 aa, Artificial Sequence
  HsCTLA4(1-35)-(G4S)3-MmTrp2(180-188)-(G4S)3-PADRE-(G4S)3-HsCTLA4( 162-223)
MACLGFQRHKAQLNLATRTWPCTLLFFLLFIPVFCGGGGSGGGGSGGGGSSVYDFFVWLGGGGSGGGGSGGGGSAKFVAAWTLKAAAGGGGSGGGGSGGGGSFLLWILAAVSSGLFFYSFLLTAVSLSKMLKKRSPLTTGVYVKMPPTEPECEKQFQPYFIPIN

SEQ ID NO: 2921 - RNA, 39 nt, Artificial Sequence
  PADRE epitope
gccaaauuuguugcugccuggacccugaaagcugcugcu

SEQ ID NO: 2922 - RNA, 36 nt, Artificial Sequence
  OVA epitope (792-827)
cuugagaguauaaucaacuuugaaaaacugacugaa

SEQ ID NO: 2923 - RNA, 27 nt, Artificial Sequence
  Trp2 epitope mus musculus (942-968)
agcguguaugacuuuuuuguguggcuc

SEQ ID NO: 2924 - RNA, 1217 nt, Artificial Sequence
  Ovalbumin Ova
ggccgcgggaauucgauuaagguaccaugggcuccaucggugcagcaagcauggaauuuuguuuugauguauucaaggagcucaaaguccaccaugccaaugagaacaucuucuacugccccauugccaucaugucagcucuagccaugguauaccugggugcaaaagacagcaccaggacacaaauaaauaagguuguucgcuuugauaaacuuccaggauucggagacaguauugaagcucaguguggcacaucuguaaacguucacucuucacuuagagacauccucaaccaaaucaccaaaccaaaugauguuuauucguucagccuugccaguagacuuuaugcugaagagagauacccaauccugccagaauacuugcagugugugaaggaacuguauagaggaggcuuggaaccuaucaacuuucaaacagcugcagaucaagccagagagcucaucaauuccuggguagaaagucagmcaaauggaauuaucagaaauguccuucagccaagcuccguggauucucaaacugcaakgguucugguuaaugccauugucuucaaaggacugugggagaaagcauuuaaggaugaagacacacaagcaaugccuuucagagugacugagcaagaaagcaaaccugugcagaugauguaccagauugguuuauuuagaguggcaucaauggcuucugagaaaaugaagauccuggagcuuccauuugccagugggacaaugagcauguuggugcuguugccugaugaagucucaggccuugagcagcuugagaguauaaucaacuuugaaaaacugacugaauggaccaguucuaauguuauggaagagaggaagaucaaaguguacuucccucgcaugaagauggaggaaaaauacaaccucacaucugucuuaauggcuaugggcauuacugacguguuuagcucuucagccaaucugucuggcaucuccucagcagagagccugaagauaucucaagcuguccaugcagcacaugcagaaaucaaugaagcaggcagagaggugguagggucagcagaggcuggaguggaugcugcaagcgucucugaagaauuuagggcugaccauccauuccucuucuguaucaagcacaucgcaaccaacgccguucucuucuuuggcagauguguuuccccuuaaaaagaagagcucuuaaucacuagugaauuc

SEQ ID NO: 2925 - RNA, 2182 nt, Artificial Sequence
  Trp2 mus musculus
gcagcauaauaagcaguauggcuggagcacucuguaaauuaacucaauuagacagagccugauuuaacaaggaagacuggcgagaagcuccccucauuaaaccugauguuagaggagcuucggaugaaauuaaaucaguguuaguuguuugagucacauaaaauugcaugagcguguacacaugugcacacguguaggcucugugauuuaggugggaauuuugagaggagaggaaagggcuagaacuaaacccaaagaaaaggaaagaagagaagaggaaaggaaagaaaaaagaaaaggcaauuugagugaguaaagguuccagaacucaggaguggaagacaaggaguaaagucagacagaaaccaggugggacgccggccaggccucccaauuaagaaggcaugggccuugugggaugggggcuucugcuggguugucugggcugcggaauucugcucagagcucgggcucaguuuccccgagucugcaugaccuuggauggcgugcugaacaaggaaugcugcccgccucugggucccgaggcaaccaacaucuguggauuucuagagggcagggggcagugcgcagaggugcaaacagacaccagacccuggaguggcccuuauauccuucgaaaccaggaugaccgugagcaauggccgagaaaauucuucaaccggacaugcaaaugcacaggaaacuuugcugguuauaauuguggaggcugcaaguucggcuggaccggccccgacuguaaucggaagaagccggccauccuaagacggaauauccauucccugacugcccaggagagggagcaguucuugggcgccuuagaccuggccaagaagaguauccauccagacuacgugaucaccacgcaacacuggcuggggcugcucggacccaacgggacccagccccagaucgccaacugcagcguguaugacuuuuuuguguggcuccauuauuauucuguucgagacacauuauuagguccaggacgccccuauaaggccauugauuucucucaccaagggccugccuuugucacguggcacagguaccaucuguuguggcuggaaagagaacuccagagacucacuggcaaugaguccuuugcguugcccuacuggaacuuugcaaccgggaagaacgagugugacgugugcacagacgacuggcuuggagcagcaagacaagaugacccaacgcugauuagucggaacucgagauucucuaccugggagauugugugcgacagcuuggaugacuacaaccgccgggucacacuguguaauggaaccuaugaagguuugcugagaagaaacaaaguaggcagaaauaaugagaaacugccaaccuuaaaaaaugugcaagauugccugucucuccagaaguuugacagcccucccuucuuccagaacucuaccuucagcuucaggaaugcacuggaaggguuugauaaagcagacggaacacuggacucucaagucaugaaccuucauaacuuggcucacuccuuccugaaugggaccaaugccuugccacacucagcagccaacgacccuguguuugugguccuccacucuuuuacagacgccaucuuugaugaguggcugaagagaaacaacccuuccacagaugccuggccucaggaacuggcacccauuggucacaaccgaauguauaacaugguccccuucuucccaccggugacuaaugaggagcucuuccuaaccgcagagcaacuuggcuacaauuacgccguugaucugucagaggaagaagcuccaguuugguccacaacucucucaguggucauuggaauccugggagcuuucgucuugcucuugggguugcuggcuuuucuucaauacagaaggcuucgcaaaggcuaugcgcccuuaauggagacaggucucagcagcaagagauacacggaggaagccuagcaugcuccuaccuggccugaccuggguaguaacuaauuacaccgucgcucaucuugagacagguggaacucuucagcgugugcucuuuaguagugaugaugaugaugccuuagcaaugacaauuaucucuaguugcugcuuugcuuauuguacacagacaaaaugcuugggucauucaccacggucaaaguaagguguggcuaguauaugugaccuuugauuag

SEQ ID NO: 2926 - protein, 13 aa, Artificial Sequence
  PADRE epitope
AKFVAAWTLKAAA

SEQ ID NO: 2927 - protein, 12 aa, Artificial Sequence
  OVA epitope (256-267)
LESIINFEKLTE

SEQ ID NO: 2928 - protein, 9 aa, Artificial Sequence
  Trp2 epitope  mus musculus
SVYDFFVWL

SEQ ID NO: 2929 - protein, 386 aa, Artificial Sequence
  Ovalbumin Ova
MGSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 2930 - protein, 517 aa, Artificial Sequence
  Trp2 mus musculus
MGLVGWGLLLGCLGCGILLRARAQFPRVCMTLDGVLNKECCPPLGPEATNICGFLEGRGQCAEVQTDTRPWSGPYILRNQDDREQWPRKFFNRTCKCTGNFAGYNCGGCKFGWTGPDCNRKKPAILRRNIHSLTAQEREQFLGALDLAKKSIHPDYVITTQHWLGLLGPNGTQPQIANCSVYDFFVWLHYYSVRDTLLGPGRPYKAIDFSHQGPAFVTWHRYHLLWLERELQRLTGNESFALPYWNFATGKNECDVCTDELLGAARQDDPTLISRNSRFSTWEIVCDSLDDYNRRVTLCNGTYEGLLRRNKVGRNNEKLPTLKNVQDCLSLQKFDSPPFFQNSTFSFRNALEGFDKADGTLDSQVMNLHNLAHSFLNGTNALPHSAANDPVFVVLHSFTDAIFDEWLKRNNPSTDAWPQELAPIGHNRMYNMVPFFPPVTNEELFLTAEQLGYNYAVDLSEEEAPVWSTTLSVVIGILGAFVLLLGLLAFLQYRRLRKGYAPLMETGLSSKRYTEEA

SEQ ID NO: 2931 - RNA, 499 nt, Artificial Sequence
  MmTRP2(180-188)(GC)_Linker(GGGGS)3(GC)_PADRE(GC)
ggggcgcugccuacggagguggcagccaucuccuucucggcaucaagcuuaccauguccguguacgacuucuucguguggcugggcgggggcgggagcggcgggggcggcuccgggggcgggggcagcgccaaguucguggccgccuggacccugaaggcggccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2932 - RNA, 117 nt, Artificial Sequence
  MmTRP2(180-188)(GC)_Linker(GGGGS)3(GC)_PADRE(GC)
auguccguguacgacuucuucguguggcugggcgggggcgggagcggcgggggcggcuccgggggcgggggcagcgccaaguucguggccgccuggacccugaaggcggccgccuga

SEQ ID NO: 2933 - RNA, 117 nt, Artificial Sequence
  MmTrp2(942-968)-(G4S)3-PADRE
augagcguguaugacuuuuuuguguggcucggaggugguggauccggcgguggcgguucugguggagguggaucugccaaauuuguugcugccuggacccugaaagcugcugcuuaa

SEQ ID NO: 2934 - protein, 38 aa, Artificial Sequence
  MmTrp2(180-188)-(G4S)3-PADRE
MSVYDFFVWLGGGGSGGGGSGGGGSAKFVAAWTLKAAA

SEQ ID NO: 2935 - RNA, 1543 nt, Artificial Sequence
  OVA RNActive
ggggcgcugccuacggagguggcagccaucuccuucucggcaucaagcuuaccaugggcagcaucggggccgcgucgauggaguucugcuucgacguguucaaggagcugaagguccaccacgccaacgagaacaucuucuacugcccgaucgccaucaugagcgcgcucgccaugguguaccugggcgccaaggacagcacccggacgcagaucaacaaggugguccgcuucgacaagcugcccggcuucggggacucgaucgaggcgcagugcggcaccagcgugaacgugcacagcucgcuccgggacauccugaaccagaucaccaagccgaacgacgucuacagcuucagccuggccucgcggcucuacgccgaggagcgcuacccgauccugcccgaguaccugcagugcgugaaggagcucuaccggggcgggcuggagccgaucaacuuccagacggcggccgaccaggcccgggagcugaucaacagcuggguggagagccagaccaacggcaucauccgcaacguccuccagccgucgagcguggacagccagaccgcgauggugcuggucaacgccaucguguucaagggccugugggagaagacguucaaggacgaggacacccaggccaugcccuuccgggugaccgagcaggagucgaagccgguccagaugauguaccagaucgggcucuuccggguggcgagcauggccagcgagaagaugaagauccuggagcugccguucgccucgggcacgaugagcaugcucgugcugcugcccgacgaggucagcggccucgagcagcuggagucgaucaucaacuucgagaagcugaccgaguggaccagcagcaacgugauggaggagcgcaagaucaagguguaccucccgcggaugaagauggaggagaaguacaaccugacgucgguccugauggcgauggggaucaccgacguguucagcagcucggccaaccucagcggcaucagcucggccgagagccugaagaucagccaggcggugcacgccgcccacgcggagaucaacgaggccggccgggaggucguggggucggccgaggcgggcguggacgccgccagcgucagcgaggaguuccgcgcggaccacccguuccuguucugcaucaagcacaucgccaccaacgccgugcucuucuucggccggugcgugucgcccugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2936 - RNA, 45 nt, Artificial Sequence
  (G4S)3  Linker
ggaggugguggauccggcgguggcgguucugguggagguggaucu

SEQ ID NO: 2937 - protein, 15 aa, Artificial Sequence
  (G4S)3  Linker
GGGGSGGGGSGGGGS

SEQ ID NO: 2938 - RNA, 20 nt, Artificial Sequence
  Immune stimulatory RNA
gguuuuuuuuuuuuuuuggg

SEQ ID NO: 2939 - RNA, 20 nt, Artificial Sequence
  Immune stimulatory RNA
ggggguuuuuuuuuuggggg

SEQ ID NO: 2940 - RNA, 40 nt, Artificial Sequence
  Immune stimulatory RNA
ggggguuuuuuuuuuuuuuuuuuuuuuuuuuuuuuggggg

SEQ ID NO: 2941 - RNA, 39 nt, Artificial Sequence
  Immune stimulatory RNA
guguguguguguuuuuuuuuuuuuuuugugugugugugu

SEQ ID NO: 2942 - RNA, 39 nt, Artificial Sequence
  Immune stimulatory RNA
gguugguugguuuuuuuuuuuuuuuuugguugguugguu

SEQ ID NO: 2943 - RNA, 20 nt, Artificial Sequence
  Immune stimulatory RNA
ggggggggguuugggggggg

SEQ ID NO: 2944 - RNA, 20 nt, Artificial Sequence
  Immune stimulatory RNA
gggggggguuuugggggggg

SEQ ID NO: 2945 - RNA, 20 nt, Artificial Sequence
  Immune stimulatory RNA
ggggggguuuuuuggggggg

SEQ ID NO: 2946 - RNA, 20 nt, Artificial Sequence
  Immune stimulatory RNA
ggggggguuuuuuugggggg

SEQ ID NO: 2947 - RNA, 20 nt, Artificial Sequence
  Immune stimulatory RNA
gggggguuuuuuuugggggg

SEQ ID NO: 2948 - RNA, 20 nt, Artificial Sequence
  Immune stimulatory RNA
gggggguuuuuuuuuggggg

SEQ ID NO: 2949 - RNA, 20 nt, Artificial Sequence
  Immune stimulatory RNA
gggggguuuuuuuuuugggg

SEQ ID NO: 2950 - RNA, 20 nt, Artificial Sequence
  Immune stimulatory RNA
ggggguuuuuuuuuuugggg

SEQ ID NO: 2951 - RNA, 20 nt, Artificial Sequence
  Immune stimulatory RNA
ggggguuuuuuuuuuuuggg

SEQ ID NO: 2952 - RNA, 20 nt, Artificial Sequence
  Immune stimulatory RNA
gggguuuuuuuuuuuuuggg

SEQ ID NO: 2953 - RNA, 20 nt, Artificial Sequence
  Immune stimulatory RNA
gggguuuuuuuuuuuuuugg

SEQ ID NO: 2954 - RNA, 20 nt, Artificial Sequence
  Immune stimulatory RNA
gguuuuuuuuuuuuuuuugg

SEQ ID NO: 2955 - RNA, 20 nt, Artificial Sequence
  Immune stimulatory RNA
guuuuuuuuuuuuuuuuuug

SEQ ID NO: 2956 - RNA, 22 nt, Artificial Sequence
  Immune stimulatory RNA
gggggggggguuuggggggggg

SEQ ID NO: 2957 - RNA, 22 nt, Artificial Sequence
  Immune stimulatory RNA
ggggggggguuuuggggggggg

SEQ ID NO: 2958 - RNA, 22 nt, Artificial Sequence
  Immune stimulatory RNA
gggggggguuuuuugggggggg

SEQ ID NO: 2959 - RNA, 22 nt, Artificial Sequence
  Immune stimulatory RNA
gggggggguuuuuuuggggggg

SEQ ID NO: 2960 - RNA, 22 nt, Artificial Sequence
  Immune stimulatory RNA
ggggggguuuuuuuuggggggg

SEQ ID NO: 2961 - RNA, 22 nt, Artificial Sequence
  Immune stimulatory RNA
ggggggguuuuuuuuugggggg

SEQ ID NO: 2962 - RNA, 22 nt, Artificial Sequence
  Immune stimulatory RNA
ggggggguuuuuuuuuuggggg

SEQ ID NO: 2963 - RNA, 22 nt, Artificial Sequence
  Immune stimulatory RNA
gggggguuuuuuuuuuuggggg

SEQ ID NO: 2964 - RNA, 22 nt, Artificial Sequence
  Immune stimulatory RNA
gggggguuuuuuuuuuuugggg

SEQ ID NO: 2965 - RNA, 22 nt, Artificial Sequence
  Immune stimulatory RNA
ggggguuuuuuuuuuuuugggg

SEQ ID NO: 2966 - RNA, 22 nt, Artificial Sequence
  Immune stimulatory RNA
ggggguuuuuuuuuuuuuuggg

SEQ ID NO: 2967 - RNA, 22 nt, Artificial Sequence
  Immune stimulatory RNA
ggguuuuuuuuuuuuuuuuggg

SEQ ID NO: 2968 - RNA, 22 nt, Artificial Sequence
  Immune stimulatory RNA
gguuuuuuuuuuuuuuuuuugg

SEQ ID NO: 2969 - RNA, 24 nt, Artificial Sequence
  Immune stimulatory RNA
ggggggggggguuugggggggggg

SEQ ID NO: 2970 - RNA, 24 nt, Artificial Sequence
  Immune stimulatory RNA
gggggggggguuuugggggggggg

SEQ ID NO: 2971 - RNA, 24 nt, Artificial Sequence
  Immune stimulatory RNA
ggggggggguuuuuuggggggggg

SEQ ID NO: 2972 - RNA, 24 nt, Artificial Sequence
  Immune stimulatory RNA
ggggggggguuuuuuugggggggg

SEQ ID NO: 2973 - RNA, 24 nt, Artificial Sequence
  Immune stimulatory RNA
gggggggguuuuuuuugggggggg

SEQ ID NO: 2974 - RNA, 24 nt, Artificial Sequence
  Immune stimulatory RNA
gggggggguuuuuuuuuggggggg

SEQ ID NO: 2975 - RNA, 24 nt, Artificial Sequence
  Immune stimulatory RNA
gggggggguuuuuuuuuugggggg

SEQ ID NO: 2976 - RNA, 24 nt, Artificial Sequence
  Immune stimulatory RNA
ggggggguuuuuuuuuuugggggg

SEQ ID NO: 2977 - RNA, 24 nt, Artificial Sequence
  Immune stimulatory RNA
ggggggguuuuuuuuuuuuggggg

SEQ ID NO: 2978 - RNA, 24 nt, Artificial Sequence
  Immune stimulatory RNA
gggggguuuuuuuuuuuuuggggg

SEQ ID NO: 2979 - RNA, 24 nt, Artificial Sequence
  Immune stimulatory RNA
gggggguuuuuuuuuuuuuugggg

SEQ ID NO: 2980 - RNA, 24 nt, Artificial Sequence
  Immune stimulatory RNA
gggguuuuuuuuuuuuuuuugggg

SEQ ID NO: 2981 - RNA, 24 nt, Artificial Sequence
  Immune stimulatory RNA
ggguuuuuuuuuuuuuuuuuuggg

SEQ ID NO: 2982 - RNA, 32 nt, Artificial Sequence
  Immune stimulatory RNA
guuuuuuuuuuuuuuuuuuuuuuuuuuuuuug

SEQ ID NO: 2983 - RNA, 34 nt, Artificial Sequence
  Immune stimulatory RNA
gguuuuuuuuuuuuuuuuuuuuuuuuuuuuuugg

SEQ ID NO: 2984 - RNA, 36 nt, Artificial Sequence
  Immune stimulatory RNA
ggguuuuuuuuuuuuuuuuuuuuuuuuuuuuuuggg

SEQ ID NO: 2985 - RNA, 37 nt, Artificial Sequence
  Immune stimulatory RNA
gggguuuuuuuuuuuuuuuuuuuuuuuuuuuuuuggg

SEQ ID NO: 2986 - RNA, 39 nt, Artificial Sequence
  Immune stimulatory RNA
ggggguuuuuuuuuuuuuuuuuuuuuuuuuuuuuugggg

SEQ ID NO: 2987 - RNA, 41 nt, Artificial Sequence
  Immune stimulatory RNA
gggggguuuuuuuuuuuuuuuuuuuuuuuuuuuuuuggggg

SEQ ID NO: 2988 - RNA, 43 nt, Artificial Sequence
  Immune stimulatory RNA
ggggggguuuuuuuuuuuuuuuuuuuuuuuuuuuuuugggggg

SEQ ID NO: 2989 - RNA, 45 nt, Artificial Sequence
  Immune stimulatory RNA
gggggggguuuuuuuuuuuuuuuuuuuuuuuuuuuuuuggggggg

SEQ ID NO: 2990 - RNA, 47 nt, Artificial Sequence
  Immune stimulatory RNA
ggggggggguuuuuuuuuuuuuuuuuuuuuuuuuuuuuugggggggg

SEQ ID NO: 2991 - RNA, 7 nt, Artificial Sequence
  Immune stimulatory RNA
gguuugg

SEQ ID NO: 2992 - RNA, 8 nt, Artificial Sequence
  Immune stimulatory RNA
gguuuugg

SEQ ID NO: 2993 - RNA, 9 nt, Artificial Sequence
  Immune stimulatory RNA
gguuuuugg

SEQ ID NO: 2994 - RNA, 10 nt, Artificial Sequence
  Immune stimulatory RNA
gguuuuuugg

SEQ ID NO: 2995 - RNA, 11 nt, Artificial Sequence
  Immune stimulatory RNA
gguuuuuuugg

SEQ ID NO: 2996 - RNA, 12 nt, Artificial Sequence
  Immune stimulatory RNA
gguuuuuuuugg

SEQ ID NO: 2997 - RNA, 13 nt, Artificial Sequence
  Immune stimulatory RNA
gguuuuuuuuugg

SEQ ID NO: 2998 - RNA, 14 nt, Artificial Sequence
  Immune stimulatory RNA
gguuuuuuuuuugg

SEQ ID NO: 2999 - RNA, 15 nt, Artificial Sequence
  Immune stimulatory RNA
gguuuuuuuuuuugg

SEQ ID NO: 3000 - RNA, 16 nt, Artificial Sequence
  Immune stimulatory RNA
gguuuuuuuuuuuugg

SEQ ID NO: 3001 - RNA, 17 nt, Artificial Sequence
  Immune stimulatory RNA
gguuuuuuuuuuuuugg

SEQ ID NO: 3002 - RNA, 18 nt, Artificial Sequence
  Immune stimulatory RNA
gguuuuuuuuuuuuuugg

SEQ ID NO: 3003 - RNA, 19 nt, Artificial Sequence
  Immune stimulatory RNA
gguuuuuuuuuuuuuuugg

SEQ ID NO: 3004 - RNA, 9 nt, Artificial Sequence
  Immune stimulatory RNA
ggguuuggg

SEQ ID NO: 3005 - RNA, 10 nt, Artificial Sequence
  Immune stimulatory RNA
ggguuuuggg

SEQ ID NO: 3006 - RNA, 11 nt, Artificial Sequence
  Immune stimulatory RNA
ggguuuuuggg

SEQ ID NO: 3007 - RNA, 12 nt, Artificial Sequence
  Immune stimulatory RNA
ggguuuuuuggg

SEQ ID NO: 3008 - RNA, 13 nt, Artificial Sequence
  Immune stimulatory RNA
ggguuuuuuuggg

SEQ ID NO: 3009 - RNA, 14 nt, Artificial Sequence
  Immune stimulatory RNA
ggguuuuuuuuggg

SEQ ID NO: 3010 - RNA, 15 nt, Artificial Sequence
  Immune stimulatory RNA
ggguuuuuuuuuggg

SEQ ID NO: 3011 - RNA, 16 nt, Artificial Sequence
  Immune stimulatory RNA
ggguuuuuuuuuuggg

SEQ ID NO: 3012 - RNA, 17 nt, Artificial Sequence
  Immune stimulatory RNA
ggguuuuuuuuuuuggg

SEQ ID NO: 3013 - RNA, 18 nt, Artificial Sequence
  Immune stimulatory RNA
ggguuuuuuuuuuuuggg

SEQ ID NO: 3014 - RNA, 19 nt, Artificial Sequence
  Immune stimulatory RNA
ggguuuuuuuuuuuuuggg

SEQ ID NO: 3015 - RNA, 57 nt, Artificial Sequence
  Immune stimulatory RNA
ggguuuuuuuuuuuuuuuggguuuuuuuuuuuuuuuggguuuuuuuuuuuuuuuggg

SEQ ID NO: 3016 - RNA, 42 nt, Artificial Sequence
  Immune stimulatory RNA
ggguuuuuuuuuuuuuuugggggguuuuuuuuuuuuuuuggg

SEQ ID NO: 3017 - RNA, 51 nt, Artificial Sequence
  Immune stimulatory RNA
ggguuuggguuuggguuuggguuuggguuuggguuuggguuuggguuuggg

SEQ ID NO: 3018 - RNA, 20 nt, Artificial Sequence
  Immune stimulatory RNA
gguuuuuuuuuuuuuuuggg

SEQ ID NO: 3019 - RNA, 57 nt, Artificial Sequence
  Immune stimulatory RNA
cccuuuuuuuuuuuuuuucccuuuuuuuuuuuuuuucccuuuuuuuuuuuuuuuccc

SEQ ID NO: 3020 - RNA, 51 nt, Artificial Sequence
  Immune stimulatory RNA
cccuuucccuuucccuuucccuuucccuuucccuuucccuuucccuuuccc

SEQ ID NO: 3021 - RNA, 42 nt, Artificial Sequence
  Immune stimulatory RNA
cccuuuuuuuuuuuuuuuccccccuuuuuuuuuuuuuuuccc

SEQ ID NO: 3022 - RNA, 60 nt, Artificial Sequence
  Immune stimulatory RNA
uagcgaagcucuuggaccuagguuuuuuuuuuuuuuugggugcguuccuagaaguacacg

SEQ ID NO: 3023 - RNA, 120 nt, Artificial Sequence
  Immune stimulatory RNA
uagcgaagcucuuggaccuagguuuuuuuuuuuuuuugggugcguuccuagaaguacacgaucgcuucgagaaccuggauccaaaaaaaaaaaaaaacccacgcaaggaucuucaugugc

SEQ ID NO: 3024 - RNA, 229 nt, Artificial Sequence
  Immune stimulatory RNA
gggagaaagcucaagcuuggagcaaugcccgcacauugaggaaaccgaguugcauaucucagaguauuggcccccguguagguuauucuugacagacaguggagcuuauucacucccaggauccgagucgcauacuacgguacuggugacagaccuaggucgucaguugaccaguccgccacuagacgugaguccgucaaagcaguuagauguuacacucuauuagauc

SEQ ID NO: 3025 - RNA, 547 nt, Artificial Sequence
  Immune stimulatory RNA
gggagaaagcucaagcuuggagcaaugcccgcacauugaggaaaccgaguugcauaucucagaguauuggcccccguguagguuauucuugacagacaguggagcuuauucacucccaggauccgagucgcauacuacgguacuggugacagaccuaggucgucaguugaccaguccgccacuagacgugaguccgucaaagcaguuagauguuacacucuauuagaucucggauuacagcuggaaggagcaggaguaguguucuugcucuaaguaccgagugugcccaauacccgaucagcuuauuaacgaacggcuccuccucuuagacugcagcguaagugcggaaucuggggaucaaauuacugacugccuggauuacccucggacauauaaccuuguagcacgcuguugcuguauaggugaccaacgcccacucgaguagaccagcucucuuaguccggacaaugauaggaggcgcggucaaucuacuucuggcuaguuaagaauaggcugcaccgaccucuauaaguagcguguccucuag

SEQ ID NO: 3026 - RNA, 1083 nt, Artificial Sequence
  Immune stimulatory RNA
gggagaaagcucaagcuuggagcaaugcccgcacauugaggaaaccgaguugcauaucucagaguauuggcccccguguagguuauucuugacagacaguggagcuuauucacucccaggauccgagucgcauacuacgguacuggugacagaccuaggucgucaguugaccaguccgccacuagacgugaguccgucaaagcaguuagauguuacacucuauuagaucucggauuacagcuggaaggagcaggaguaguguucuugcucuaaguaccgagugugcccaauacccgaucagcuuauuaacgaacggcuccuccucuuagacugcagcguaagugcggaaucuggggaucaaauuacugacugccuggauuacccucggacauauaaccuuguagcacgcuguugcuguauaggugaccaacgcccacucgaguagaccagcucucuuaguccggacaaugauaggaggcgcggucaaucuacuucuggcuaguuaagaauaggcugcaccgaccucuauaaguagcguguccucuagagcuacgcagguucgcaauaaaagcguugauuagugugcauagaacagaccucuuauucggugaaacgccagaaugcuaaauuccaauaacucuucccaaaacgcguacggccgaagacgcgcgcuuaucuuguguacguucucgcacauggaagaaucagcgggcauggugguagggcaauaggggagcuggguagcagcgaaaaagggccccugcgcacguagcuucgcuguucgucugaaacaacccggcauccguuguagcgaucccguuaucaguguuauucuugugcgcacuaagauucaugguguagucgacaauaacagcgucuuggcagauucuggucacgugcccuaugcccgggcuugugccucucaggugcacagcgauacuuaaagccuucaagguacucgacguggguaccgauucgugacacuuccuaagauuauuccacuguguuagccccgcaccgccgaccuaaacugguccaauguauacgcauucgcugagcggaucgauaauaaaagcuugaauu

SEQ ID NO: 3027 - RNA, 229 nt, Artificial Sequence
  Immune stimulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagauc

SEQ ID NO: 3028 - RNA, 546 nt, Artificial Sequence
  Immune stimulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucua

SEQ ID NO: 3029 - RNA, 547 nt, Artificial Sequence
  Immune stimulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucuag

SEQ ID NO: 3030 - RNA, 1083 nt, Artificial Sequence
  Immune stimulatory RNA
gggagaaagcucaagcuuauccaaguaggcuggucaccuguacaacguagccgguauuuuuuuuuuuuuuuuuuuuuugaccgucucaagguccaaguuagucugccuauaaaggugcggauccacagcugaugaaagacuugugcgguacgguuaaucuccccuuuuuuuuuuuuuuuuuuuuuaguaaaugcgucuacugaauccagcgaugaugcuggcccagaucuucgaccacaagugcauauaguagucaucgagggucgccuuuuuuuuuuuuuuuuuuuuuuuggcccaguucugagacuucgcuagagacuacaguuacagcugcaguaguaaccacugcggcuauugcaggaaaucccguucagguuuuuuuuuuuuuuuuuuuuuccgcucacuaugauuaagaaccagguggagugucacugcucucgaggucucacgagagcgcucgauacaguccuuggaagaaucuuuuuuuuuuuuuuuuuuuuuugugcgacgaucacagagaacuucuauucaugcaggucugcucuagaacgaacugaccugacgccugaacuuaugagcgugcguauuuuuuuuuuuuuuuuuuuuuuuccucccaacaaaugucgaucaauagcugggcuguuggagacgcgucagcaaaugccguggcuccauaggacguguagacuucuauuuuuuuuuuuuuuuuuuuuucccgggaccacaaauaauauucuugcuugguugggcgcaagggccccguaucaggucauaaacggguacauguugcacaggcuccuuuuuuuuuuuuuuuuuuuuuuucgcugaguuauuccggucucaaaagacggcagacgucagucgacaacacggucuaaagcagugcuacaaucugccguguucguguuuuuuuuuuuuuuuuuuuugugaaccuacacggcgugcacuguaguucgcaauucauaggguaccggcucagaguuaugccuugguugaaaacugcccagcauacuuuuuuuuuuuuuuuuuuuucauauucccaugcuaagcaagggaugccgcgagucauguuaagcuugaauu

SEQ ID NO: 3031 - RNA, 59 nt, Artificial Sequence
  Immune stimulatory RNA
uagcgaagcucuuggaccuaccuuuuuuuuuuuuuucccugcguuccuagaaguacacg

SEQ ID NO: 3032 - RNA, 120 nt, Artificial Sequence
  Immune stimulatory RNA
uagcgaagcucuuggaccuaccuuuuuuuuuuuuuuucccugcguuccuagaaguacacgaucgcuucgagaaccuggauggaaaaaaaaaaaaaaagggacgcaaggaucuucaugugc

SEQ ID NO: 3033 - RNA, 9 nt, Artificial Sequence
  Cys(Arg7)Cys
crrrrrrrc

SEQ ID NO: 3034 - RNA, 10 nt, Artificial Sequence
  Cys(Arg8)Cys
crrrrrrrrc

SEQ ID NO: 3035 - RNA, 11 nt, Artificial Sequence
  Cys(Arg9)Cys
crrrrrrrrrc

SEQ ID NO: 3036 - RNA, 12 nt, Artificial Sequence
  Cys(Arg10)Cys
crrrrrrrrrrc

SEQ ID NO: 3037 - RNA, 13 nt, Artificial Sequence
  Cys(Arg11)Cys
crrrrrrrrrrrc

SEQ ID NO: 3038 - RNA, 15 nt, Artificial Sequence
  Cys(Arg13)Cys
crrrrrrrrrrrrrc

SEQ ID NO: 3039 - RNA, 16 nt, Artificial Sequence
  Cys(Arg14)Cys
crrrrrrrrrrrrrrc

SEQ ID NO: 3040 - RNA, 17 nt, Artificial Sequence
  Cys(Arg15)Cys
crrrrrrrrrrrrrrrc

SEQ ID NO: 3041 - RNA, 18 nt, Artificial Sequence
  Cys(Arg16)Cys
crrrrrrrrrrrrrrrrc

SEQ ID NO: 3042 - RNA, 19 nt, Artificial Sequence
  Cys(Arg17)Cys
crrrrrrrrrrrrrrrrrc

SEQ ID NO: 3043 - RNA, 20 nt, Artificial Sequence
  Cys(Arg18)Cys
crrrrrrrrrrrrrrrrrrc

SEQ ID NO: 3044 - RNA, 21 nt, Artificial Sequence
  Cys(Arg19)Cys
crrrrrrrrrrrrrrrrrrrc

SEQ ID NO: 3045 - RNA, 22 nt, Artificial Sequence
  Cys(Arg20)Cys
crrrrrrrrrrrrrrrrrrrrc

SEQ ID NO: 3046 - RNA, 14 nt, Artificial Sequence
  Cys(Arg12)Cys
crrrrrrrrrrrrc

SEQ ID NO: 3047 - RNA, 13 nt, Artificial Sequence
  Cys(Arg12)
crrrrrrrrrrrr

SEQ ID NO: 3048 - RNA, 8 nt, Artificial Sequence
  Cys(Arg7)
crrrrrrr

SEQ ID NO: 3049 - RNA, 9 nt, Artificial Sequence
  Cys(Arg8)
crrrrrrrr

SEQ ID NO: 3050 - RNA, 10 nt, Artificial Sequence
  Cys(Arg9)
crrrrrrrrr

SEQ ID NO: 3051 - RNA, 11 nt, Artificial Sequence
  Cys(Arg10)
crrrrrrrrrr

SEQ ID NO: 3052 - RNA, 12 nt, Artificial Sequence
  Cys(Arg11)
crrrrrrrrrrr

SEQ ID NO: 3053 - RNA, 14 nt, Artificial Sequence
  Cys(Arg13)
crrrrrrrrrrrrr

SEQ ID NO: 3054 - RNA, 15 nt, Artificial Sequence
  Cys(Arg14)
crrrrrrrrrrrrrr

SEQ ID NO: 3055 - RNA, 16 nt, Artificial Sequence
  Cys(Arg15)
crrrrrrrrrrrrrrr

SEQ ID NO: 3056 - RNA, 17 nt, Artificial Sequence
  Cys(Arg16)
crrrrrrrrrrrrrrrr

SEQ ID NO: 3057 - RNA, 18 nt, Artificial Sequence
  Cys(Arg17)
crrrrrrrrrrrrrrrrr

SEQ ID NO: 3058 - RNA, 19 nt, Artificial Sequence
  Cys(Arg18)
crrrrrrrrrrrrrrrrrr

SEQ ID NO: 3059 - RNA, 20 nt, Artificial Sequence
  Cys(Arg19)
crrrrrrrrrrrrrrrrrrr

SEQ ID NO: 3060 - RNA, 21 nt, Artificial Sequence
  Cys(Arg20)
crrrrrrrrrrrrrrrrrrrr

SEQ ID NO: 3061 - DNA, 42 bp, Artificial Sequence
  RPL32 (32L4) 5-UTR
ggcgctgcctacggaggtggcagccatctccttctcggcatc

SEQ ID NO: 3062 - RNA, 42 nt, Artificial Sequence
  RPL32 (32L4) 5-UTR
ggcgcugccuacggagguggcagccaucuccuucucggcauc

SEQ ID NO: 3063 - DNA, 75 bp, Artificial Sequence
  ATP5A1 5-UTR
gcggctcggccattttgtcccagtcagtccggaggctgcggctgcagaagtaccgcctgcggagtaactgcaaag

SEQ ID NO: 3064 - RNA, 75 nt, Artificial Sequence
  ATP5A1 5-UTR
gcggcucggccauuuugucccagucaguccggaggcugcggcugcagaaguaccgccugcggaguaacugcaaag

SEQ ID NO: 3065 - DNA, 110 bp, Artificial Sequence
  HBA1 3-UTR
gctggagcctcggtggccatgcttcttgccccttgggcctccccccagcccctcctccccttcctgcacccgtacccccgtggtctttgaataaagtctgagtgggcggc

SEQ ID NO: 3066 - RNA, 110 nt, Artificial Sequence
  HBA1 3-UTR
gcuggagccucgguggccaugcuucuugccccuugggccuccccccagccccuccuccccuuccugcacccguacccccguggucuuugaauaaagucugagugggcggc

SEQ ID NO: 3067 - DNA, 108 bp, Artificial Sequence
  HBA2 3-UTR
gctggagcctcggtagccgttcctcctgcccgctgggcctcccaacgggccctcctcccctccttgcaccggcccttcctggtctttgaataaagtctgagtgggcag

SEQ ID NO: 3068 - RNA, 108 nt, Artificial Sequence
  HBA2 3-UTR
gcuggagccucgguagccguuccuccugcccgcugggccucccaacgggcccuccuccccuccuugcaccggcccuuccuggucuuugaauaaagucugagugggcag

SEQ ID NO: 3069 - DNA, 132 bp, Artificial Sequence
  HBB 3-UTR
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 3070 - RNA, 132 nt, Artificial Sequence
  HBB 3-UTR
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 3071 - DNA, 44 bp, Artificial Sequence
  muag 3-UTR
gcccgatgggcctcccaacgggccctcctcccctccttgcaccg

SEQ ID NO: 3072 - RNA, 44 nt, Artificial Sequence
  muag 3-UTR
gcccgaugggccucccaacgggcccuccuccccuccuugcaccg

SEQ ID NO: 3073 - DNA, 186 bp, Artificial Sequence
  human albumin 3-UTR
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 3074 - RNA, 186 nt, Artificial Sequence
  human albumin 3-UTR
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 3075 - DNA, 186 bp, Artificial Sequence
  albumin7 3-UTR
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 3076 - RNA, 186 nt, Artificial Sequence
  albumin7 3-UTR
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 3077 - DNA, 187 bp, Artificial Sequence
  ALB7 3-UTR
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 3078 - RNA, 187 nt, Artificial Sequence
  ALB7 3-UTR
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 3079 - DNA, 24 bp, Artificial Sequence
  hSL
caaaggctcttttcagagccacca

SEQ ID NO: 3080 - RNA, 24 nt, Artificial Sequence
  hSL
caaaggcucuuuucagagccacca

SEQ ID NO: 3081 - DNA, 13 bp, Artificial Sequence
  Kozak sequence
gccgccaccatgg

SEQ ID NO: 3082 - RNA, 13 nt, Artificial Sequence
  Kozak sequence
gccgccaccaugg

SEQ ID NO: 3083 - protein, 13 aa, Artificial Sequence
  PADRE
AKFVAAWTLKAAA

SEQ ID NO: 3084 - protein, 18 aa, Artificial Sequence
  Hepatitis C virus_Core
MSTNPKPQIKTKRNTNRR

SEQ ID NO: 3085 - protein, 20 aa, Artificial Sequence
  Hepatitis C virus_Core
MSTNPKPQRKTKRNTNRRQD

SEQ ID NO: 3086 - protein, 20 aa, Artificial Sequence
  Hepatitis C virus_Core
DVKFPGGGQIVGGVYLLPRR

SEQ ID NO: 3087 - protein, 15 aa, Artificial Sequence
  Hepatitis C virus_Core
VGGVYLLPRRGPRLG

SEQ ID NO: 3088 - protein, 20 aa, Artificial Sequence
  Hepatitis C virus_Core
VGGVYLLPRRGPRLGVRATR

SEQ ID NO: 3089 - protein, 15 aa, Artificial Sequence
  Hepatitis C virus_Core
RRRSRNLGKVIDTLT

SEQ ID NO: 3090 - protein, 15 aa, Artificial Sequence
  Hepatitis C virus_Core
TLTCGFADLMGYIPL

SEQ ID NO: 3091 - protein, 15 aa, Artificial Sequence
  Hepatitis C virus_Core
GAPLGGAARALAHGV

SEQ ID NO: 3092 - protein, 20 aa, Artificial Sequence
  Hepatitis C virus_Core
GAPLGGAARALAHGVRVLED

SEQ ID NO: 3093 - protein, 15 aa, Artificial Sequence
  Hepatitis C virus_Core
APLGGAARALAHGVR

SEQ ID NO: 3094 - protein, 15 aa, Artificial Sequence
  Hepatitis C virus_Core
SFSIFLLALLSCLTI

SEQ ID NO: 3095 - protein, 11 aa, Artificial Sequence
  Hepatitis C virus_Core
LLSCLTIPASA

SEQ ID NO: 3096 - protein, 15 aa, Artificial Sequence
  Hepatitis C virus_E1
HVTNDCPNSSIVYEA

SEQ ID NO: 3097 - protein, 15 aa, Artificial Sequence
  Hepatitis C virus_E1
CPNSSIVYEAHDAIL

SEQ ID NO: 3098 - protein, 15 aa, Artificial Sequence
  Hepatitis C virus_E1
SRCWVALTPTLAARN

SEQ ID NO: 3099 - protein, 15 aa, Artificial Sequence
  Hepatitis C virus_E1
RCWVAMTPTVATRDG

SEQ ID NO: 3100 - protein, 15 aa, Artificial Sequence
  Hepatitis C virus_E1
MTPTVATRDGKLPAT

SEQ ID NO: 3101 - protein, 15 aa, Artificial Sequence
  Hepatitis C virus_E1
KLPATQLRRHIDLLV

SEQ ID NO: 3102 - protein, 15 aa, Artificial Sequence
  Hepatitis C virus_E1
TIRRHVDLLVGAAAF

SEQ ID NO: 3103 - protein, 15 aa, Artificial Sequence
  Hepatitis C virus_E1
GSATLCSALYVGDLC

SEQ ID NO: 3104 - protein, 15 aa, Artificial Sequence
  Hepatitis C virus_E1
GSVFLIGQLFTFSPR

SEQ ID NO: 3105 - protein, 15 aa, Artificial Sequence
  Hepatitis C virus_E1
TFSPRRHQTVQDCNC

SEQ ID NO: 3106 - protein, 15 aa, Artificial Sequence
  Hepatitis C virus_E1
SIYPGHITGHRMAWD

SEQ ID NO: 3107 - protein, 15 aa, Artificial Sequence
  Hepatitis C virus_E1
HITGHRMAWDMMMNW

SEQ ID NO: 3108 - protein, 15 aa, Artificial Sequence
  Hepatitis C virus_E1
HVSGHRMAWDMMMNW

SEQ ID NO: 3109 - protein, 15 aa, Artificial Sequence
  Hepatitis C virus_E1
MMMNWSPTAALVMAQ

SEQ ID NO: 3110 - protein, 15 aa, Artificial Sequence
  Hepatitis C virus_E1
SPTAALVVSQLLRIP

SEQ ID NO: 3111 - protein, 15 aa, Artificial Sequence
  Hepatitis C virus_E1
QAILDMIAGAHWGVL

SEQ ID NO: 3112 - protein, 15 aa, Artificial Sequence
  Hepatitis C virus_E1
HWGVLAGLAYYSMVG

SEQ ID NO: 3113 - protein, 15 aa, Artificial Sequence
  Hepatitis C virus_E1
FSMVGNWAKVLVVLL

SEQ ID NO: 3114 - protein, 15 aa, Artificial Sequence
  Hepatitis C virus_E1
NWAKVLVVLLLFAGV

SEQ ID NO: 3115 - protein, 18 aa, Artificial Sequence
  Hepatitis C virus_E2
GFATQRLTSLFALGPSQK

SEQ ID NO: 3116 - protein, 16 aa, Artificial Sequence
  Hepatitis C virus_E2
CLWMMLLIAQAEQALL

SEQ ID NO: 3117 - protein, 15 aa, Artificial Sequence
  Hepatitis C virus_NS2
AMDREMAASCGGAVF

SEQ ID NO: 3118 - protein, 15 aa, Artificial Sequence
  Hepatitis C virus_NS2
RDAIILLTCAVHPEL

SEQ ID NO: 3119 - protein, 15 aa, Artificial Sequence
  Hepatitis C virus_NS2
GPLMVLQAGIIRAPY

SEQ ID NO: 3120 - protein, 20 aa, Artificial Sequence
  Hepatitis C virus_NS2
PVSARRGREILLGPADGMVS

SEQ ID NO: 3121 - protein, 15 aa, Artificial Sequence
  Hepatitis C virus_NS3
GQGWRLLAPITAYSQ

SEQ ID NO: 3122 - protein, 15 aa, Artificial Sequence
  Hepatitis C virus_NS3
GPVIQMYTNVDQDLV

SEQ ID NO: 3123 - protein, 15 aa, Artificial Sequence
  Hepatitis C virus_NS3
QGSRSLTPCTCGSSD

SEQ ID NO: 3124 - protein, 15 aa, Artificial Sequence
  Hepatitis C virus_NS3
SSDLYLVTRHADVIP

SEQ ID NO: 3125 - protein, 20 aa, Artificial Sequence
  Hepatitis C virus_NS3
YLVTRHADVIPVRRRGDSRG

SEQ ID NO: 3126 - protein, 15 aa, Artificial Sequence
  Hepatitis C virus_NS3
SLLSPRPISYLKGSS

SEQ ID NO: 3127 - protein, 15 aa, Artificial Sequence
  Hepatitis C virus_NS3
CPAGHAVGIFRAAVC

SEQ ID NO: 3128 - protein, 20 aa, Artificial Sequence
  Hepatitis C virus_NS3
LETTMRSPVFTDNSSPPVVP

SEQ ID NO: 3129 - protein, 14 aa, Artificial Sequence
  Hepatitis C virus_NS3
SPVFTDNSSPAVPQ

SEQ ID NO: 3130 - protein, 15 aa, Artificial Sequence
  Hepatitis C virus_NS3
VPQSFQVAHLHAPTG

SEQ ID NO: 3131 - protein, 15 aa, Artificial Sequence
  Hepatitis C virus_NS3
FQVAHLHAPTGSGKS

SEQ ID NO: 3132 - protein, 15 aa, Artificial Sequence
  Hepatitis C virus_NS3
KVPAAYAAQGYKVLV

SEQ ID NO: 3133 - protein, 20 aa, Artificial Sequence
  Hepatitis C virus_NS3
PAAYAAQGYKVLVLNPSVAA

SEQ ID NO: 3134 - protein, 14 aa, Artificial Sequence
  Hepatitis C virus_NS3
AAKGYKVLVLPSVA

SEQ ID NO: 3135 - protein, 15 aa, Artificial Sequence
  Hepatitis C virus_NS3
AQGYKVLVLNPSVAA

SEQ ID NO: 3136 - protein, 15 aa, Artificial Sequence
  Hepatitis C virus_NS3
QGYKVLVLNPSVAAT

SEQ ID NO: 3137 - protein, 14 aa, Artificial Sequence
  Hepatitis C virus_NS3
GYKVLVLNPSVAAT

SEQ ID NO: 3138 - protein, 18 aa, Artificial Sequence
  Hepatitis C virus_NS3
GYKVLVLNPSVAATLGFG

SEQ ID NO: 3139 - protein, 20 aa, Artificial Sequence
  Hepatitis C virus_NS3
GYKVLVLNPSVAATLGFGAY

SEQ ID NO: 3140 - protein, 9 aa, Artificial Sequence
  Hepatitis C virus_NS3
VLVLNPSVA

SEQ ID NO: 3141 - protein, 20 aa, Artificial Sequence
  Hepatitis C virus_NS3
ITYSTYGKFLADGGCSGGAY

SEQ ID NO: 3142 - protein, 18 aa, Artificial Sequence
  Hepatitis C virus_NS3
YSTYGKFLADAGCSGGAY

SEQ ID NO: 3143 - protein, 15 aa, Artificial Sequence
  Hepatitis C virus_NS3
TYGKFLADGGCSGGA

SEQ ID NO: 3144 - protein, 18 aa, Artificial Sequence
  Hepatitis C virus_NS3
LADAGCSGGAYDIIICDE

SEQ ID NO: 3145 - protein, 15 aa, Artificial Sequence
  Hepatitis C virus_NS3
GGAYDIIICDECHST

SEQ ID NO: 3146 - protein, 15 aa, Artificial Sequence
  Hepatitis C virus_NS3
DIIICDECHSTDATS

SEQ ID NO: 3147 - protein, 20 aa, Artificial Sequence
  Hepatitis C virus_NS3
TDATSILGIGTVLDQAETAG

SEQ ID NO: 3148 - protein, 15 aa, Artificial Sequence
  Hepatitis C virus_NS3
ATSILGIGTVLDQAE

SEQ ID NO: 3149 - protein, 18 aa, Artificial Sequence
  Hepatitis C virus_NS3
VIKGGRHLIFCHSKKKCD

SEQ ID NO: 3150 - protein, 18 aa, Artificial Sequence
  Hepatitis C virus_NS3
VIKGGRHLIFCHSHHHCD

SEQ ID NO: 3151 - protein, 15 aa, Artificial Sequence
  Hepatitis C virus_NS3
GGRHLIFCHSKKKCD

SEQ ID NO: 3152 - protein, 10 aa, Artificial Sequence
  Hepatitis C virus_NS3
GRHLIFCHSK

SEQ ID NO: 3153 - protein, 11 aa, Artificial Sequence
  Hepatitis C virus_NS3
GRHLIFCHSKR

SEQ ID NO: 3154 - protein, 15 aa, Artificial Sequence
  Hepatitis C virus_NS3
KCDELAAKLVALGIN

SEQ ID NO: 3155 - protein, 15 aa, Artificial Sequence
  Hepatitis C virus_NS3
LAAKLVALGINAVAY

SEQ ID NO: 3156 - protein, 15 aa, Artificial Sequence
  Hepatitis C virus_NS3
GINAVAYYRGLDVSV

SEQ ID NO: 3157 - protein, 20 aa, Artificial Sequence
  Hepatitis C virus_NS3
GINAVAYYRGLDVSVIPTSG

SEQ ID NO: 3158 - protein, 11 aa, Artificial Sequence
  Hepatitis C virus_NS3
VAYYRGLDVSV

SEQ ID NO: 3159 - protein, 15 aa, Artificial Sequence
  Hepatitis C virus_NS3
VAYYRGLDVSVIPTS

SEQ ID NO: 3160 - protein, 18 aa, Artificial Sequence
  Hepatitis C virus_NS3
IPTNGDVVVVSTDALMTG

SEQ ID NO: 3161 - protein, 15 aa, Artificial Sequence
  Hepatitis C virus_NS3
ALMTGYTGDFDSVID

SEQ ID NO: 3162 - protein, 18 aa, Artificial Sequence
  Hepatitis C virus_NS3
DFDSVIDCNTCVTQTVDF

SEQ ID NO: 3163 - protein, 15 aa, Artificial Sequence
  Hepatitis C virus_NS3
VIDCNTCVTQTVDFS

SEQ ID NO: 3164 - protein, 15 aa, Artificial Sequence
  Hepatitis C virus_NS3
NTCVTQTVDFSLDPT

SEQ ID NO: 3165 - protein, 15 aa, Artificial Sequence
  Hepatitis C virus_NS3
TQTVDFSLDPTFTIE

SEQ ID NO: 3166 - protein, 15 aa, Artificial Sequence
  Hepatitis C virus_NS3
EQYVDFSLDPTFSIE

SEQ ID NO: 3167 - protein, 18 aa, Artificial Sequence
  Hepatitis C virus_NS3
PTFTIETTTLPQDAVSRT

SEQ ID NO: 3168 - protein, 15 aa, Artificial Sequence
  Hepatitis C virus_NS3
MFDSSVLCECYDAGC

SEQ ID NO: 3169 - protein, 20 aa, Artificial Sequence
  Hepatitis C virus_NS3
YDAGCAWYELTPAETTVRLR

SEQ ID NO: 3170 - protein, 17 aa, Artificial Sequence
  Hepatitis C virus_NS3
MPAETTVRLRAYMNTPG

SEQ ID NO: 3171 - protein, 20 aa, Artificial Sequence
  Hepatitis C virus_NS3
TPAETTVRLRAYMNTPGLPV

SEQ ID NO: 3172 - protein, 15 aa, Artificial Sequence
  Hepatitis C virus_NS3
TTVRLRAYMNTPGLP

SEQ ID NO: 3173 - protein, 12 aa, Artificial Sequence
  Hepatitis C virus_NS3
LRAYMNTPGLPV

SEQ ID NO: 3174 - protein, 15 aa, Artificial Sequence
  Hepatitis C virus_NS3
LRAYMNTPGLPVCQD

SEQ ID NO: 3175 - protein, 11 aa, Artificial Sequence
  Hepatitis C virus_NS3
RAYMNTPGLPV

SEQ ID NO: 3176 - protein, 10 aa, Artificial Sequence
  Hepatitis C virus_NS3
AYMNTPGLPV

SEQ ID NO: 3177 - protein, 15 aa, Artificial Sequence
  Hepatitis C virus_NS3
ESVFTGLTHIDAHFL

SEQ ID NO: 3178 - protein, 15 aa, Artificial Sequence
  Hepatitis C virus_NS3
TGLTHIDAHFLSQTK

SEQ ID NO: 3179 - protein, 20 aa, Artificial Sequence
  Hepatitis C virus_NS3
ENLPYLVAYQATVCARAQAP

SEQ ID NO: 3180 - protein, 15 aa, Artificial Sequence
  Hepatitis C virus_NS3
LPYLVAYQATVCARA

SEQ ID NO: 3181 - protein, 14 aa, Artificial Sequence
  Hepatitis C virus_NS3
NLPYLVAYQATVCA

SEQ ID NO: 3182 - protein, 10 aa, Artificial Sequence
  Hepatitis C virus_NS3
YLVAYQATVC

SEQ ID NO: 3183 - protein, 11 aa, Artificial Sequence
  Hepatitis C virus_NS3
YLVAYQATVCA

SEQ ID NO: 3184 - protein, 15 aa, Artificial Sequence
  Hepatitis C virus_NS3
VAYQATVCARAQAPP

SEQ ID NO: 3185 - protein, 15 aa, Artificial Sequence
  Hepatitis C virus_NS3
TAYQATVCARAQAPP

SEQ ID NO: 3186 - protein, 15 aa, Artificial Sequence
  Hepatitis C virus_NS3
AQAPPPSWDQMWKCL

SEQ ID NO: 3187 - protein, 16 aa, Artificial Sequence
  Hepatitis C virus_NS3
DQMWLKCLIRLKPTLH

SEQ ID NO: 3188 - protein, 20 aa, Artificial Sequence
  Hepatitis C virus_NS3
PTPLLYRLGAVQNEITLTHP

SEQ ID NO: 3189 - protein, 15 aa, Artificial Sequence
  Hepatitis C virus_NS3
PVTKYIMACSADLES

SEQ ID NO: 3190 - protein, 18 aa, Artificial Sequence
  Hepatitis C virus_NS3
PITKYIMTCMSADLEVVT

SEQ ID NO: 3191 - protein, 15 aa, Artificial Sequence
  Hepatitis C virus_NS3
TSTWVLVGGVLAALA

SEQ ID NO: 3192 - protein, 20 aa, Artificial Sequence
  Hepatitis C virus_NS4
NFISGIQYLAGLSTLPGNPA

SEQ ID NO: 3193 - protein, 13 aa, Artificial Sequence
  Hepatitis C virus_NS4a
TSTWVLVGGVLAA

SEQ ID NO: 3194 - protein, 15 aa, Artificial Sequence
  Hepatitis C virus_NS4a
STWVLVGGVLAALAA

SEQ ID NO: 3195 - protein, 10 aa, Artificial Sequence
  Hepatitis C virus_NS4a
TWVLVGGVLA

SEQ ID NO: 3196 - protein, 20 aa, Artificial Sequence
  Hepatitis C virus_NS4a
AAYCLSTGCVVIVGRVVLSG

SEQ ID NO: 3197 - protein, 20 aa, Artificial Sequence
  Hepatitis C virus_NS4a
VVLSGKPAIIPDREVLYREF

SEQ ID NO: 3198 - protein, 15 aa, Artificial Sequence
  Hepatitis C virus_NS4a
GKPAIIPDREVLYRE

SEQ ID NO: 3199 - protein, 10 aa, Artificial Sequence
  Hepatitis C virus_NS4a
IIPDREVLYR

SEQ ID NO: 3200 - protein, 20 aa, Artificial Sequence
  Hepatitis C virus_NS4b
IAPAVQTNWQKLETFWAKHM

SEQ ID NO: 3201 - protein, 20 aa, Artificial Sequence
  Hepatitis C virus_NS4b
GIQYLAGLSTLPGNPAIASL

SEQ ID NO: 3202 - protein, 11 aa, Artificial Sequence
  Hepatitis C virus_NS4b
QYLAGLSTLPG

SEQ ID NO: 3203 - protein, 10 aa, Artificial Sequence
  Hepatitis C virus_NS4b
YLAGLSTLPG

SEQ ID NO: 3204 - protein, 20 aa, Artificial Sequence
  Hepatitis C virus_NS4b
LAGLSTLPGNPAIASLMAFT

SEQ ID NO: 3205 - protein, 18 aa, Artificial Sequence
  Hepatitis C virus_NS4b
GLSTLPGNPAIASLMAFT

SEQ ID NO: 3206 - protein, 20 aa, Artificial Sequence
  Hepatitis C virus_NS4b
LPGNPAIASLMAFTAAVTSP

SEQ ID NO: 3207 - protein, 11 aa, Artificial Sequence
  Hepatitis C virus_NS4b
PAIASLMAFTA

SEQ ID NO: 3208 - protein, 10 aa, Artificial Sequence
  Hepatitis C virus_NS4b
IASLMAFTAA

SEQ ID NO: 3209 - protein, 20 aa, Artificial Sequence
  Hepatitis C virus_NS4b
LTTSQTLLFNILGGWVAAQL

SEQ ID NO: 3210 - protein, 15 aa, Artificial Sequence
  Hepatitis C virus_NS4b
TQHTLLFNILGGWVA

SEQ ID NO: 3211 - protein, 10 aa, Artificial Sequence
  Hepatitis C virus_NS4b
LFNILGGWVA

SEQ ID NO: 3212 - protein, 9 aa, Artificial Sequence
  Hepatitis C virus_NS4b
FNILGGWVA

SEQ ID NO: 3213 - protein, 12 aa, Artificial Sequence
  Hepatitis C virus_NS4b
FNILGGWVAAQL

SEQ ID NO: 3214 - protein, 15 aa, Artificial Sequence
  Hepatitis C virus_NS4b
LGKVLVDILAGYGAG

SEQ ID NO: 3215 - protein, 18 aa, Artificial Sequence
  Hepatitis C virus_NS4b
IMSGEVPSTEDLVNLLPA

SEQ ID NO: 3216 - protein, 20 aa, Artificial Sequence
  Hepatitis C virus_NS4b
GEVPSTEDLVNLLPAILSPG

SEQ ID NO: 3217 - protein, 10 aa, Artificial Sequence
  Hepatitis C virus_NS4b
LVNLLPAILS

SEQ ID NO: 3218 - protein, 7 aa, Artificial Sequence
  Hepatitis C virus_NS4b
NLLPAIL

SEQ ID NO: 3219 - protein, 20 aa, Artificial Sequence
  Hepatitis C virus_NS4b
ALVVGVVCAAILRRHVGPGE

SEQ ID NO: 3220 - protein, 20 aa, Artificial Sequence
  Hepatitis C virus_NS4b
GPGEGAVQWMNRLIAFASRG

SEQ ID NO: 3221 - protein, 15 aa, Artificial Sequence
  Hepatitis C virus_NS4b
EGAVQWMNRLIAFAS

SEQ ID NO: 3222 - protein, 20 aa, Artificial Sequence
  Hepatitis C virus_NS4b
GAVQWMNRLIAFASRGNHVS

SEQ ID NO: 3223 - protein, 18 aa, Artificial Sequence
  Hepatitis C virus_NS4b
NRLIAFASRGNHVSPTHY

SEQ ID NO: 3224 - protein, 18 aa, Artificial Sequence
  Hepatitis C virus_NS5a
SQLSARSLKATCTANHDS

SEQ ID NO: 3225 - protein, 15 aa, Artificial Sequence
  Hepatitis C virus_NS5a
IEANLLWRQEMGGNI

SEQ ID NO: 3226 - protein, 14 aa, Artificial Sequence
  Hepatitis C virus_NS5a
VSVPAEILRKRRFA

SEQ ID NO: 3227 - protein, 18 aa, Artificial Sequence
  Hepatitis C virus_NS5a
PAELRKSRFAQALPVWAR

SEQ ID NO: 3228 - protein, 20 aa, Artificial Sequence
  Hepatitis C virus_NS5b
LRHHNLVYSTTSRSACQRQK

SEQ ID NO: 3229 - protein, 20 aa, Artificial Sequence
  Hepatitis C virus_NS5b
KVTFDRLQVLDSHYQDVLKE

SEQ ID NO: 3230 - protein, 20 aa, Artificial Sequence
  Hepatitis C virus_NS5b
SVWKDLLEDNVTPIDTTIMA

SEQ ID NO: 3231 - protein, 20 aa, Artificial Sequence
  Hepatitis C virus_NS5b
KGGRKPARLIVFPDLGVRVC

SEQ ID NO: 3232 - protein, 18 aa, Artificial Sequence
  Hepatitis C virus_NS5b
KPARLIVFPDLGVRVCEK

SEQ ID NO: 3233 - protein, 20 aa, Artificial Sequence
  Hepatitis C virus_NS5b
KLPLAVMGSSYGFQYSPGQR

SEQ ID NO: 3234 - protein, 20 aa, Artificial Sequence
  Hepatitis C virus_NS5b
VEFLVQAWKSKKTPMGFSYD

SEQ ID NO: 3235 - protein, 20 aa, Artificial Sequence
  Hepatitis C virus_NS5b
SDIRTEEAIYQCCDLDPQAR

SEQ ID NO: 3236 - protein, 20 aa, Artificial Sequence
  Hepatitis C virus_NS5b
QCCDLDPQARVAIKSLTERL

SEQ ID NO: 3237 - protein, 12 aa, Artificial Sequence
  Hepatitis C virus_NS5b
GYRRCRASGVLT

SEQ ID NO: 3238 - protein, 14 aa, Artificial Sequence
  Hepatitis C virus_NS5b
CSSNVSVAHDGAGK

SEQ ID NO: 3239 - protein, 20 aa, Artificial Sequence
  Hepatitis C virus_NS5b
SVAHDGAGKRVYYLTRDPTT

SEQ ID NO: 3240 - protein, 15 aa, Artificial Sequence
  Hepatitis C virus_NS5b
RDPTTPLARAAWETA

SEQ ID NO: 3241 - protein, 20 aa, Artificial Sequence
  Hepatitis C virus_NS5b
NIIMFAPTLWARMILMTHFF

SEQ ID NO: 3242 - protein, 20 aa, Artificial Sequence
  Hepatitis C virus_NS5b
ARMILMTHFFSVLIARDQLE

SEQ ID NO: 3243 - protein, 15 aa, Artificial Sequence
  Hepatitis C virus_NS5b
LMIHFFSILAQEQLE

SEQ ID NO: 3244 - protein, 19 aa, Artificial Sequence
  Hepatitis C virus_NS5b
INRVAACLRKLGVPPLRAW

SEQ ID NO: 3245 - protein, 14 aa, Artificial Sequence
  Hepatitis C virus_NS5b
CGKYLFNWAVTKLK

SEQ ID NO: 3246 - protein, 20 aa, Artificial Sequence
  Hepatitis C virus_NS5b
CGKYLFNWAVRTKLKLTPIA

SEQ ID NO: 3247 - protein, 14 aa, Artificial Sequence
  Influenza A
ALNNRFQIKGVELK

SEQ ID NO: 3248 - protein, 15 aa, Artificial Sequence
  Influenza A
GALNNRFQIKGVELS

SEQ ID NO: 3249 - protein, 14 aa, Artificial Sequence
  Measles virus_F
LSEIKGVIVHRLEG

SEQ ID NO: 3250 - protein, 16 aa, Artificial Sequence
  Canine distemper virus_Fusion protein
TAAQITAGIALHQSNL

SEQ ID NO: 3251 - protein, 16 aa, Artificial Sequence
  Canine distemper virus_Fusion protein
IGTDNVHYKIMTRPSH

SEQ ID NO: 3252 - protein, 16 aa, Artificial Sequence
  Canine distemper virus_Fusion protein
YKIMTRPSHQYLVIKI

SEQ ID NO: 3253 - protein, 17 aa, Artificial Sequence
  Canine distemper virus_Fusion protein
SHQYLVIKLIPNASLIE

SEQ ID NO: 3254 - protein, 16 aa, Artificial Sequence
  Canine distemper virus_Fusion protein
KLIPNASLIENCTKAE

SEQ ID NO: 3255 - protein, 15 aa, Artificial Sequence
  Canine distemper virus_Fusion protein
LIENCTKAELGEYEK

SEQ ID NO: 3256 - protein, 17 aa, Artificial Sequence
  Canine distemper virus_Fusion protein
AELGEYEKLLNSVLEPI

SEQ ID NO: 3257 - protein, 17 aa, Artificial Sequence
  Canine distemper virus_Fusion protein
KLLNSVLEPINQALTLM

SEQ ID NO: 3258 - protein, 17 aa, Artificial Sequence
  Canine distemper virus_Fusion protein
EPINQALTLMTKNVKPL

SEQ ID NO: 3259 - protein, 17 aa, Artificial Sequence
  Canine distemper virus_Fusion protein
TLMTKNVKPLQSLGSGR

SEQ ID NO: 3260 - protein, 17 aa, Artificial Sequence
  Canine distemper virus_Fusion protein
KPLQSLGSGRRQRRFAG

SEQ ID NO: 3261 - protein, 17 aa, Artificial Sequence
  Canine distemper virus_Fusion protein
SGRRQRRFAGVVLAGVA

SEQ ID NO: 3262 - protein, 17 aa, Artificial Sequence
  Canine distemper virus_Fusion protein
FAGVVLAGVALGVATAA

SEQ ID NO: 3263 - protein, 17 aa, Artificial Sequence
  Canine distemper virus_Fusion protein
GVALGVATAAQITAGIA

SEQ ID NO: 3264 - protein, 17 aa, Artificial Sequence
  Canine distemper virus_Fusion protein
GIALHQSNLNAQAIQSL

SEQ ID NO: 3265 - protein, 17 aa, Artificial Sequence
  Canine distemper virus_Fusion protein
NLNAQAIQSLRTSLEQS

SEQ ID NO: 3266 - protein, 17 aa, Artificial Sequence
  Canine distemper virus_Fusion protein
QSLRTSLEQSNKAIEEI

SEQ ID NO: 3267 - protein, 17 aa, Artificial Sequence
  Canine distemper virus_Fusion protein
EQSNKAIEEIREATQET

SEQ ID NO: 3268 - protein, 17 aa, Artificial Sequence
  Canine distemper virus_Fusion protein
SSKTQTHTQQDRPPQPS

SEQ ID NO: 3269 - protein, 17 aa, Artificial Sequence
  Canine distemper virus_Fusion protein
QPSTELEETRTSRARHS

SEQ ID NO: 3270 - protein, 17 aa, Artificial Sequence
  Canine distemper virus_Fusion protein
RHSTTSAQRSTHYDPRT

SEQ ID NO: 3271 - protein, 17 aa, Artificial Sequence
  Canine distemper virus_Fusion protein
PRTSDRPVSYTMNRTRS

SEQ ID NO: 3272 - protein, 17 aa, Artificial Sequence
  Canine distemper virus_Fusion protein
TRSRKQTSHRLKNIPVH

SEQ ID NO: 3273 - protein, 17 aa, Artificial Sequence
  Canine distemper virus_Fusion protein
TELLSIFGPSLRDPISA

SEQ ID NO: 3274 - protein, 17 aa, Artificial Sequence
  Canine distemper virus_Fusion protein
PRYIATNGYLISNFDES

SEQ ID NO: 3275 - protein, 17 aa, Artificial Sequence
  Canine distemper virus_Fusion protein
CIRGDTSSCARTLVSGT

SEQ ID NO: 3276 - protein, 17 aa, Artificial Sequence
  Canine distemper virus_Fusion protein
DESSCVFVSESAICSQN

SEQ ID NO: 3277 - protein, 17 aa, Artificial Sequence
  Canine distemper virus_Fusion protein
TSTIINQSPDKLLTFIA

SEQ ID NO: 3278 - protein, 17 aa, Artificial Sequence
  Canine distemper virus_Fusion protein
SPDKLLTFIASDTCPLV

SEQ ID NO: 3279 - protein, 24 aa, Artificial Sequence
  Mucin-1
STAPPAHGVTSAPDTRAPGSTAPP

SEQ ID NO: 3280 - protein, 19 aa, Artificial Sequence
  Mucin-1
GVTSAPDTRPAPGSTASSL

SEQ ID NO: 3281 - protein, 18 aa, Artificial Sequence
  Mucin-1
GVTSAPDTRPAPGSTASL

SEQ ID NO: 3282 - protein, 27 aa, Artificial Sequence
  Mucin-1
TAPPAHGVTSAPDTRPAPGSTAPPKKG

SEQ ID NO: 3283 - protein, 26 aa, Artificial Sequence
  Mucin-1
STAPPAHGVTSAPDTRPAPGSTAPPK

SEQ ID NO: 3284 - protein, 4 aa, Artificial Sequence
  foot-and-mouth disease virus_VP3
GVAE

SEQ ID NO: 3285 - protein, 10 aa, Artificial Sequence
  foot-and-mouth disease virus_VP3
TASGVAETTN

SEQ ID NO: 3286 - protein, 16 aa, Artificial Sequence
  foot-and-mouth disease virus
TAKSKKFPSYTATYQF

SEQ ID NO: 3287 - protein, 16 aa, Artificial Sequence
  Clostridium tetani
AQYIKANSKFIGITEL

SEQ ID NO: 3288 - protein, 16 aa, Artificial Sequence
  Human immunodeficiency virus 1_gp120 protein
KQIINMWQVVGKAMYA

SEQ ID NO: 3289 - protein, 15 aa, Artificial Sequence
  Human immunodeficiency virus 1_gag protein
KRWIILGLNKIVRMY

SEQ ID NO: 3290 - protein, 16 aa, Artificial Sequence
  Human immunodeficiency virus 1_envelope glycoprotein
KQIINMWQEVGKAMYA

SEQ ID NO: 3291 - protein, 16 aa, Artificial Sequence
  Human immunodeficiency virus 1_envelope glycoprotein
KQIINMWQAVGKAMYA

SEQ ID NO: 3292 - protein, 16 aa, Artificial Sequence
  Tetanus Toxid
AQYIKANSKFIGITEL

SEQ ID NO: 3293 - protein, 7 aa, Artificial Sequence
  Human papilloma virus 16_E17
DRAHYNI

SEQ ID NO: 3294 - protein, 19 aa, Artificial Sequence
  Human papilloma virus 16_E17
QAEPDRAHYNIVTFCCKCD

SEQ ID NO: 3295 - RNA, 39 nt, Artificial Sequence
  PADRE
gccaaguucguggccgcguggacccugaaggccgccgcc

SEQ ID NO: 3296 - RNA, 54 nt, Artificial Sequence
  Hepatitis C virus_Core
augagcaccaaccccaagccgcagaucaagaccaagcgcaacacgaaccggcgc

SEQ ID NO: 3297 - RNA, 60 nt, Artificial Sequence
  Hepatitis C virus_Core
augagcaccaaccccaagccgcagcgcaagaccaagcggaacacgaaccgccggcaggac

SEQ ID NO: 3298 - RNA, 60 nt, Artificial Sequence
  Hepatitis C virus_Core
gacgugaaguuccccggcgggggccagaucgucgggggcguguaccugcucccgcgccgg

SEQ ID NO: 3299 - RNA, 45 nt, Artificial Sequence
  Hepatitis C virus_Core
gugggcggggucuaccugcucccccgccggggcccgcgccugggg

SEQ ID NO: 3300 - RNA, 60 nt, Artificial Sequence
  Hepatitis C virus_Core
gugggcggggucuaccugcucccccgccggggcccgcgccugggggugcgggccacccgc

SEQ ID NO: 3301 - RNA, 45 nt, Artificial Sequence
  Hepatitis C virus_Core
cgccggcgcagccggaaccugggcaaggugaucgacacccucacc

SEQ ID NO: 3302 - RNA, 45 nt, Artificial Sequence
  Hepatitis C virus_Core
acccugaccugcggcuucgccgaccucaugggguacaucccccug

SEQ ID NO: 3303 - RNA, 45 nt, Artificial Sequence
  Hepatitis C virus_Core
ggcgccccccuggggggcgccgcgcgcgcccucgcccacggggug

SEQ ID NO: 3304 - RNA, 60 nt, Artificial Sequence
  Hepatitis C virus_Core
ggcgccccccuggggggcgccgcgcgcgcccucgcccacggggugcggguccuggaggac

SEQ ID NO: 3305 - RNA, 45 nt, Artificial Sequence
  Hepatitis C virus_Core
gccccccugggcggggccgcgcgcgcccucgcccacggcgugcgg

SEQ ID NO: 3306 - RNA, 45 nt, Artificial Sequence
  Hepatitis C virus_Core
agcuucuccaucuuccugcucgcccugcugagcugccucaccauc

SEQ ID NO: 3307 - RNA, 33 nt, Artificial Sequence
  Hepatitis C virus_Core
cugcucagcugccugaccauccccgccuccgcc

SEQ ID NO: 3308 - RNA, 45 nt, Artificial Sequence
  Hepatitis C virus_E1
cacgugaccaacgacugccccaacagcuccaucgucuacgaggcc

SEQ ID NO: 3309 - RNA, 45 nt, Artificial Sequence
  Hepatitis C virus_E1
ugccccaacagcuccaucguguacgaggcccacgacgccauccug

SEQ ID NO: 3310 - RNA, 45 nt, Artificial Sequence
  Hepatitis C virus_E1
agccgcugcuggguggcccugacccccacccucgccgcgcggaac

SEQ ID NO: 3311 - RNA, 45 nt, Artificial Sequence
  Hepatitis C virus_E1
cgcugcuggguggccaugacccccaccgucgccacgcgggacggc

SEQ ID NO: 3312 - RNA, 45 nt, Artificial Sequence
  Hepatitis C virus_E1
augacccccaccguggccacgcgcgacggcaagcugccggccacc

SEQ ID NO: 3313 - RNA, 45 nt, Artificial Sequence
  Hepatitis C virus_E1
aagcugcccgccacccagcuccgccggcacaucgaccugcuggug

SEQ ID NO: 3314 - RNA, 45 nt, Artificial Sequence
  Hepatitis C virus_E1
accauccgccggcacguggaccugcucgucggcgccgccgcguuc

SEQ ID NO: 3315 - RNA, 45 nt, Artificial Sequence
  Hepatitis C virus_E1
ggcagcgccacccugugcuccgcccucuacgugggggaccugugc

SEQ ID NO: 3316 - RNA, 45 nt, Artificial Sequence
  Hepatitis C virus_E1
ggcagcguguuccugaucgggcagcucuucaccuucuccccccgc

SEQ ID NO: 3317 - RNA, 45 nt, Artificial Sequence
  Hepatitis C virus_E1
accuucagcccccgccggcaccagaccgugcaggacugcaacugc

SEQ ID NO: 3318 - RNA, 45 nt, Artificial Sequence
  Hepatitis C virus_E1
agcaucuaccccggccacaucaccgggcaccgcauggccugggac

SEQ ID NO: 3319 - RNA, 45 nt, Artificial Sequence
  Hepatitis C virus_E1
cacaucaccggccaccgcauggccugggacaugaugaugaacugg

SEQ ID NO: 3320 - RNA, 45 nt, Artificial Sequence
  Hepatitis C virus_E1
cacgugagcggccaccgcauggccugggacaugaugaugaacugg

SEQ ID NO: 3321 - RNA, 45 nt, Artificial Sequence
  Hepatitis C virus_E1
augaugaugaacuggagccccaccgccgcccuggugauggcgcag

SEQ ID NO: 3322 - RNA, 45 nt, Artificial Sequence
  Hepatitis C virus_E1
agccccaccgccgcccugguggucucccagcuccugcgcaucccg

SEQ ID NO: 3323 - RNA, 45 nt, Artificial Sequence
  Hepatitis C virus_E1
caggccauccuggacaugaucgccggcgcgcacuggggggugcuc

SEQ ID NO: 3324 - RNA, 45 nt, Artificial Sequence
  Hepatitis C virus_E1
cacuggggcgugcuggccgggcucgccuacuacagcauggucggc

SEQ ID NO: 3325 - RNA, 45 nt, Artificial Sequence
  Hepatitis C virus_E1
uucagcauggugggcaacugggccaagguccugguggugcuccug

SEQ ID NO: 3326 - RNA, 45 nt, Artificial Sequence
  Hepatitis C virus_E1
aacugggccaaggugcuggucgugcuccugcuguucgccggcgug

SEQ ID NO: 3327 - RNA, 54 nt, Artificial Sequence
  Hepatitis C virus_E2
ggcuucgccacccagcgccugaccagccucuucgcccuggggcccucccagaag

SEQ ID NO: 3328 - RNA, 48 nt, Artificial Sequence
  Hepatitis C virus_E2
ugccuguggaugaugcuccugaucgcccaggccgagcaggcgcugcuc

SEQ ID NO: 3329 - RNA, 45 nt, Artificial Sequence
  Hepatitis C virus_NS2
gccauggaccgcgagauggccgcgagcugcggcggggccguguuc

SEQ ID NO: 3330 - RNA, 45 nt, Artificial Sequence
  Hepatitis C virus_NS2
cgcgacgccaucauccugcucaccugcgccgugcaccccgagcug

SEQ ID NO: 3331 - RNA, 45 nt, Artificial Sequence
  Hepatitis C virus_NS2
ggcccccugauggugcuccaggccgggaucauccgcgccccguac

SEQ ID NO: 3332 - RNA, 60 nt, Artificial Sequence
  Hepatitis C virus_NS2
cccgugagcgcccgccggggccgcgagauccugcucgggccggccgacggcauggucucc

SEQ ID NO: 3333 - RNA, 45 nt, Artificial Sequence
  Hepatitis C virus_NS3
ggccagggguggcgccugcucgcccccaucaccgccuacagccag

SEQ ID NO: 3334 - RNA, 45 nt, Artificial Sequence
  Hepatitis C virus_NS3
ggccccgugauccagauguacaccaacgucgaccaggaccuggug

SEQ ID NO: 3335 - RNA, 45 nt, Artificial Sequence
  Hepatitis C virus_NS3
cagggcagccgcucccugacccccugcaccugcgggagcuccgac

SEQ ID NO: 3336 - RNA, 45 nt, Artificial Sequence
  Hepatitis C virus_NS3
agcuccgaccuguaccucgugacccgccacgccgacgucaucccc

SEQ ID NO: 3337 - RNA, 60 nt, Artificial Sequence
  Hepatitis C virus_NS3
uaccuggugacccgccacgccgacgucauccccgugcggcgccggggcgacagccgcggg

SEQ ID NO: 3338 - RNA, 45 nt, Artificial Sequence
  Hepatitis C virus_NS3
agccugcucuccccccgcccgaucagcuaccugaagggcuccagc

SEQ ID NO: 3339 - RNA, 45 nt, Artificial Sequence
  Hepatitis C virus_NS3
ugccccgccggccacgccguggggaucuuccgcgcggccgucugc

SEQ ID NO: 3340 - RNA, 60 nt, Artificial Sequence
  Hepatitis C virus_NS3
cuggagaccaccaugcgcagccccguguucacggacaacuccagcccgcccgucgugccc

SEQ ID NO: 3341 - RNA, 42 nt, Artificial Sequence
  Hepatitis C virus_NS3
agccccguguucaccgacaacuccagcccggccgucccccag

SEQ ID NO: 3342 - RNA, 45 nt, Artificial Sequence
  Hepatitis C virus_NS3
gugccccagagcuuccaggucgcccaccugcacgccccgaccggc

SEQ ID NO: 3343 - RNA, 45 nt, Artificial Sequence
  Hepatitis C virus_NS3
uuccagguggcccaccugcacgcccccaccggcagcgggaagucc

SEQ ID NO: 3344 - RNA, 45 nt, Artificial Sequence
  Hepatitis C virus_NS3
aaggugcccgccgccuacgcggcccagggcuacaagguccuggug

SEQ ID NO: 3345 - RNA, 60 nt, Artificial Sequence
  Hepatitis C virus_NS3
cccgccgccuacgcggcccagggcuacaaggugcugguccucaacccgagcguggccgcc

SEQ ID NO: 3346 - RNA, 42 nt, Artificial Sequence
  Hepatitis C virus_NS3
gccgccaagggcuacaaggugcugguccuccccagcguggcg

SEQ ID NO: 3347 - RNA, 45 nt, Artificial Sequence
  Hepatitis C virus_NS3
gcccagggcuacaaggugcugguccucaaccccagcguggccgcg

SEQ ID NO: 3348 - RNA, 45 nt, Artificial Sequence
  Hepatitis C virus_NS3
cagggcuacaaggugcugguccucaaccccagcguggccgccacc

SEQ ID NO: 3349 - RNA, 42 nt, Artificial Sequence
  Hepatitis C virus_NS3
ggcuacaaggugcugguccucaaccccagcguggccgccacc

SEQ ID NO: 3350 - RNA, 54 nt, Artificial Sequence
  Hepatitis C virus_NS3
ggcuacaaggugcugguccucaaccccagcguggccgccacccugggguucggc

SEQ ID NO: 3351 - RNA, 60 nt, Artificial Sequence
  Hepatitis C virus_NS3
ggcuacaaggugcugguccucaaccccagcguggccgccacccugggguucggcgcguac

SEQ ID NO: 3352 - RNA, 27 nt, Artificial Sequence
  Hepatitis C virus_NS3
gugcugguccucaaccccagcguggcc

SEQ ID NO: 3353 - RNA, 60 nt, Artificial Sequence
  Hepatitis C virus_NS3
aucaccuacagcaccuacggcaaguuccuggccgacgggggcugcuccgggggcgccuac

SEQ ID NO: 3354 - RNA, 54 nt, Artificial Sequence
  Hepatitis C virus_NS3
uacagcaccuacggcaaguuccuggccgacgccgggugcuccggcggggcguac

SEQ ID NO: 3355 - RNA, 45 nt, Artificial Sequence
  Hepatitis C virus_NS3
accuacggcaaguuccuggccgacgggggcugcagcgggggcgcc

SEQ ID NO: 3356 - RNA, 54 nt, Artificial Sequence
  Hepatitis C virus_NS3
cuggccgacgccggcugcagcgggggcgcguacgacaucaucaucugcgacgag

SEQ ID NO: 3357 - RNA, 45 nt, Artificial Sequence
  Hepatitis C virus_NS3
ggcggggccuacgacaucaucaucugcgacgagugccacagcacc

SEQ ID NO: 3358 - RNA, 45 nt, Artificial Sequence
  Hepatitis C virus_NS3
gacaucaucaucugcgacgagugccacagcaccgacgccaccucc

SEQ ID NO: 3359 - RNA, 60 nt, Artificial Sequence
  Hepatitis C virus_NS3
accgacgccaccagcauccugggcaucgggacggugcucgaccaggccgagaccgcgggc

SEQ ID NO: 3360 - RNA, 45 nt, Artificial Sequence
  Hepatitis C virus_NS3
gccaccagcauccugggcaucgggaccgugcucgaccaggccgag

SEQ ID NO: 3361 - RNA, 54 nt, Artificial Sequence
  Hepatitis C virus_NS3
gugaucaagggcgggcgccaccugaucuucugccacagcaagaagaagugcgac

SEQ ID NO: 3362 - RNA, 54 nt, Artificial Sequence
  Hepatitis C virus_NS3
gugaucaagggcgggcgccaccugaucuucugccacagccaccaccacugcgac

SEQ ID NO: 3363 - RNA, 45 nt, Artificial Sequence
  Hepatitis C virus_NS3
ggcgggcgccaccugaucuucugccacagcaagaagaagugcgac

SEQ ID NO: 3364 - RNA, 30 nt, Artificial Sequence
  Hepatitis C virus_NS3
ggccgccaccugaucuucugccacagcaag

SEQ ID NO: 3365 - RNA, 33 nt, Artificial Sequence
  Hepatitis C virus_NS3
ggccgccaccugaucuucugccacagcaagcgg

SEQ ID NO: 3366 - RNA, 45 nt, Artificial Sequence
  Hepatitis C virus_NS3
aagugcgacgagcuggccgccaagcucguggcgcugggcaucaac

SEQ ID NO: 3367 - RNA, 45 nt, Artificial Sequence
  Hepatitis C virus_NS3
cuggccgccaagcucguggcgcugggcaucaacgccgucgccuac

SEQ ID NO: 3368 - RNA, 45 nt, Artificial Sequence
  Hepatitis C virus_NS3
ggcaucaacgccguggccuacuaccgcgggcuggacgucagcgug

SEQ ID NO: 3369 - RNA, 60 nt, Artificial Sequence
  Hepatitis C virus_NS3
ggcaucaacgccguggccuacuaccgcgggcuggacgucagcgugauccccaccuccggc

SEQ ID NO: 3370 - RNA, 33 nt, Artificial Sequence
  Hepatitis C virus_NS3
guggccuacuaccgcggccuggacgucagcgug

SEQ ID NO: 3371 - RNA, 45 nt, Artificial Sequence
  Hepatitis C virus_NS3
guggccuacuaccgcggccuggacgucagcgugauccccaccucc

SEQ ID NO: 3372 - RNA, 54 nt, Artificial Sequence
  Hepatitis C virus_NS3
auccccaccaacggcgacguggucguggugagcaccgacgcccugaugacgggg

SEQ ID NO: 3373 - RNA, 45 nt, Artificial Sequence
  Hepatitis C virus_NS3
gcccugaugaccggcuacaccggggacuucgacagcgugaucgac

SEQ ID NO: 3374 - RNA, 54 nt, Artificial Sequence
  Hepatitis C virus_NS3
gacuucgacagcgugaucgacugcaacaccugcgucacccagacgguggacuuc

SEQ ID NO: 3375 - RNA, 45 nt, Artificial Sequence
  Hepatitis C virus_NS3
gugaucgacugcaacaccugcgucacccagacgguggacuucagc

SEQ ID NO: 3376 - RNA, 45 nt, Artificial Sequence
  Hepatitis C virus_NS3
aacaccugcgugacccagacggucgacuucagccuggaccccacc

SEQ ID NO: 3377 - RNA, 45 nt, Artificial Sequence
  Hepatitis C virus_NS3
acccagaccguggacuucagccuggaccccacguucaccaucgag

SEQ ID NO: 3378 - RNA, 45 nt, Artificial Sequence
  Hepatitis C virus_NS3
gagcaguacguggacuucagccuggaccccaccuucuccaucgag

SEQ ID NO: 3379 - RNA, 54 nt, Artificial Sequence
  Hepatitis C virus_NS3
cccaccuucaccaucgagacgaccacccugccgcaggacgccgugagccgcacc

SEQ ID NO: 3380 - RNA, 45 nt, Artificial Sequence
  Hepatitis C virus_NS3
auguucgacagcuccgugcugugcgagugcuacgacgccggcugc

SEQ ID NO: 3381 - RNA, 60 nt, Artificial Sequence
  Hepatitis C virus_NS3
uacgacgccggcugcgccugguacgagcugacccccgcggagaccacggugcgccuccgg

SEQ ID NO: 3382 - RNA, 51 nt, Artificial Sequence
  Hepatitis C virus_NS3
augcccgccgagaccaccgugcgccugcgggccuacaugaacacgccgggc

SEQ ID NO: 3383 - RNA, 60 nt, Artificial Sequence
  Hepatitis C virus_NS3
acccccgccgagaccacggugcgccugcgggccuacaugaacaccccgggccuccccguc

SEQ ID NO: 3384 - RNA, 45 nt, Artificial Sequence
  Hepatitis C virus_NS3
accaccgugcgccugcgggccuacaugaacacgcccggccucccg

SEQ ID NO: 3385 - RNA, 36 nt, Artificial Sequence
  Hepatitis C virus_NS3
cugcgcgccuacaugaacacccccggccucccggug

SEQ ID NO: 3386 - RNA, 45 nt, Artificial Sequence
  Hepatitis C virus_NS3
cugcgcgccuacaugaacacccccggccucccggugugccaggac

SEQ ID NO: 3387 - RNA, 33 nt, Artificial Sequence
  Hepatitis C virus_NS3
cgcgccuacaugaacacccccggccugccggug

SEQ ID NO: 3388 - RNA, 30 nt, Artificial Sequence
  Hepatitis C virus_NS3
gccuacaugaacacccccggccugccggug

SEQ ID NO: 3389 - RNA, 45 nt, Artificial Sequence
  Hepatitis C virus_NS3
gagagcguguucaccggccugacccacaucgacgcccacuuccuc

SEQ ID NO: 3390 - RNA, 45 nt, Artificial Sequence
  Hepatitis C virus_NS3
accggccugacccacaucgacgcccacuuccucagccagacgaag

SEQ ID NO: 3391 - RNA, 60 nt, Artificial Sequence
  Hepatitis C virus_NS3
gagaaccugcccuaccucguggccuaccaggccaccgucugcgcgcgcgcccaggccccg

SEQ ID NO: 3392 - RNA, 45 nt, Artificial Sequence
  Hepatitis C virus_NS3
cugcccuaccucguggccuaccaggccaccgucugcgcgcgcgcc

SEQ ID NO: 3393 - RNA, 42 nt, Artificial Sequence
  Hepatitis C virus_NS3
aaccugcccuaccucguggccuaccaggccaccgucugcgcg

SEQ ID NO: 3394 - RNA, 30 nt, Artificial Sequence
  Hepatitis C virus_NS3
uaccugguggccuaccaggccaccgucugc

SEQ ID NO: 3395 - RNA, 33 nt, Artificial Sequence
  Hepatitis C virus_NS3
uaccugguggccuaccaggccaccgucugcgcg

SEQ ID NO: 3396 - RNA, 45 nt, Artificial Sequence
  Hepatitis C virus_NS3
guggccuaccaggccaccgucugcgcgcgcgcccaggcccccccg

SEQ ID NO: 3397 - RNA, 45 nt, Artificial Sequence
  Hepatitis C virus_NS3
accgccuaccaggccaccgugugcgcgcgcgcccaggcccccccg

SEQ ID NO: 3398 - RNA, 45 nt, Artificial Sequence
  Hepatitis C virus_NS3
gcccaggcccccccgcccagcugggaccagauguggaagugccug

SEQ ID NO: 3399 - RNA, 48 nt, Artificial Sequence
  Hepatitis C virus_NS3
gaccagauguggcugaagugccucauccgccugaagcccacccugcac

SEQ ID NO: 3400 - RNA, 60 nt, Artificial Sequence
  Hepatitis C virus_NS3
cccaccccgcugcucuaccgccugggcgccgugcagaacgagaucacccugacgcacccc

SEQ ID NO: 3401 - RNA, 45 nt, Artificial Sequence
  Hepatitis C virus_NS3
cccgugaccaaguacaucauggccugcagcgccgaccuggagucc

SEQ ID NO: 3402 - RNA, 54 nt, Artificial Sequence
  Hepatitis C virus_NS3
cccaucaccaaguacaucaugaccugcaugagcgccgaccuggagguggucacg

SEQ ID NO: 3403 - RNA, 45 nt, Artificial Sequence
  Hepatitis C virus_NS3
accagcaccugggugcuggucggcggggugcucgccgcccuggcg

SEQ ID NO: 3404 - RNA, 60 nt, Artificial Sequence
  Hepatitis C virus_NS4
aacuucaucagcggcauccaguaccuggccgggcucuccacccugcccggcaacccggcc

SEQ ID NO: 3405 - RNA, 39 nt, Artificial Sequence
  Hepatitis C virus_NS4a
accagcaccugggugcuggucggcggggugcucgccgcc

SEQ ID NO: 3406 - RNA, 45 nt, Artificial Sequence
  Hepatitis C virus_NS4a
agcaccugggugcuggucggcggggugcucgccgcccuggcggcc

SEQ ID NO: 3407 - RNA, 30 nt, Artificial Sequence
  Hepatitis C virus_NS4a
accugggugcuggucggcggggugcucgcc

SEQ ID NO: 3408 - RNA, 60 nt, Artificial Sequence
  Hepatitis C virus_NS4a
gccgccuacugccugagcaccggcugcguggucaucguggggcgcgugguccucuccggc

SEQ ID NO: 3409 - RNA, 60 nt, Artificial Sequence
  Hepatitis C virus_NS4a
gugguccugagcggcaagcccgccaucaucccggaccgcgaggugcucuaccgggaguuc

SEQ ID NO: 3410 - RNA, 45 nt, Artificial Sequence
  Hepatitis C virus_NS4a
ggcaagcccgccaucaucccggaccgcgaggugcuguaccgggag

SEQ ID NO: 3411 - RNA, 30 nt, Artificial Sequence
  Hepatitis C virus_NS4a
aucauccccgaccgcgaggugcuguaccgg

SEQ ID NO: 3412 - RNA, 60 nt, Artificial Sequence
  Hepatitis C virus_NS4b
aucgcccccgccgugcagaccaacuggcagaagcuggagaccuucugggcgaagcacaug

SEQ ID NO: 3413 - RNA, 60 nt, Artificial Sequence
  Hepatitis C virus_NS4b
ggcauccaguaccuggccgggcucagcacccugcccggcaacccggccaucgcgucccug

SEQ ID NO: 3414 - RNA, 33 nt, Artificial Sequence
  Hepatitis C virus_NS4b
caguaccuggccggccucagcacccugcccggg

SEQ ID NO: 3415 - RNA, 30 nt, Artificial Sequence
  Hepatitis C virus_NS4b
uaccuggccggccucagcacccugcccggg

SEQ ID NO: 3416 - RNA, 60 nt, Artificial Sequence
  Hepatitis C virus_NS4b
cuggccggccucagcacccugcccgggaacccggccaucgcgucccugauggccuucacc

SEQ ID NO: 3417 - RNA, 54 nt, Artificial Sequence
  Hepatitis C virus_NS4b
ggccugagcacccuccccgggaacccggccaucgccucccugauggcguucacc

SEQ ID NO: 3418 - RNA, 60 nt, Artificial Sequence
  Hepatitis C virus_NS4b
cugcccggcaacccggccaucgccagccucauggcguucaccgccgccgugaccuccccc

SEQ ID NO: 3419 - RNA, 33 nt, Artificial Sequence
  Hepatitis C virus_NS4b
cccgccaucgccagccugauggcguucaccgcc

SEQ ID NO: 3420 - RNA, 30 nt, Artificial Sequence
  Hepatitis C virus_NS4b
aucgccagccugauggccuucaccgcggcc

SEQ ID NO: 3421 - RNA, 60 nt, Artificial Sequence
  Hepatitis C virus_NS4b
cugaccaccagccagacgcuccuguucaacauccugggcggguggguggccgcccagcuc

SEQ ID NO: 3422 - RNA, 45 nt, Artificial Sequence
  Hepatitis C virus_NS4b
acccagcacacccugcucuucaacauccugggcggguggguggcc

SEQ ID NO: 3423 - RNA, 30 nt, Artificial Sequence
  Hepatitis C virus_NS4b
cuguucaacauccucggcggguggguggcc

SEQ ID NO: 3424 - RNA, 27 nt, Artificial Sequence
  Hepatitis C virus_NS4b
uucaacauccugggcggguggguggcc

SEQ ID NO: 3425 - RNA, 36 nt, Artificial Sequence
  Hepatitis C virus_NS4b
uucaacauccugggcggguggguggccgcccagcuc

SEQ ID NO: 3426 - RNA, 45 nt, Artificial Sequence
  Hepatitis C virus_NS4b
cugggcaaggugcucgucgacauccuggccggguacggcgccggg

SEQ ID NO: 3427 - RNA, 54 nt, Artificial Sequence
  Hepatitis C virus_NS4b
aucaugagcggcgaggugcccuccaccgaggaccuggucaaccuccugccggcc

SEQ ID NO: 3428 - RNA, 60 nt, Artificial Sequence
  Hepatitis C virus_NS4b
ggcgaggugcccagcaccgaggaccuggucaaccuccugccggccauccugucccccggg

SEQ ID NO: 3429 - RNA, 30 nt, Artificial Sequence
  Hepatitis C virus_NS4b
cuggugaaccuccugcccgccauccugagc

SEQ ID NO: 3430 - RNA, 21 nt, Artificial Sequence
  Hepatitis C virus_NS4b
aaccugcuccccgccauccug

SEQ ID NO: 3431 - RNA, 60 nt, Artificial Sequence
  Hepatitis C virus_NS4b
gcccugguggucggcguggugugcgccgcgauccuccgccggcacgucgggcccggcgag

SEQ ID NO: 3432 - RNA, 60 nt, Artificial Sequence
  Hepatitis C virus_NS4b
ggccccggggagggcgccgugcaguggaugaaccgccugaucgccuucgcgagccggggg

SEQ ID NO: 3433 - RNA, 45 nt, Artificial Sequence
  Hepatitis C virus_NS4b
gagggcgccgugcaguggaugaaccgccugaucgccuucgcgagc

SEQ ID NO: 3434 - RNA, 60 nt, Artificial Sequence
  Hepatitis C virus_NS4b
ggcgccgugcaguggaugaaccgccugaucgccuucgcgagccgggggaaccacgucucc

SEQ ID NO: 3435 - RNA, 54 nt, Artificial Sequence
  Hepatitis C virus_NS4b
aaccgccugaucgccuucgccagccggggcaaccacgugucccccacccacuac

SEQ ID NO: 3436 - RNA, 54 nt, Artificial Sequence
  Hepatitis C virus_NS5a
agccagcuguccgcccgcagccucaaggccaccugcaccgcgaaccacgacucc

SEQ ID NO: 3437 - RNA, 45 nt, Artificial Sequence
  Hepatitis C virus_NS5a
aucgaggccaaccugcucuggcgccaggagaugggcgggaacauc

SEQ ID NO: 3438 - RNA, 42 nt, Artificial Sequence
  Hepatitis C virus_NS5a
gugagcguccccgccgagauccugcgcaagcggcgcuucgcc

SEQ ID NO: 3439 - RNA, 54 nt, Artificial Sequence
  Hepatitis C virus_NS5a
cccgccgagcugcgcaagagccgguucgcccaggcgcucccggugugggcccgc

SEQ ID NO: 3440 - RNA, 60 nt, Artificial Sequence
  Hepatitis C virus_NS5b
cugcgccaccacaaccucguguacagcaccaccucccggagcgccugccagcgccagaag

SEQ ID NO: 3441 - RNA, 60 nt, Artificial Sequence
  Hepatitis C virus_NS5b
aaggugaccuucgaccgccugcagguccucgacagccacuaccaggacgugcugaaggag

SEQ ID NO: 3442 - RNA, 60 nt, Artificial Sequence
  Hepatitis C virus_NS5b
agcguguggaaggaccugcucgaggacaacgucacccccaucgacaccacgaucauggcc

SEQ ID NO: 3443 - RNA, 60 nt, Artificial Sequence
  Hepatitis C virus_NS5b
aagggcgggcgcaagcccgcccggcugaucguguucccggaccucggcguccgcgugugc

SEQ ID NO: 3444 - RNA, 54 nt, Artificial Sequence
  Hepatitis C virus_NS5b
aagcccgcccgccugaucguguucccggaccucggcguccgggugugcgagaag

SEQ ID NO: 3445 - RNA, 60 nt, Artificial Sequence
  Hepatitis C virus_NS5b
aagcugccccucgccgugaugggcagcuccuacggguuccaguacagcccgggccagcgc

SEQ ID NO: 3446 - RNA, 60 nt, Artificial Sequence
  Hepatitis C virus_NS5b
guggaguuccugguccaggccuggaagagcaagaagacccccaugggcuucuccuacgac

SEQ ID NO: 3447 - RNA, 60 nt, Artificial Sequence
  Hepatitis C virus_NS5b
agcgacauccgcaccgaggaggccaucuaccagugcugcgaccuggacccccaggcccgg

SEQ ID NO: 3448 - RNA, 60 nt, Artificial Sequence
  Hepatitis C virus_NS5b
cagugcugcgaccuggacccccaggcccgcguggccaucaagagccucaccgagcggcug

SEQ ID NO: 3449 - RNA, 36 nt, Artificial Sequence
  Hepatitis C virus_NS5b
ggcuaccgccggugccgcgccagcggggugcugacc

SEQ ID NO: 3450 - RNA, 42 nt, Artificial Sequence
  Hepatitis C virus_NS5b
ugcagcuccaacgugagcgucgcccacgacggcgccgggaag

SEQ ID NO: 3451 - RNA, 60 nt, Artificial Sequence
  Hepatitis C virus_NS5b
agcguggcccacgacggcgccgggaagcgcgucuacuaccugacccgggaccccaccacg

SEQ ID NO: 3452 - RNA, 45 nt, Artificial Sequence
  Hepatitis C virus_NS5b
cgcgaccccaccaccccgcuggcccgggccgcgugggagacggcc

SEQ ID NO: 3453 - RNA, 60 nt, Artificial Sequence
  Hepatitis C virus_NS5b
aacaucaucauguucgcccccacccugugggcccgcaugauccucaugacccacuucuuc

SEQ ID NO: 3454 - RNA, 60 nt, Artificial Sequence
  Hepatitis C virus_NS5b
gcccgcaugauccugaugacccacuucuucagcgugcucaucgcccgggaccagcuggag

SEQ ID NO: 3455 - RNA, 45 nt, Artificial Sequence
  Hepatitis C virus_NS5b
cugaugauccacuucuucagcauccucgcccaggagcagcuggag

SEQ ID NO: 3456 - RNA, 57 nt, Artificial Sequence
  Hepatitis C virus_NS5b
aucaaccgcguggccgccugccugcggaagcucggcguccccccgcugcgcgcgugg

SEQ ID NO: 3457 - RNA, 42 nt, Artificial Sequence
  Hepatitis C virus_NS5b
ugcggcaaguaccuguucaacugggccgugaccaagcucaag

SEQ ID NO: 3458 - RNA, 60 nt, Artificial Sequence
  Hepatitis C virus_NS5b
ugcggcaaguaccuguucaacugggccgugcgcaccaagcucaagcugacccccaucgcc

SEQ ID NO: 3459 - RNA, 45 nt, Artificial Sequence
  Influenza A
gcccugaacaaccgcuuccagaucaagggcguggagcucaagagc

SEQ ID NO: 3460 - RNA, 48 nt, Artificial Sequence
  Influenza A
ggcgcccugaacaaccgcuuccagaucaaggggguggagcucaagagc

SEQ ID NO: 3461 - RNA, 45 nt, Artificial Sequence
  Measles virus_F
cugagcgagaucaagggcgugaucguccaccgccucgagggggug

SEQ ID NO: 3462 - RNA, 51 nt, Artificial Sequence
  Canine distemper virus_Fusion protein
accgccgcccagaucaccgcgggcaucgcccugcaccagagcaaccucaac

SEQ ID NO: 3463 - RNA, 51 nt, Artificial Sequence
  Canine distemper virus_Fusion protein
aucggcaccgacaacgugcacuacaagaucaugacccgccccagccaccag

SEQ ID NO: 3464 - RNA, 51 nt, Artificial Sequence
  Canine distemper virus_Fusion protein
uacaagaucaugacccgccccagccaccaguaccuggugaucaagcucauc

SEQ ID NO: 3465 - RNA, 51 nt, Artificial Sequence
  Canine distemper virus_Fusion protein
agccaccaguaccuggugaucaagcucauccccaacgccucccugaucgag

SEQ ID NO: 3466 - RNA, 51 nt, Artificial Sequence
  Canine distemper virus_Fusion protein
aagcugauccccaacgccagccucaucgagaacugcaccaaggccgagcug

SEQ ID NO: 3467 - RNA, 51 nt, Artificial Sequence
  Canine distemper virus_Fusion protein
cugaucgagaacugcaccaaggccgagcucggcgaguacgagaagcugcug

SEQ ID NO: 3468 - RNA, 51 nt, Artificial Sequence
  Canine distemper virus_Fusion protein
gccgagcugggcgaguacgagaagcuccugaacagcgugcuggagcccauc

SEQ ID NO: 3469 - RNA, 51 nt, Artificial Sequence
  Canine distemper virus_Fusion protein
aagcugcucaacagcgugcuggagcccaucaaccaggcccugacccucaug

SEQ ID NO: 3470 - RNA, 51 nt, Artificial Sequence
  Canine distemper virus_Fusion protein
gagcccaucaaccaggcccugacccucaugaccaagaacgugaagccgcug

SEQ ID NO: 3471 - RNA, 51 nt, Artificial Sequence
  Canine distemper virus_Fusion protein
acccugaugaccaagaacgugaagccccuccagagccugggcuccgggcgc

SEQ ID NO: 3472 - RNA, 51 nt, Artificial Sequence
  Canine distemper virus_Fusion protein
aagccccugcagagccucggcuccgggcgccggcagcgccgguucgccggc

SEQ ID NO: 3473 - RNA, 51 nt, Artificial Sequence
  Canine distemper virus_Fusion protein
agcggccgccggcagcgccgguucgccggggugguccuggccggcguggcg

SEQ ID NO: 3474 - RNA, 51 nt, Artificial Sequence
  Canine distemper virus_Fusion protein
uucgccggcgugguccuggccgggguggcgcucggcguggccaccgccgcc

SEQ ID NO: 3475 - RNA, 51 nt, Artificial Sequence
  Canine distemper virus_Fusion protein
ggcguggcccugggggucgccaccgcggcccagaucaccgccggcaucgcc

SEQ ID NO: 3476 - RNA, 51 nt, Artificial Sequence
  Canine distemper virus_Fusion protein
ggcaucgcccugcaccagagcaaccucaacgcccaggcgauccagucccug

SEQ ID NO: 3477 - RNA, 51 nt, Artificial Sequence
  Canine distemper virus_Fusion protein
aaccugaacgcccaggccauccagagccuccgcaccucccuggagcagagc

SEQ ID NO: 3478 - RNA, 51 nt, Artificial Sequence
  Canine distemper virus_Fusion protein
cagagccugcgcaccucccucgagcagagcaacaaggccaucgaggagauc

SEQ ID NO: 3479 - RNA, 51 nt, Artificial Sequence
  Canine distemper virus_Fusion protein
gagcagagcaacaaggccaucgaggagauccgcgaggccacccaggagacc

SEQ ID NO: 3480 - RNA, 51 nt, Artificial Sequence
  Canine distemper virus_Fusion protein
agcuccaagacccagacccacacgcagcaggaccgccccccgcagcccagc

SEQ ID NO: 3481 - RNA, 51 nt, Artificial Sequence
  Canine distemper virus_Fusion protein
cagcccagcaccgagcuggaggagacccgcacgucccgggcccgccacagc

SEQ ID NO: 3482 - RNA, 51 nt, Artificial Sequence
  Canine distemper virus_Fusion protein
cgccacagcaccaccuccgcccagcggagcacgcacuacgacccccgcacc

SEQ ID NO: 3483 - RNA, 51 nt, Artificial Sequence
  Canine distemper virus_Fusion protein
ccccgcaccagcgaccggccgguguccuacaccaugaaccgcacgcggagc

SEQ ID NO: 3484 - RNA, 51 nt, Artificial Sequence
  Canine distemper virus_Fusion protein
acccgcagccggaagcagaccucccaccgccugaagaacauccccgugcac

SEQ ID NO: 3485 - RNA, 51 nt, Artificial Sequence
  Canine distemper virus_Fusion protein
accgagcugcucagcaucuucggccccucccugcgcgacccgaucagcgcc

SEQ ID NO: 3486 - RNA, 51 nt, Artificial Sequence
  Canine distemper virus_Fusion protein
ccccgcuacaucgccaccaacggcuaccugaucagcaacuucgacgagucc

SEQ ID NO: 3487 - RNA, 51 nt, Artificial Sequence
  Canine distemper virus_Fusion protein
ugcauccgcggcgacaccagcuccugcgcccggacccuggugagcgggacg

SEQ ID NO: 3488 - RNA, 51 nt, Artificial Sequence
  Canine distemper virus_Fusion protein
gacgagagcuccugcguguucgucagcgaguccgccaucugcagccagaac

SEQ ID NO: 3489 - RNA, 51 nt, Artificial Sequence
  Canine distemper virus_Fusion protein
accagcaccaucaucaaccagucccccgacaagcugcucacguucaucgcc

SEQ ID NO: 3490 - RNA, 51 nt, Artificial Sequence
  Canine distemper virus_Fusion protein
agccccgacaagcugcucaccuucaucgccuccgacaccugcccgcuggug

SEQ ID NO: 3491 - RNA, 72 nt, Artificial Sequence
  Mucin-1
agcaccgcccccccggcccacggcgugaccuccgcgcccgacacgcgcgcccccgggagcaccgcccccccg

SEQ ID NO: 3492 - RNA, 57 nt, Artificial Sequence
  Mucin-1
ggcgugaccagcgcccccgacacccgcccggcccccggguccacggcgagcucccug

SEQ ID NO: 3493 - RNA, 54 nt, Artificial Sequence
  Mucin-1
ggcgugaccagcgcccccgacacccgcccggcccccggguccacggcgagccug

SEQ ID NO: 3494 - RNA, 81 nt, Artificial Sequence
  Mucin-1
accgcccccccggcccacggcgugaccagcgcgcccgacacgcgccccgcccccggguccaccgccccgcccaagaagggc

SEQ ID NO: 3495 - RNA, 78 nt, Artificial Sequence
  Mucin-1
agcaccgcccccccggcccacggcgugaccuccgcgcccgacacgcgccccgcccccgggagcaccgccccgcccaag

SEQ ID NO: 3496 - RNA, 12 nt, Artificial Sequence
  foot-and-mouth disease virus_VP3
ggcguggccgag

SEQ ID NO: 3497 - RNA, 30 nt, Artificial Sequence
  foot-and-mouth disease virus_VP3
accgccagcggcguggccgagaccacgaac

SEQ ID NO: 3498 - RNA, 48 nt, Artificial Sequence
  foot-and-mouth disease virus
accgccaagagcaagaaguuccccuccuacaccgccacguaccaguuc

SEQ ID NO: 3499 - RNA, 48 nt, Artificial Sequence
  Clostridium tetani
gcccaguacaucaaggccaacagcaaguucaucggcaucaccgagcug

SEQ ID NO: 3500 - RNA, 48 nt, Artificial Sequence
  Human immunodeficiency virus 1_gp120 protein
aagcagaucaucaacauguggcagguggucggcaaggccauguacgcc

SEQ ID NO: 3501 - RNA, 45 nt, Artificial Sequence
  Human immunodeficiency virus 1_gag protein
aagcgcuggaucauccugggccucaacaagaucgugcggauguac

SEQ ID NO: 3502 - RNA, 48 nt, Artificial Sequence
  Human immunodeficiency virus 1_envelope glycoprotein
aagcagaucaucaacauguggcaggaggugggcaaggccauguacgcc

SEQ ID NO: 3503 - RNA, 48 nt, Artificial Sequence
  Human immunodeficiency virus 1_envelope glycoprotein
aagcagaucaucaacauguggcaggccgugggcaaggccauguacgcg

SEQ ID NO: 3504 - RNA, 48 nt, Artificial Sequence; identical to SEQ ID NO: 3499
  Tetanus Toxid

SEQ ID NO: 3505 - RNA, 21 nt, Artificial Sequence
  Human papilloma virus 16_E17
gaccgcgcccacuacaacauc

SEQ ID NO: 3506 - RNA, 57 nt, Artificial Sequence
  Human papilloma virus 16_E17
caggccgagcccgaccgcgcccacuacaacaucgugaccuucugcugcaagugcgac

SEQ ID NO: 3507 - RNA, 39 nt, Artificial Sequence
  PADRE
gccaaguucguggcugcauggacccugaaagccgcggcu

SEQ ID NO: 3508 - RNA, 54 nt, Artificial Sequence
  Hepatitis C virus_Core
augagcaccaaccccaagccucagaucaaaacaaagagaaauacuaacaggcgg

SEQ ID NO: 3509 - RNA, 60 nt, Artificial Sequence
  Hepatitis C virus_Core
augagcaccaaccccaagccucagagaaaaacaaagaggaauacuaaccggcgccaagac

SEQ ID NO: 3510 - RNA, 60 nt, Artificial Sequence
  Hepatitis C virus_Core
gacgugaaguuccccggcgggggacagaucgucgguggcguuuaccugcucccuagaagg

SEQ ID NO: 3511 - RNA, 45 nt, Artificial Sequence
  Hepatitis C virus_Core
gugggcggggucuaccugcuccccagaaggggaccucggcuuggu

SEQ ID NO: 3512 - RNA, 60 nt, Artificial Sequence
  Hepatitis C virus_Core
gugggcggggucuaccugcuccccagaaggggaccucggcuugguguucgcgccacccga

SEQ ID NO: 3513 - RNA, 45 nt, Artificial Sequence
  Hepatitis C virus_Core
agaaggcggagccgcaaccugggcaaggugaucgacacccucaca

SEQ ID NO: 3514 - RNA, 45 nt, Artificial Sequence
  Hepatitis C virus_Core
acccugacaugcggcuucgccgaccucaugggguacaucccccuu

SEQ ID NO: 3515 - RNA, 45 nt, Artificial Sequence
  Hepatitis C virus_Core
ggcgccccccuggggggagcugcaagagcccucgcgcacggugug

SEQ ID NO: 3516 - RNA, 60 nt, Artificial Sequence
  Hepatitis C virus_Core
ggcgccccccuggggggagcugcaagagcccucgcgcacggugugaggguccuugaggac

SEQ ID NO: 3517 - RNA, 45 nt, Artificial Sequence
  Hepatitis C virus_Core
gccccccugggcggggcugcaagagcccucgcgcacggagugagg

SEQ ID NO: 3518 - RNA, 45 nt, Artificial Sequence
  Hepatitis C virus_Core
agcuucuccaucuuucugcucgcccuucugucuugcuugaccauu

SEQ ID NO: 3519 - RNA, 33 nt, Artificial Sequence
  Hepatitis C virus_Core
cugcucagcugccuuaccauccccgccuccgcu

SEQ ID NO: 3520 - RNA, 45 nt, Artificial Sequence
  Hepatitis C virus_E1
cacgugaccaacgacugccccaauagcuccaucgucuacgaggcc

SEQ ID NO: 3521 - RNA, 45 nt, Artificial Sequence
  Hepatitis C virus_E1
ugccccaacagcuccaucguguacgaggcccacgacgcuauucug

SEQ ID NO: 3522 - RNA, 45 nt, Artificial Sequence
  Hepatitis C virus_E1
agcagaugcuggguggcccugacccccacacucgcugcaaggaac

SEQ ID NO: 3523 - RNA, 45 nt, Artificial Sequence
  Hepatitis C virus_E1
agaugcuggguggccaugacccccacagucgcuacuagggacggc

SEQ ID NO: 3524 - RNA, 45 nt, Artificial Sequence
  Hepatitis C virus_E1
augacccccacaguggccacuagagacggcaagcugccugcuacg

SEQ ID NO: 3525 - RNA, 45 nt, Artificial Sequence
  Hepatitis C virus_E1
aagcugcccgccacccagcucagaaggcacaucgaccuucuggug

SEQ ID NO: 3526 - RNA, 45 nt, Artificial Sequence
  Hepatitis C virus_E1
accaucagaaggcacguggaccugcucgucggcgccgcugcauuc

SEQ ID NO: 3527 - RNA, 45 nt, Artificial Sequence
  Hepatitis C virus_E1
ggcagcgccacccugugcuccgcucucuacgugggggaccuuugu

SEQ ID NO: 3528 - RNA, 45 nt, Artificial Sequence
  Hepatitis C virus_E1
ggcagcguguuccugaucgggcagcucuuuaccuucucccccaga

SEQ ID NO: 3529 - RNA, 45 nt, Artificial Sequence
  Hepatitis C virus_E1
accuucagccccagaaggcaccagacagugcaagacugcaacugu

SEQ ID NO: 3530 - RNA, 45 nt, Artificial Sequence
  Hepatitis C virus_E1
agcaucuaccccggccacauuaccgggcauagaauggccugggac

SEQ ID NO: 3531 - RNA, 45 nt, Artificial Sequence
  Hepatitis C virus_E1
cacaucaccggccauagaauggccugggacaugaugaugaacugg

SEQ ID NO: 3532 - RNA, 45 nt, Artificial Sequence
  Hepatitis C virus_E1
cacgugagcggccauagaauggccugggacaugaugaugaacugg

SEQ ID NO: 3533 - RNA, 45 nt, Artificial Sequence
  Hepatitis C virus_E1
augaugaugaacuggagccccaccgccgcucuggugauggcacag

SEQ ID NO: 3534 - RNA, 45 nt, Artificial Sequence
  Hepatitis C virus_E1
agccccaccgccgcucugguggucucccagcuccuuagaaucccu

SEQ ID NO: 3535 - RNA, 45 nt, Artificial Sequence
  Hepatitis C virus_E1
caggccauccuggacaugauugcuggcgcacacuggggggugcuc

SEQ ID NO: 3536 - RNA, 45 nt, Artificial Sequence
  Hepatitis C virus_E1
cacuggggcgugcuggccgggcucgcuuacuauagcauggucgga

SEQ ID NO: 3537 - RNA, 45 nt, Artificial Sequence
  Hepatitis C virus_E1
uucagcauggugggcaacugggccaagguccugguugugcuccuu

SEQ ID NO: 3538 - RNA, 45 nt, Artificial Sequence
  Hepatitis C virus_E1
aacugggccaaggugcuggucguucuccuucuguucgcuggcgug

SEQ ID NO: 3539 - RNA, 54 nt, Artificial Sequence
  Hepatitis C virus_E2
ggcuucgccacccagagacugacaagccucuuugcucuugggcccucccaaaag

SEQ ID NO: 3540 - RNA, 48 nt, Artificial Sequence
  Hepatitis C virus_E2
ugccuguggaugaugcuccuuaucgcccaggcugagcaagcacuguug

SEQ ID NO: 3541 - RNA, 45 nt, Artificial Sequence
  Hepatitis C virus_NS2
gccauggacagagagauggcugcaagcugcggcggggccguguuc

SEQ ID NO: 3542 - RNA, 45 nt, Artificial Sequence
  Hepatitis C virus_NS2
agagacgccaucauucugcucaccugcgcugugcaccccgagcuu

SEQ ID NO: 3543 - RNA, 45 nt, Artificial Sequence
  Hepatitis C virus_NS2
ggcccccugauggugcuccaggccgggaucauuagagcuccuuac

SEQ ID NO: 3544 - RNA, 60 nt, Artificial Sequence
  Hepatitis C virus_NS2
cccgugagcgccagaaggggccgggagauccugcucgggccugcugacggaauggucucc

SEQ ID NO: 3545 - RNA, 45 nt, Artificial Sequence
  Hepatitis C virus_NS3
ggccagggguggagacugcucgcccccaucaccgcuuacagccaa

SEQ ID NO: 3546 - RNA, 45 nt, Artificial Sequence
  Hepatitis C virus_NS3
ggccccgugauccagauguacaccaacgucgaccaagaucugguu

SEQ ID NO: 3547 - RNA, 45 nt, Artificial Sequence
  Hepatitis C virus_NS3
cagggcagcagaucccugacccccugcacaugugggucuucagac

SEQ ID NO: 3548 - RNA, 45 nt, Artificial Sequence
  Hepatitis C virus_NS3
agcuccgaccuguaccucgugaccagacacgccgaugucaucccc

SEQ ID NO: 3549 - RNA, 60 nt, Artificial Sequence
  Hepatitis C virus_NS3
uaccuggugaccagacacgccgacgucauccccguuaggcggcgcggcgauagccgaggg

SEQ ID NO: 3550 - RNA, 45 nt, Artificial Sequence
  Hepatitis C virus_NS3
agccugcucucccccagaccuaucucuuaccuuaagggcucaagu

SEQ ID NO: 3551 - RNA, 45 nt, Artificial Sequence
  Hepatitis C virus_NS3
ugccccgccggccacgcuguggggaucuucagagcagccgucugu

SEQ ID NO: 3552 - RNA, 60 nt, Artificial Sequence
  Hepatitis C virus_NS3
cuggagaccacaaugagaagccccguguucacugacaacuccucuccuccagucguuccg

SEQ ID NO: 3553 - RNA, 42 nt, Artificial Sequence
  Hepatitis C virus_NS3
agccccguguucaccgacaacuccucuccugccgucccacag

SEQ ID NO: 3554 - RNA, 45 nt, Artificial Sequence
  Hepatitis C virus_NS3
gugccccagagcuuccaagucgcccaccugcaugcuccuaccggc

SEQ ID NO: 3555 - RNA, 45 nt, Artificial Sequence
  Hepatitis C virus_NS3
uuccagguggcccaccugcaugcucccaccggcagcgggaagucc

SEQ ID NO: 3556 - RNA, 45 nt, Artificial Sequence
  Hepatitis C virus_NS3
aaggugcccgccgcuuacgcagcccagggcuauaaaguccugguu

SEQ ID NO: 3557 - RNA, 60 nt, Artificial Sequence
  Hepatitis C virus_NS3
cccgccgcuuacgcagcccagggcuauaaggugcugguccucaacccuagcguugcggcu

SEQ ID NO: 3558 - RNA, 42 nt, Artificial Sequence
  Hepatitis C virus_NS3
gccgcuaagggcuacaaagugcugguccuccccagcguugca

SEQ ID NO: 3559 - RNA, 45 nt, Artificial Sequence
  Hepatitis C virus_NS3
gcccagggcuacaaggugcugguccucaaccccagcguugcugca

SEQ ID NO: 3560 - RNA, 45 nt, Artificial Sequence
  Hepatitis C virus_NS3
cagggcuacaaggugcugguccucaaccccagcguugccgcuacc

SEQ ID NO: 3561 - RNA, 42 nt, Artificial Sequence
  Hepatitis C virus_NS3
ggcuacaaggugcugguccucaaccccagcguugccgcuacc

SEQ ID NO: 3562 - RNA, 54 nt, Artificial Sequence
  Hepatitis C virus_NS3
ggcuacaaggugcugguccucaaccccagcguugccgcuacccuuggguucgga

SEQ ID NO: 3563 - RNA, 60 nt, Artificial Sequence
  Hepatitis C virus_NS3
ggcuacaaggugcugguccucaaccccagcguugccgcuacccuuggguucggagcauau

SEQ ID NO: 3564 - RNA, 27 nt, Artificial Sequence
  Hepatitis C virus_NS3
gugcugguccucaaccccagcguugcc

SEQ ID NO: 3565 - RNA, 60 nt, Artificial Sequence
  Hepatitis C virus_NS3
aucaccuacagcacauauggcaaguuccuggccgacgggggaugcuccgguggcgcuuac

SEQ ID NO: 3566 - RNA, 54 nt, Artificial Sequence
  Hepatitis C virus_NS3
uacagcaccuauggcaaguuccuggccgacgcugggugcuccggaggugcauac

SEQ ID NO: 3567 - RNA, 45 nt, Artificial Sequence
  Hepatitis C virus_NS3
accuacggcaaguuccuggccgacgggggaugcagcgguggcgcu

SEQ ID NO: 3568 - RNA, 54 nt, Artificial Sequence
  Hepatitis C virus_NS3
cuggccgacgcuggcugcagcgggggagcauacgauaucauuauaugugacgag

SEQ ID NO: 3569 - RNA, 45 nt, Artificial Sequence
  Hepatitis C virus_NS3
ggcggggccuacgacaucauuauaugcgaugagugucacagcacc

SEQ ID NO: 3570 - RNA, 45 nt, Artificial Sequence
  Hepatitis C virus_NS3
gacaucauuauaugcgaugagugucacagcaccgacgccacaucc

SEQ ID NO: 3571 - RNA, 60 nt, Artificial Sequence
  Hepatitis C virus_NS3
accgacgccacaagcauccugggcauugggacugugcucgaucaggcugagacggcagga

SEQ ID NO: 3572 - RNA, 45 nt, Artificial Sequence
  Hepatitis C virus_NS3
gccaccagcauccugggcauugggacagugcucgaccaggcugag

SEQ ID NO: 3573 - RNA, 54 nt, Artificial Sequence
  Hepatitis C virus_NS3
gugaucaagggcgggagacaccugauuuucugccauagcaaaaagaaaugugac

SEQ ID NO: 3574 - RNA, 54 nt, Artificial Sequence
  Hepatitis C virus_NS3
gugaucaagggcgggagacaccugauuuucugccauagccaccaucacugugac

SEQ ID NO: 3575 - RNA, 45 nt, Artificial Sequence
  Hepatitis C virus_NS3
ggcgggagacaccugaucuucugccauagcaagaaaaagugugac

SEQ ID NO: 3576 - RNA, 30 nt, Artificial Sequence
  Hepatitis C virus_NS3
ggcagacaccugaucuucugccauagcaag

SEQ ID NO: 3577 - RNA, 33 nt, Artificial Sequence
  Hepatitis C virus_NS3
ggcagacaccugaucuucugccauagcaagagg

SEQ ID NO: 3578 - RNA, 45 nt, Artificial Sequence
  Hepatitis C virus_NS3
aagugcgacgagcuggccgcuaaacucguggcacuuggcaucaac

SEQ ID NO: 3579 - RNA, 45 nt, Artificial Sequence
  Hepatitis C virus_NS3
cuggccgcuaagcucguggcacuuggcaucaacgccgucgcguac

SEQ ID NO: 3580 - RNA, 45 nt, Artificial Sequence
  Hepatitis C virus_NS3
ggcaucaacgccguggcuuacuauagagggcuggacgucagcguu

SEQ ID NO: 3581 - RNA, 60 nt, Artificial Sequence
  Hepatitis C virus_NS3
ggcaucaacgccguggcuuacuauagagggcuggacgucagcguuauucccaccuccgga

SEQ ID NO: 3582 - RNA, 33 nt, Artificial Sequence
  Hepatitis C virus_NS3
guggccuacuauagaggccuggacgucagcguu

SEQ ID NO: 3583 - RNA, 45 nt, Artificial Sequence
  Hepatitis C virus_NS3
guggccuacuauagaggccuggacgucagcguuauccccaccucc

SEQ ID NO: 3584 - RNA, 54 nt, Artificial Sequence
  Hepatitis C virus_NS3
auccccaccaacggcgacguggucguugugagcacagaugcccugaugacuggg

SEQ ID NO: 3585 - RNA, 45 nt, Artificial Sequence
  Hepatitis C virus_NS3
gcccugaugaccggcuacacaggggacuucgauagcgugaucgac

SEQ ID NO: 3586 - RNA, 54 nt, Artificial Sequence
  Hepatitis C virus_NS3
gacuucgauagcgugaucgacugcaacaccugugucacacagacuguugauuuu

SEQ ID NO: 3587 - RNA, 45 nt, Artificial Sequence
  Hepatitis C virus_NS3
gugaucgacugcaacaccugugucacacagacuguugauuucagc

SEQ ID NO: 3588 - RNA, 45 nt, Artificial Sequence
  Hepatitis C virus_NS3
aacaccugcgugacacagacugucgacuucagccuggaucccacg

SEQ ID NO: 3589 - RNA, 45 nt, Artificial Sequence
  Hepatitis C virus_NS3
acccagacaguggacuucagccuggaucccacuuuuacgaucgag

SEQ ID NO: 3590 - RNA, 45 nt, Artificial Sequence
  Hepatitis C virus_NS3
gagcaguacguggacuucagccuggaucccaccuuuuccaucgaa

SEQ ID NO: 3591 - RNA, 54 nt, Artificial Sequence
  Hepatitis C virus_NS3
cccaccuucacaaucgagacuacgacccugccucaggacgccgugagcagaaca

SEQ ID NO: 3592 - RNA, 45 nt, Artificial Sequence
  Hepatitis C virus_NS3
auguucgacagcuccgugcugugcgaguguuacgaugccggcugc

SEQ ID NO: 3593 - RNA, 60 nt, Artificial Sequence
  Hepatitis C virus_NS3
uacgacgccggcugcgcuugguaugagcugacccccgcagaaacaacugugagacucagg

SEQ ID NO: 3594 - RNA, 51 nt, Artificial Sequence
  Hepatitis C virus_NS3
augcccgccgagaccacagugagacugagggcuuacaugaacacuccuggc

SEQ ID NO: 3595 - RNA, 60 nt, Artificial Sequence
  Hepatitis C virus_NS3
acccccgccgagacaacugugagacugagggcuuacaugaacacgccuggccucccaguc

SEQ ID NO: 3596 - RNA, 45 nt, Artificial Sequence
  Hepatitis C virus_NS3
accacagugagacugagggccuacaugaacacucccggccucccu

SEQ ID NO: 3597 - RNA, 36 nt, Artificial Sequence
  Hepatitis C virus_NS3
cugagagccuacaugaacacccccggccucccugug

SEQ ID NO: 3598 - RNA, 45 nt, Artificial Sequence
  Hepatitis C virus_NS3
cugagagccuacaugaacacccccggccucccugugugccaggac

SEQ ID NO: 3599 - RNA, 33 nt, Artificial Sequence
  Hepatitis C virus_NS3
agagccuacaugaacacccccggccugccugug

SEQ ID NO: 3600 - RNA, 30 nt, Artificial Sequence
  Hepatitis C virus_NS3
gccuacaugaacacccccggccugccugug

SEQ ID NO: 3601 - RNA, 45 nt, Artificial Sequence
  Hepatitis C virus_NS3
gagagcguguucaccggccugacacacaucgacgcccauuuucuc

SEQ ID NO: 3602 - RNA, 45 nt, Artificial Sequence
  Hepatitis C virus_NS3
accggccugacacacaucgacgcccauuuccucagccagacuaag

SEQ ID NO: 3603 - RNA, 60 nt, Artificial Sequence
  Hepatitis C virus_NS3
gagaaccugcccuaccucguggccuaucaggcuaccgucugcgcaagagcccaagcgccu

SEQ ID NO: 3604 - RNA, 45 nt, Artificial Sequence
  Hepatitis C virus_NS3
cugcccuaccucguggccuaucaggcuaccgucugcgcaagagcc

SEQ ID NO: 3605 - RNA, 42 nt, Artificial Sequence
  Hepatitis C virus_NS3
aaccugcccuaccucguggccuaucaggcuaccgucugcgca

SEQ ID NO: 3606 - RNA, 30 nt, Artificial Sequence
  Hepatitis C virus_NS3
uaccugguggccuaucaggcuaccgucugc

SEQ ID NO: 3607 - RNA, 33 nt, Artificial Sequence
  Hepatitis C virus_NS3
uaccugguggccuaucaggcuaccgucugcgca

SEQ ID NO: 3608 - RNA, 45 nt, Artificial Sequence
  Hepatitis C virus_NS3
guggccuaccaggcuaccgucugcgcaagagcccaagcgcccccu

SEQ ID NO: 3609 - RNA, 45 nt, Artificial Sequence
  Hepatitis C virus_NS3
accgccuaccaggcuacagugugcgcaagagcccaagcgcccccu

SEQ ID NO: 3610 - RNA, 45 nt, Artificial Sequence
  Hepatitis C virus_NS3
gcccaggcucccccuccaagcugggaccaaauguggaagugccug

SEQ ID NO: 3611 - RNA, 48 nt, Artificial Sequence
  Hepatitis C virus_NS3
gaccagauguggcugaagugccucaucagacuuaaacccacccugcac

SEQ ID NO: 3612 - RNA, 60 nt, Artificial Sequence
  Hepatitis C virus_NS3
cccaccccucugcucuacagacuuggcgccgugcagaacgagaucacacugacucaccca

SEQ ID NO: 3613 - RNA, 45 nt, Artificial Sequence
  Hepatitis C virus_NS3
cccgugaccaaguacaucauggccugcagcgcugaccuggagucc

SEQ ID NO: 3614 - RNA, 54 nt, Artificial Sequence
  Hepatitis C virus_NS3
cccaucaccaaguacauuaugacaugcaugagcgccgaccuggagguggucacu

SEQ ID NO: 3615 - RNA, 45 nt, Artificial Sequence
  Hepatitis C virus_NS3
accagcacaugggugcuggucggcgggguucucgccgcucuugca

SEQ ID NO: 3616 - RNA, 60 nt, Artificial Sequence
  Hepatitis C virus_NS4
aacuucaucagcggcauucaguaccuggccgggcucuccacccuucccggaaauccugcu

SEQ ID NO: 3617 - RNA, 39 nt, Artificial Sequence
  Hepatitis C virus_NS4a
accagcacaugggugcuggucggcgggguucucgccgcu

SEQ ID NO: 3618 - RNA, 45 nt, Artificial Sequence
  Hepatitis C virus_NS4a
agcaccugggugcuggucggcgggguucucgccgcucuugcagcc

SEQ ID NO: 3619 - RNA, 30 nt, Artificial Sequence
  Hepatitis C virus_NS4a
accugggugcuggucggcgggguucucgcc

SEQ ID NO: 3620 - RNA, 60 nt, Artificial Sequence
  Hepatitis C virus_NS4a
gccgcuuacugccugagcaccggcuguguggucaucguugggagagugguacucuccgga

SEQ ID NO: 3621 - RNA, 60 nt, Artificial Sequence
  Hepatitis C virus_NS4a
gugguccugagcggcaagcccgccaucauuccugacagagagguucucuacagggaauuc

SEQ ID NO: 3622 - RNA, 45 nt, Artificial Sequence
  Hepatitis C virus_NS4a
ggcaagcccgccaucauuccugacagagaggugcuguacagggaa

SEQ ID NO: 3623 - RNA, 30 nt, Artificial Sequence
  Hepatitis C virus_NS4a
aucauucccgacagagaggugcuguacagg

SEQ ID NO: 3624 - RNA, 60 nt, Artificial Sequence
  Hepatitis C virus_NS4b
aucgcccccgcugugcagaccaacuggcaaaagcuggagacauucugggcaaaacacaug

SEQ ID NO: 3625 - RNA, 60 nt, Artificial Sequence
  Hepatitis C virus_NS4b
ggcauccaguaccuggccgggcucagcacccuucccggaaacccugcuauugcaucccug

SEQ ID NO: 3626 - RNA, 33 nt, Artificial Sequence
  Hepatitis C virus_NS4b
caguaccuggccggccucagcacccuucccggg

SEQ ID NO: 3627 - RNA, 30 nt, Artificial Sequence
  Hepatitis C virus_NS4b
uaccuggccggccucagcacccuucccggg

SEQ ID NO: 3628 - RNA, 60 nt, Artificial Sequence
  Hepatitis C virus_NS4b
cuggccggccucagcacccuucccgggaacccugcuaucgcaucccugauggccuucaca

SEQ ID NO: 3629 - RNA, 54 nt, Artificial Sequence
  Hepatitis C virus_NS4b
ggccugagcacccuccccgggaacccugccaucgcuucccuuauggcauucaca

SEQ ID NO: 3630 - RNA, 60 nt, Artificial Sequence
  Hepatitis C virus_NS4b
cugcccggcaacccugccaucgcuagccucauggcauucaccgccgcggugacaucccca

SEQ ID NO: 3631 - RNA, 33 nt, Artificial Sequence
  Hepatitis C virus_NS4b
cccgccaucgcuagccugauggcauucaccgcc

SEQ ID NO: 3632 - RNA, 30 nt, Artificial Sequence
  Hepatitis C virus_NS4b
aucgccagccugauggcuuucaccgcagcc

SEQ ID NO: 3633 - RNA, 60 nt, Artificial Sequence
  Hepatitis C virus_NS4b
cugaccacaagccagacucuccuuuucaacauccugggcggguggguggccgcucaauug

SEQ ID NO: 3634 - RNA, 45 nt, Artificial Sequence
  Hepatitis C virus_NS4b
acccagcacacacugcucuucaacauccuuggcggguggguggcc

SEQ ID NO: 3635 - RNA, 30 nt, Artificial Sequence; identical to SEQ ID NO: 3423
  Hepatitis C virus_NS4b

SEQ ID NO: 3636 - RNA, 27 nt, Artificial Sequence
  Hepatitis C virus_NS4b
uucaacauccugggcggguggguggcc

SEQ ID NO: 3637 - RNA, 36 nt, Artificial Sequence
  Hepatitis C virus_NS4b
uucaacauccugggcggguggguggccgcucagcuc

SEQ ID NO: 3638 - RNA, 45 nt, Artificial Sequence
  Hepatitis C virus_NS4b
cugggcaaggugcucgucgacauccuugccggguacggagcuggu

SEQ ID NO: 3639 - RNA, 54 nt, Artificial Sequence
  Hepatitis C virus_NS4b
aucaugagcggcgaggugcccuccaccgaagaccuggucaaccuccuuccugcc

SEQ ID NO: 3640 - RNA, 60 nt, Artificial Sequence
  Hepatitis C virus_NS4b
ggcgaggugcccagcaccgaagaccuggucaaccuccuuccugccauccuguccccaggg

SEQ ID NO: 3641 - RNA, 30 nt, Artificial Sequence
  Hepatitis C virus_NS4b
cuggugaaccuccuucccgccauccugagc

SEQ ID NO: 3642 - RNA, 21 nt, Artificial Sequence
  Hepatitis C virus_NS4b
aaccugcuccccgccauccuu

SEQ ID NO: 3643 - RNA, 60 nt, Artificial Sequence
  Hepatitis C virus_NS4b
gcccugguggucggcguugugugcgcugcaauccucagaaggcacguagggcccggagag

SEQ ID NO: 3644 - RNA, 60 nt, Artificial Sequence
  Hepatitis C virus_NS4b
ggccccggggagggagccgugcaguggaugaacagacugaucgcuuucgcaagcaggggu

SEQ ID NO: 3645 - RNA, 45 nt, Artificial Sequence
  Hepatitis C virus_NS4b
gagggcgccgugcaguggaugaacagacugaucgcuuucgcaagc

SEQ ID NO: 3646 - RNA, 60 nt, Artificial Sequence
  Hepatitis C virus_NS4b
ggcgccgugcaguggaugaacagacugaucgcuuucgcaagcagggggaaucacgucucc

SEQ ID NO: 3647 - RNA, 54 nt, Artificial Sequence
  Hepatitis C virus_NS4b
aacagacugaucgccuucgcuagcaggggcaaucacgugucccccacccauuac

SEQ ID NO: 3648 - RNA, 54 nt, Artificial Sequence
  Hepatitis C virus_NS5a
agccagcuguccgccagaucucucaaggcuaccugcacagcaaaccacgacuca

SEQ ID NO: 3649 - RNA, 45 nt, Artificial Sequence
  Hepatitis C virus_NS5a
aucgaggccaaccugcucuggagacaggaaaugggcgggaauauu

SEQ ID NO: 3650 - RNA, 42 nt, Artificial Sequence
  Hepatitis C virus_NS5a
gugagcguccccgccgagauccugagaaagaggcgguucgcu

SEQ ID NO: 3651 - RNA, 54 nt, Artificial Sequence
  Hepatitis C virus_NS5a
cccgccgagcugagaaagagcagguucgcucaggcacucccugugugggcccgg

SEQ ID NO: 3652 - RNA, 60 nt, Artificial Sequence
  Hepatitis C virus_NS5b
cugagacaccauaaccucguguacagcaccacauccaggucugccugccagcggcaaaag

SEQ ID NO: 3653 - RNA, 60 nt, Artificial Sequence
  Hepatitis C virus_NS5b
aaggugaccuucgacagacugcagguccucgauagccacuaccaagacguucuuaaagag

SEQ ID NO: 3654 - RNA, 60 nt, Artificial Sequence
  Hepatitis C virus_NS5b
agcguguggaaggaccugcucgaggauaacgucacccccaucgacacaacuauuauggcc

SEQ ID NO: 3655 - RNA, 60 nt, Artificial Sequence
  Hepatitis C virus_NS5b
aagggcgggagaaaacccgccaggcugaucguguucccugaccucggaguccggguuugc

SEQ ID NO: 3656 - RNA, 54 nt, Artificial Sequence
  Hepatitis C virus_NS5b
aagcccgccagacugaucguguucccugaccucggcgucaggguuugcgagaaa

SEQ ID NO: 3657 - RNA, 60 nt, Artificial Sequence
  Hepatitis C virus_NS5b
aagcugccccucgccgugaugggcagcuccuacggguuccaguauucuccuggacaaaga

SEQ ID NO: 3658 - RNA, 60 nt, Artificial Sequence
  Hepatitis C virus_NS5b
guggaguuccugguccaggccuggaagagcaaaaagacccccaugggcuuuuccuacgac

SEQ ID NO: 3659 - RNA, 60 nt, Artificial Sequence
  Hepatitis C virus_NS5b
agcgacaucagaaccgaggaagccauuuaccagugcugugaucuggacccccaagcuagg

SEQ ID NO: 3660 - RNA, 60 nt, Artificial Sequence
  Hepatitis C virus_NS5b
cagugcugugaccuggauccccaagccagaguggcuaucaagagccucaccgagaggcuu

SEQ ID NO: 3661 - RNA, 36 nt, Artificial Sequence
  Hepatitis C virus_NS5b
ggcuacagaaggugccgggccagcggggugcugacc

SEQ ID NO: 3662 - RNA, 42 nt, Artificial Sequence
  Hepatitis C virus_NS5b
ugcagcuccaacgugucugucgcccacgacggcgcugggaag

SEQ ID NO: 3663 - RNA, 60 nt, Artificial Sequence
  Hepatitis C virus_NS5b
agcguggcccacgacggcgcugggaagagagucuacuaucugaccagggaucccacaacu

SEQ ID NO: 3664 - RNA, 45 nt, Artificial Sequence
  Hepatitis C virus_NS5b
agagaccccaccacaccucuggccagggcugcaugggagacugcc

SEQ ID NO: 3665 - RNA, 60 nt, Artificial Sequence
  Hepatitis C virus_NS5b
aacaucauuauguucgcccccacccugugggcuagaaugauacucaugacacacuuuuuc

SEQ ID NO: 3666 - RNA, 60 nt, Artificial Sequence
  Hepatitis C virus_NS5b
gccagaaugauccugaugacccacuucuuuagcgugcucauugcuagggaccagcuugag

SEQ ID NO: 3667 - RNA, 45 nt, Artificial Sequence
  Hepatitis C virus_NS5b
cugaugauccacuucuuuagcauucucgcccaggagcaacuugaa

SEQ ID NO: 3668 - RNA, 57 nt, Artificial Sequence
  Hepatitis C virus_NS5b
aucaacagaguggccgcuugccugaggaagcucggcguccccccucuucgggcaugg

SEQ ID NO: 3669 - RNA, 42 nt, Artificial Sequence
  Hepatitis C virus_NS5b
ugcggcaaguaccuguucaacugggccgugaccaaacucaag

SEQ ID NO: 3670 - RNA, 60 nt, Artificial Sequence
  Hepatitis C virus_NS5b
ugcggcaaguaccuguucaacugggccgugagaaccaaacucaagcuuacacccaucgcu

SEQ ID NO: 3671 - RNA, 45 nt, Artificial Sequence
  Influenza A
gcccugaacaauagauuccagaucaagggcguggagcucaaaagc

SEQ ID NO: 3672 - RNA, 48 nt, Artificial Sequence
  Influenza A
ggcgcccugaacaauagauuccagaucaaggggguggagcucaaaagc

SEQ ID NO: 3673 - RNA, 45 nt, Artificial Sequence
  Measles virus_F
cugagcgagaucaagggcgugauuguccacagacucgaagggguu

SEQ ID NO: 3674 - RNA, 51 nt, Artificial Sequence
  Canine distemper virus_Fusion protein
accgccgcucagaucacagcaggcauugcccugcaccaaagcaaccucaau

SEQ ID NO: 3675 - RNA, 51 nt, Artificial Sequence
  Canine distemper virus_Fusion protein
aucggcaccgacaacgugcacuacaagauuaugacaagacccagccaucag

SEQ ID NO: 3676 - RNA, 51 nt, Artificial Sequence
  Canine distemper virus_Fusion protein
uacaagaucaugaccagacccagccaccaguaucuggugauuaaacucaua

SEQ ID NO: 3677 - RNA, 51 nt, Artificial Sequence
  Canine distemper virus_Fusion protein
agccaccaguaccuggugaucaagcucauucccaacgccucccuuauagag

SEQ ID NO: 3678 - RNA, 51 nt, Artificial Sequence
  Canine distemper virus_Fusion protein
aagcugauccccaacgccagccucauugagaauugcaccaaagcugaacuu

SEQ ID NO: 3679 - RNA, 51 nt, Artificial Sequence
  Canine distemper virus_Fusion protein
cugaucgagaacugcaccaaggccgaacucggcgaguacgaaaaacuucug

SEQ ID NO: 3680 - RNA, 51 nt, Artificial Sequence
  Canine distemper virus_Fusion protein
gccgagcugggcgaauacgagaagcuccuuaacagcgugcuggaacccauc

SEQ ID NO: 3681 - RNA, 51 nt, Artificial Sequence
  Canine distemper virus_Fusion protein
aagcugcucaacagcgugcuugagcccaucaaucaggcccugaccuugaug

SEQ ID NO: 3682 - RNA, 51 nt, Artificial Sequence
  Canine distemper virus_Fusion protein
gagcccaucaaccaggcccugacccucaugacaaagaaugugaaaccucuu

SEQ ID NO: 3683 - RNA, 51 nt, Artificial Sequence
  Canine distemper virus_Fusion protein
acccugaugacaaagaacgugaaaccccuccagagccuuggcuccgggaga

SEQ ID NO: 3684 - RNA, 51 nt, Artificial Sequence
  Canine distemper virus_Fusion protein
aagccccugcagagccucggcuccgggagaaggcaacggcgcuucgccgga

SEQ ID NO: 3685 - RNA, 51 nt, Artificial Sequence
  Canine distemper virus_Fusion protein
agcggcagaaggcagcggcgcuucgccggggugguccuggcuggaguugca

SEQ ID NO: 3686 - RNA, 51 nt, Artificial Sequence
  Canine distemper virus_Fusion protein
uucgccggcgugguccuggcugggguugcacucggaguggccaccgcggcu

SEQ ID NO: 3687 - RNA, 51 nt, Artificial Sequence
  Canine distemper virus_Fusion protein
ggcguggcccugggggucgcuaccgcagcccagaucacagcgggaauugcu

SEQ ID NO: 3688 - RNA, 51 nt, Artificial Sequence
  Canine distemper virus_Fusion protein
ggcaucgcccugcaccagagcaaccucaaugcucaagcaauucagucccuu

SEQ ID NO: 3689 - RNA, 51 nt, Artificial Sequence
  Canine distemper virus_Fusion protein
aaccugaaugcccaggcuauccaaagccucagaaccucccuugagcagucu

SEQ ID NO: 3690 - RNA, 51 nt, Artificial Sequence
  Canine distemper virus_Fusion protein
cagagccugagaaccucccucgagcaaucuaacaaggccaucgaagagauu

SEQ ID NO: 3691 - RNA, 51 nt, Artificial Sequence
  Canine distemper virus_Fusion protein
gagcagagcaacaaggccaucgaagagauuagagaagcuacccaagagaca

SEQ ID NO: 3692 - RNA, 51 nt, Artificial Sequence
  Canine distemper virus_Fusion protein
agcuccaagacccagacacacacucaacaggacagacccccucagccaucu

SEQ ID NO: 3693 - RNA, 51 nt, Artificial Sequence
  Canine distemper virus_Fusion protein
cagcccagcaccgagcuggaagagacaagaacuuccagggcccggcacucu

SEQ ID NO: 3694 - RNA, 51 nt, Artificial Sequence
  Canine distemper virus_Fusion protein
agacacagcaccacauccgcccagaggucuacucauuacgacccccggacg

SEQ ID NO: 3695 - RNA, 51 nt, Artificial Sequence
  Canine distemper virus_Fusion protein
cccagaaccagcgacaggccuguguccuacacaaugaaccggacucgcucu

SEQ ID NO: 3696 - RNA, 51 nt, Artificial Sequence
  Canine distemper virus_Fusion protein
accagaagcaggaagcagacaucccaccggcugaaaaacauccccgugcau

SEQ ID NO: 3697 - RNA, 51 nt, Artificial Sequence
  Canine distemper virus_Fusion protein
accgagcugcucagcaucuucggccccucccuuagagacccuauuucugcc

SEQ ID NO: 3698 - RNA, 51 nt, Artificial Sequence
  Canine distemper virus_Fusion protein
cccagauacaucgccaccaacggcuaucugauuagcaauuucgacgagucc

SEQ ID NO: 3699 - RNA, 51 nt, Artificial Sequence
  Canine distemper virus_Fusion protein
ugcaucagaggcgacaccagcuccugugccaggacacuggugucugggacu

SEQ ID NO: 3700 - RNA, 51 nt, Artificial Sequence
  Canine distemper virus_Fusion protein
gacgagagcuccugcguguucgucucugaaucagccaucuguagucagaac

SEQ ID NO: 3701 - RNA, 51 nt, Artificial Sequence
  Canine distemper virus_Fusion protein
accagcacaaucauuaaccagucccccgacaagcugcucacuuucauagcc

SEQ ID NO: 3702 - RNA, 51 nt, Artificial Sequence
  Canine distemper virus_Fusion protein
agccccgacaagcugcucaccuucaucgccuccgauacaugcccucuugug

SEQ ID NO: 3703 - RNA, 72 nt, Artificial Sequence
  Mucin-1
agcaccgcccccccugcucacggcgugacauccgcaccagacacuagagccccggggucuacggcgcccccu

SEQ ID NO: 3704 - RNA, 57 nt, Artificial Sequence
  Mucin-1
ggcgugaccagcgcccccgacacaagaccugcuccaggguccacugcaucuucacug

SEQ ID NO: 3705 - RNA, 54 nt, Artificial Sequence
  Mucin-1
ggcgugaccagcgcccccgacacaagaccugcuccaggguccacugcaucucug

SEQ ID NO: 3706 - RNA, 81 nt, Artificial Sequence
  Mucin-1
accgcccccccugcucacggcgugacaagcgcaccagacacuagaccggcccccggguccacggcgccuccaaagaaagga

SEQ ID NO: 3707 - RNA, 78 nt, Artificial Sequence
  Mucin-1
agcaccgcccccccugcucacggcgugacauccgcaccagacacuagaccggcccccgggucuacggcgccuccaaag

SEQ ID NO: 3708 - RNA, 12 nt, Artificial Sequence
  foot-and-mouth disease virus_VP3
ggcguggccgag

SEQ ID NO: 3709 - RNA, 30 nt, Artificial Sequence
  foot-and-mouth disease virus_VP3
accgccagcggcguggcugagacaacuaac

SEQ ID NO: 3710 - RNA, 48 nt, Artificial Sequence
  foot-and-mouth disease virus
accgccaagagcaaaaaguuccccuccuacacagcuacuuaucaguuu

SEQ ID NO: 3711 - RNA, 48 nt, Artificial Sequence
  Clostridium tetani
gcccaguacaucaaggcuaacagcaaauucauuggcauaaccgagcug

SEQ ID NO: 3712 - RNA, 48 nt, Artificial Sequence
  Human immunodeficiency virus 1_gp120 protein
aagcagaucauuaacauguggcaaguggucggcaaagccauguacgcu

SEQ ID NO: 3713 - RNA, 45 nt, Artificial Sequence
  Human immunodeficiency virus 1_gag protein
aagagauggaucauucugggccucaacaaaauagugaggauguac

SEQ ID NO: 3714 - RNA, 48 nt, Artificial Sequence
  Human immunodeficiency virus 1_envelope glycoprotein
aagcagaucauuaacauguggcaagaggugggcaaagccauguacgcu

SEQ ID NO: 3715 - RNA, 48 nt, Artificial Sequence
  Human immunodeficiency virus 1_envelope glycoprotein
aagcagaucauuaacauguggcaagccgugggcaaagcuauguacgca

SEQ ID NO: 3716 - RNA, 48 nt, Artificial Sequence; identical to SEQ ID NO: 3711
  Tetanus Toxid

SEQ ID NO: 3717 - RNA, 21 nt, Artificial Sequence
  Human papilloma virus 16_E17
gacagagcccacuacaacauc

SEQ ID NO: 3718 - RNA, 57 nt, Artificial Sequence
  Human papilloma virus 16_E17
caggccgagcccgacagagcucacuacaacaucgugaccuucugcuguaagugcgau

SEQ ID NO: 3719 - protein, 9 aa, Artificial Sequence
  Melanoma antigen recognized by T-cells 1 (27-35)
AAGIGILTV

SEQ ID NO: 3720 - protein, 9 aa, Artificial Sequence
  Eukaryotic translation initiation factor 4 gamma 1 (1073-1081)
AARPATSTL

SEQ ID NO: 3721 - protein, 11 aa, Artificial Sequence
  Histone H1.2 (49-59)
AASKERSGVSL

SEQ ID NO: 3722 - protein, 10 aa, Artificial Sequence
  Cyclin-dependent kinase 4 (23-32)
ACDPHSGHFV

SEQ ID NO: 3723 - protein, 10 aa, Artificial Sequence
  40S ribosomal protein S21 (37-46)
AEVDKVTGRF

SEQ ID NO: 3724 - protein, 9 aa, Artificial Sequence
  DNA replication licensing factor MCM4 (694-702)
AHSTIMPRL

SEQ ID NO: 3725 - protein, 9 aa, Artificial Sequence
  Actin, gamma-enteric smooth muscle (277-285)
ALAPSTMKI

SEQ ID NO: 3726 - protein, 10 aa, Artificial Sequence
  Melanocyte protein PMEL (231-240)
ALDGGNKHFL

SEQ ID NO: 3727 - protein, 9 aa, Artificial Sequence
  Phospholipid transfer protein (2-10)
ALFGALFLA

SEQ ID NO: 3728 - protein, 9 aa, Artificial Sequence
  Vimentin (332-340)
ALKGTNESL

SEQ ID NO: 3729 - protein, 9 aa, Artificial Sequence
  Eukaryotic translation initiation factor 3 subunit D (439-447)
ALLAGSEYL

SEQ ID NO: 3730 - protein, 9 aa, Artificial Sequence
  Melanocyte protein PMEL (24-32)
ALLAVGATK

SEQ ID NO: 3731 - protein, 9 aa, Artificial Sequence
  Melanoma antigen recognized by T-cells 1 (56-64)
ALMDKSLHV

SEQ ID NO: 3732 - protein, 9 aa, Artificial Sequence
  Melanocyte protein PMEL (94-102)
ALNFPGSQK

SEQ ID NO: 3733 - protein, 9 aa, Artificial Sequence
  Melanoma-associated antigen 1 (301-309)
ALREEEEGV

SEQ ID NO: 3734 - protein, 9 aa, Artificial Sequence
  Fructose-bisphosphate aldolase A (98-106)
ALSDHHIYL

SEQ ID NO: 3735 - protein, 12 aa, Artificial Sequence
  Guanine nucleotide-binding protein G(I)/G(S)/G(T) subunit beta-2 (167-178)
ALWDIETGQQTV

SEQ ID NO: 3736 - protein, 9 aa, Artificial Sequence
  ER membrane protein complex subunit 7 (4-12)
ALWGFFPVL

SEQ ID NO: 3737 - protein, 10 aa, Artificial Sequence
  Melanocyte protein PMEL (184-193)
AMLGTHTMEV

SEQ ID NO: 3738 - protein, 9 aa, Artificial Sequence
  Actin, cytoplasmic 1 (14-22)
APEEHPVLL

SEQ ID NO: 3739 - protein, 9 aa, Artificial Sequence
  High mobility group protein B1 (94-102)
APKRPPSAF

SEQ ID NO: 3740 - protein, 9 aa, Artificial Sequence
  Coiled-coil-helix-coiled-coil-helix domain-containing protein 2 (49-57)
APRQPGLMA

SEQ ID NO: 3741 - protein, 9 aa, Artificial Sequence
  HLA class II histocompatibility antigen, DP beta 1 chain (9-17)
APRTVALTA

SEQ ID NO: 3742 - protein, 9 aa, Artificial Sequence
  60S ribosomal protein L13 (189-197)
ARLFGIRAK

SEQ ID NO: 3743 - protein, 9 aa, Artificial Sequence
  Thymosin beta-10 (16-24)
ASFDKAKLK

SEQ ID NO: 3744 - protein, 9 aa, Artificial Sequence
  Guanine nucleotide-binding protein G(s) subunit alpha isoforms short (239-247)
ASSSYNMVI

SEQ ID NO: 3745 - protein, 8 aa, Artificial Sequence
  Guanine nucleotide-binding protein subunit beta-2-like 1 (251-258)
ATGPSIKI

SEQ ID NO: 3746 - protein, 9 aa, Artificial Sequence
  Bax inhibitor 1 (91-99)
AYVHMVTHF

SEQ ID NO: 3747 - protein, 9 aa, Artificial Sequence
  Wilms tumor protein (235-243)
CMTWNQMNL

SEQ ID NO: 3748 - protein, 9 aa, Artificial Sequence
  Melanocyte protein PMEL (647-655)
CPIGENSPL

SEQ ID NO: 3749 - protein, 16 aa, Artificial Sequence
  Gamma-secretase C-terminal fragment 59 (562-577)
DAEFRHDSGYEVHHQK

SEQ ID NO: 3750 - protein, 17 aa, Artificial Sequence
  Gamma-secretase C-terminal fragment 59 (562-578)
DAEFRHDSGYEVHHQKL

SEQ ID NO: 3751 - protein, 9 aa, Artificial Sequence
  Thymidylate synthase (254-262)
DAHIYLNHI

SEQ ID NO: 3752 - protein, 9 aa, Artificial Sequence
  60S ribosomal protein L10 (28-36)
DAKIRIFDL

SEQ ID NO: 3753 - protein, 9 aa, Artificial Sequence
  Lys-63-specific deubiquitinase BRCC36 (221-229)
DAYRRIHSL

SEQ ID NO: 3754 - protein, 9 aa, Artificial Sequence
  Myelin basic protein (109-117)
DENPVVHFF

SEQ ID NO: 3755 - protein, 9 aa, Artificial Sequence
  Vimentin (219-227)
DLERKVESL

SEQ ID NO: 3756 - protein, 15 aa, Artificial Sequence
  HLA class I histocompatibility antigen, A-2 alpha chain (29-43)
DTQFVRFDSDAASQR

SEQ ID NO: 3757 - protein, 18 aa, Artificial Sequence
  HLA class I histocompatibility antigen, A-2 alpha chain (29-46)
DTQFVRFDSDAASQRMEP

SEQ ID NO: 3758 - protein, 10 aa, Artificial Sequence
  Melanoma antigen recognized by T-cells 1 (26-35)
EAAGIGILTV

SEQ ID NO: 3759 - protein, 9 aa, Artificial Sequence
  Melanoma-associated antigen 1 (161-169)
EADPTGHSY

SEQ ID NO: 3760 - protein, 9 aa, Artificial Sequence
  Ragulator complex protein LAMTOR5 (40-48)
EHAGVISVL

SEQ ID NO: 3761 - protein, 10 aa, Artificial Sequence
  Mart-1 (26-35)
ELAGIGILTV

SEQ ID NO: 3762 - protein, 9 aa, Artificial Sequence
  40S ribosomal protein S25 (75-83)
ERLKIRGSL

SEQ ID NO: 3763 - protein, 9 aa, Artificial Sequence
  Actin, cytoplasmic 1 (364-372)
ESGPSIVHR

SEQ ID NO: 3764 - protein, 9 aa, Artificial Sequence
  POTE ankyrin domain family member F (825-833)
ETFNTPAMY

SEQ ID NO: 3765 - protein, 10 aa, Artificial Sequence
  Mortality factor 4-like protein 1 (312-321)
EVAPPEYHRK

SEQ ID NO: 3766 - protein, 9 aa, Artificial Sequence
  Melanoma-associated antigen 3 (168-176)
EVDPIGHLY

SEQ ID NO: 3767 - protein, 9 aa, Artificial Sequence
  Heme oxygenase 1 (103-111)
EVIPYTPAM

SEQ ID NO: 3768 - protein, 9 aa, Artificial Sequence
  G2/mitotic-specific cyclin-B1 (18-26)
FAFVTDNTY

SEQ ID NO: 3769 - protein, 9 aa, Artificial Sequence
  Proteasome subunit alpha type-5 (154-162)
FHMDPSGTF

SEQ ID NO: 3770 - protein, 9 aa, Artificial Sequence
  Protein THEMIS2 (597-605)
FIKDGSSTY

SEQ ID NO: 3771 - protein, 10 aa, Artificial Sequence
  Vimentin (123-132)
FLEQQNKILL

SEQ ID NO: 3772 - protein, 10 aa, Artificial Sequence
  Fatty acid synthase (2335-2344)
FLFDGSPTYV

SEQ ID NO: 3773 - protein, 11 aa, Artificial Sequence
  Fatty acid synthase (2335-2345)
FLFDGSPTYVL

SEQ ID NO: 3774 - protein, 9 aa, Artificial Sequence
  Mammaglobin-A (66-74)
FLNQTDETL

SEQ ID NO: 3775 - protein, 9 aa, Artificial Sequence
  Melanoma-associated antigen 3 (271-279)
FLWGPRALV

SEQ ID NO: 3776 - protein, 9 aa, Artificial Sequence
  Actin-related protein 2 (27-35)
FPEHIFPAL

SEQ ID NO: 3777 - protein, 9 aa, Artificial Sequence
  60S ribosomal protein L28 (38-46)
FRYNGLIHR

SEQ ID NO: 3778 - protein, 9 aa, Artificial Sequence
  60S acidic ribosomal protein P0 (67-75)
GHLENNPAL

SEQ ID NO: 3779 - protein, 11 aa, Artificial Sequence
  Cellular tumor antigen p53 (62-72)
GLAPPQHLIRV

SEQ ID NO: 3780 - protein, 9 aa, Artificial Sequence
  Proteasome subunit beta type-3 (55-63)
GLATDVQTV

SEQ ID NO: 3781 - protein, 9 aa, Artificial Sequence
  DNA (cytosine-5)-methyltransferase 1 (425-433)
GLIEKNIEL

SEQ ID NO: 3782 - protein, 9 aa, Artificial Sequence
  Catenin beta-1 (400-408)
GLLGTLVQL

SEQ ID NO: 3783 - protein, 9 aa, Artificial Sequence
  Myosin-9 (338-346)
GLLRVISGV

SEQ ID NO: 3784 - protein, 10 aa, Artificial Sequence
  Reticulocalbin-2 (4-13)
GPRTAALGLL

SEQ ID NO: 3785 - protein, 10 aa, Artificial Sequence
  Heterogeneous nuclear ribonucleoprotein A1 (339-348)
GPYGGGGQYF

SEQ ID NO: 3786 - protein, 9 aa, Artificial Sequence
  60S ribosomal protein L8 (127-135)
GRIDKPILK

SEQ ID NO: 3787 - protein, 9 aa, Artificial Sequence
  Cellular tumor antigen p53 (5-13)
GRNSFEVRV

SEQ ID NO: 3788 - protein, 10 aa, Artificial Sequence
  Ribonucleoside-diphosphate reductase subunit M2 (238-247)
GSFASIFWLK

SEQ ID NO: 3789 - protein, 9 aa, Artificial Sequence
  Melanocyte protein PMEL (467-475)
GTATLRLVK

SEQ ID NO: 3790 - protein, 10 aa, Artificial Sequence
  Melanoma-associated antigen B2 (231-240)
GVYDGEEHSV

SEQ ID NO: 3791 - protein, 9 aa, Artificial Sequence
  Protein SSX2 (17-25)
GYDQIMPKK

SEQ ID NO: 3792 - protein, 9 aa, Artificial Sequence
  Proliferating cell nuclear antigen (241-249)
IADMGHLKY

SEQ ID NO: 3793 - protein, 9 aa, Artificial Sequence
  Receptor tyrosine-protein kinase erbB-2 (654-662)
IISAVVGIL

SEQ ID NO: 3794 - protein, 9 aa, Artificial Sequence
  Heat shock protein HSP 90-beta (496-504)
ILDKKVEKV

SEQ ID NO: 3795 - protein, 9 aa, Artificial Sequence
  Ornithine decarboxylase (23-31)
ILDQKINEV

SEQ ID NO: 3796 - protein, 9 aa, Artificial Sequence
  Ubiquitin-conjugating enzyme E2 E3 (97-105)
ILGPPGSVY

SEQ ID NO: 3797 - protein, 9 aa, Artificial Sequence
  Vimentin (130-138)
ILLAELEQL

SEQ ID NO: 3798 - protein, 9 aa, Artificial Sequence
  60S ribosomal protein L19 (137-145)
ILMEHIHKL

SEQ ID NO: 3799 - protein, 9 aa, Artificial Sequence
  Small nuclear ribonucleoprotein-associated proteins B and B' (13-21)
ILQDGRIFI

SEQ ID NO: 3800 - protein, 9 aa, Artificial Sequence
  Elongation factor 2 (161-169)
ILTDITKGV

SEQ ID NO: 3801 - protein, 9 aa, Artificial Sequence
  Melanoma antigen recognized by T-cells 1 (32-40)
ILTVILGVL

SEQ ID NO: 3802 - protein, 9 aa, Artificial Sequence
  Putative small nuclear ribonucleoprotein G-like protein 15 (68-76)
IMLEALERV

SEQ ID NO: 3803 - protein, 9 aa, Artificial Sequence
  Serine-tRNA ligase, cytoplasmic (357-365)
IPYHIVNIV

SEQ ID NO: 3804 - protein, 16 aa, Artificial Sequence
  Beta-2-microglobulin (21-36)
IQRTPKIQVYSRHPAE

SEQ ID NO: 3805 - protein, 9 aa, Artificial Sequence
  ADP/ATP translocase 2 (79-87)
IRYFPTQAL

SEQ ID NO: 3806 - protein, 9 aa, Artificial Sequence
  Acyl-CoA desaturase (20-28)
ITAPPSRVL

SEQ ID NO: 3807 - protein, 9 aa, Artificial Sequence
  Melanocyte protein PMEL (216-224)
ITDQVPFSV

SEQ ID NO: 3808 - protein, 9 aa, Artificial Sequence
  Ubiquitin-60S ribosomal protein L40 (68-76)
KESTLHLVL

SEQ ID NO: 3809 - protein, 18 aa, Artificial Sequence
  Receptor tyrosine-protein kinase erbB-2 (369-386)
KIFGSLAFLPESFDGDPA

SEQ ID NO: 3810 - protein, 15 aa, Artificial Sequence
  Protein SSX2 (45-59)
KIFYVYMKRKYEAMT

SEQ ID NO: 3811 - protein, 10 aa, Artificial Sequence
  Vimentin (236-245)
KLHEEEIQEL

SEQ ID NO: 3812 - protein, 9 aa, Artificial Sequence
  Myosin-9 (1843-1851)
KLKDVLLQV

SEQ ID NO: 3813 - protein, 10 aa, Artificial Sequence
  Prelamin-A/C (297-306)
KLLEGEEERL

SEQ ID NO: 3814 - protein, 9 aa, Artificial Sequence
  Mammaglobin-A (2-10)
KLLMVLMLA

SEQ ID NO: 3815 - protein, 9 aa, Artificial Sequence
  Heat shock cognate 71 kDa protein (126-134)
KMKEIAEAY

SEQ ID NO: 3816 - protein, 9 aa, Artificial Sequence
  Melanoma-associated antigen 2 (140-148)
KMVELVHFL

SEQ ID NO: 3817 - protein, 9 aa, Artificial Sequence
  Beta-adrenergic receptor kinase 1 (667-675)
KPRSPVVEL

SEQ ID NO: 3818 - protein, 9 aa, Artificial Sequence
  Farnesyl pyrophosphate synthase (184-192)
KRYKSIVKY

SEQ ID NO: 3819 - protein, 9 aa, Artificial Sequence
  Cellular tumor antigen p53 (139-147)
KTCPVQLWV

SEQ ID NO: 3820 - protein, 9 aa, Artificial Sequence
  40S ribosomal protein S8 (75-83)
KTRIIDVVY

SEQ ID NO: 3821 - protein, 9 aa, Artificial Sequence
  Melanocyte protein PMEL (161-169)
KTWGQYWQV

SEQ ID NO: 3822 - protein, 9 aa, Artificial Sequence
  Melanoma-associated antigen 1 (278-286)
KVLEYVIKV

SEQ ID NO: 3823 - protein, 9 aa, Artificial Sequence
  Glutamate carboxypeptidase 2 (298-306)
KYADKIYSI

SEQ ID NO: 3824 - protein, 9 aa, Artificial Sequence
  Serine/threonine-protein phosphatase PP1-beta catalytic subunit (112-120)
KYPENFFLL

SEQ ID NO: 3825 - protein, 10 aa, Artificial Sequence
  Mammaglobin-A (83-92)
LIYDSSLCDL

SEQ ID NO: 3826 - protein, 9 aa, Artificial Sequence
  ATP-binding cassette sub-family F member 2 (251-259)
LLDEPTNHL

SEQ ID NO: 3827 - protein, 9 aa, Artificial Sequence
  Gamma-interferon-inducible lysosomal thiol reductase (24-32)
LLDVPTAAV

SEQ ID NO: 3828 - protein, 9 aa, Artificial Sequence
  Cellular tumor antigen p53 (264-272)
LLGRNSFEV

SEQ ID NO: 3829 - protein, 10 aa, Artificial Sequence
  Gamma-interferon-inducible lysosomal thiol reductase (23-32)
LLLDVPTAAV

SEQ ID NO: 3830 - protein, 12 aa, Artificial Sequence
  Gamma-interferon-inducible lysosomal thiol reductase (15-26)
LLLDVPTAAVQA

SEQ ID NO: 3831 - protein, 10 aa, Artificial Sequence
  Stress-70 protein, mitochondrial (436-445)
LLLDVTPLSL

SEQ ID NO: 3832 - protein, 9 aa, Artificial Sequence
  Mucin-1 (12-20)
LLLLTVLTV

SEQ ID NO: 3833 - protein, 9 aa, Artificial Sequence
  Mammaglobin-A (4-12)
LMVLMLAAL

SEQ ID NO: 3834 - protein, 9 aa, Artificial Sequence
  Melanocyte protein PMEL (527-535)
LPKEACMEI

SEQ ID NO: 3835 - protein, 9 aa, Artificial Sequence
  Rac GTPase-activating protein 1 (403-411)
LPQANRDTL

SEQ ID NO: 3836 - protein, 9 aa, Artificial Sequence
  Catenin beta-1 (370-378)
LTDPSQRLV

SEQ ID NO: 3837 - protein, 9 aa, Artificial Sequence
  HLA class I histocompatibility antigen, B-39 alpha chain (2-10)
LVMAPRTVL

SEQ ID NO: 3838 - protein, 9 aa, Artificial Sequence
  40S ribosomal protein S16 (40-48)
MIEPRTLQY

SEQ ID NO: 3839 - protein, 9 aa, Artificial Sequence
  Melanocyte protein PMEL (185-193)
MLGTHTMEV

SEQ ID NO: 3840 - protein, 9 aa, Artificial Sequence
  Tyrosinase (1-9)
MLLAVLYCL

SEQ ID NO: 3841 - protein, 9 aa, Artificial Sequence
  HLA class I histocompatibility antigen, alpha chain E (1-9)
MVDGTLLLL

SEQ ID NO: 3842 - protein, 9 aa, Artificial Sequence
  Vimentin (177-185)
NLAEDIMRL

SEQ ID NO: 3843 - protein, 9 aa, Artificial Sequence
  Bifunctional purine biosynthesis protein PURH (101-109)
NLYPFVKTV

SEQ ID NO: 3844 - protein, 16 aa, Artificial Sequence
  Transferrin receptor protein 1 (215-230)
NPGGYVAYSKAATVTG

SEQ ID NO: 3845 - protein, 18 aa, Artificial Sequence
  Transferrin receptor protein 1 (215-232)
NPGGYVAYSKAATVTGKL

SEQ ID NO: 3846 - protein, 10 aa, Artificial Sequence
  ELAV-like protein 1 (186-195)
NPNQNKNVAL

SEQ ID NO: 3847 - protein, 9 aa, Artificial Sequence
  U1 small nuclear ribonucleoprotein A (229-237)
NQFPGFKEV

SEQ ID NO: 3848 - protein, 15 aa, Artificial Sequence
  Heat shock 70 kDa protein 1-like (170-184)
NVLRIINEPTAAAIA

SEQ ID NO: 3849 - protein, 15 aa, Artificial Sequence
  HLA class II histocompatibility antigen, DR alpha chain (52-66)
QGALANIAVDKANLE

SEQ ID NO: 3850 - protein, 9 aa, Artificial Sequence
  Myosin-9 (478-486)
QLFNHTMFI

SEQ ID NO: 3851 - protein, 9 aa, Artificial Sequence
  Myosin-9 (163-171)
QLMAEKLQL

SEQ ID NO: 3852 - protein, 9 aa, Artificial Sequence
  T-complex protein 1 subunit alpha (187-195)
QPRYPVNSV

SEQ ID NO: 3853 - protein, 10 aa, Artificial Sequence
  Carcinoembryonic antigen-related cell adhesion molecule 5 (268-277)
QYSWFVNGTF

SEQ ID NO: 3854 - protein, 9 aa, Artificial Sequence
  Histone H2AX (78-86)
RIIPRHLQL

SEQ ID NO: 3855 - protein, 9 aa, Artificial Sequence
  Lamin-B1 (42-50)
RLAVYIDKV

SEQ ID NO: 3856 - protein, 9 aa, Artificial Sequence
  Prelamin-A/C (41-49)
RLAVYIDRV

SEQ ID NO: 3857 - protein, 9 aa, Artificial Sequence
  Melanocyte protein PMEL (626-634)
RLMKQDFSV

SEQ ID NO: 3858 - protein, 9 aa, Artificial Sequence
  60S acidic ribosomal protein P2 (38-46)
RLNKVISEL

SEQ ID NO: 3859 - protein, 9 aa, Artificial Sequence
  Vimentin (69-77)
RLRSSVPGV

SEQ ID NO: 3860 - protein, 9 aa, Artificial Sequence
  Wilms tumor protein (126-134)
RMFPNAPYL

SEQ ID NO: 3861 - protein, 9 aa, Artificial Sequence
  Histone deacetylase 2 variant (122-130)
RMLPHAPGV

SEQ ID NO: 3862 - protein, 9 aa, Artificial Sequence
  Cellular tumor antigen p53 (65-73)
RMPEAAPPV

SEQ ID NO: 3863 - protein, 9 aa, Artificial Sequence
  Actin, cytoplasmic 2 (103-111)
RMQKEITAL

SEQ ID NO: 3864 - protein, 23 aa, Artificial Sequence
  Melanoma antigen recognized by T-cells 1 (51-73)
RNGYRALMDKSLHVGTQCALTRR

SEQ ID NO: 3865 - protein, 9 aa, Artificial Sequence
  B-lymphocyte antigen CD20 (222-230)
RPKSNIVLL

SEQ ID NO: 3866 - protein, 9 aa, Artificial Sequence
  Actin, aortic smooth muscle (39-47)
RPRHQGVMV

SEQ ID NO: 3867 - protein, 9 aa, Artificial Sequence
  Probable global transcription activator SNF2L2 (261-269)
RPSGPGPEL

SEQ ID NO: 3868 - protein, 9 aa, Artificial Sequence
  Myotubularin-related protein 5 (644-652)
RPYSNVSNL

SEQ ID NO: 3869 - protein, 9 aa, Artificial Sequence
  Proteasome subunit beta type-1 (127-135)
RRFFPYYVY

SEQ ID NO: 3870 - protein, 9 aa, Artificial Sequence
  60S ribosomal protein L7a (110-118)
RRHWGGNVL

SEQ ID NO: 3871 - protein, 9 aa, Artificial Sequence
  Histone H3.3 (53-61)
RRYQKSTEL

SEQ ID NO: 3872 - protein, 9 aa, Artificial Sequence
  60S ribosomal protein L24 (23-31)
RTDGKVFQF

SEQ ID NO: 3873 - protein, 9 aa, Artificial Sequence
  40S ribosomal protein S3 (54-62)
RTQNVLGEK

SEQ ID NO: 3874 - protein, 9 aa, Artificial Sequence
  HLA class I histocompatibility antigen, Cw-7 alpha chain (2-10)
RVMAPRALL

SEQ ID NO: 3875 - protein, 10 aa, Artificial Sequence
  HLA class I histocompatibility antigen, B-15 alpha chain (194-203)
RYLENGKETL

SEQ ID NO: 3876 - protein, 9 aa, Artificial Sequence
  Serine/threonine-protein kinase Sgk1 (208-216)
SALGYLHSL

SEQ ID NO: 3877 - protein, 9 aa, Artificial Sequence
  Tyrosinase (192-200)
SEIWRDIDF

SEQ ID NO: 3878 - protein, 9 aa, Artificial Sequence
  Serine/threonine-protein phosphatase PP1-alpha catalytic subunit (10-18)
SIIGRLLEV

SEQ ID NO: 3879 - protein, 10 aa, Artificial Sequence
  Melanocyte protein PMEL (577-586)
SLADTNSLAV

SEQ ID NO: 3880 - protein, 9 aa, Artificial Sequence
  Heterogeneous nuclear ribonucleoprotein K (154-162)
SLAGGIIGV

SEQ ID NO: 3881 - protein, 9 aa, Artificial Sequence
  L-dopachrome tautomerase (288-296)
SLDDYNHLV

SEQ ID NO: 3882 - protein, 9 aa, Artificial Sequence
  Protein flightless-1 homolog (1009-1017)
SLFPGKLEV

SEQ ID NO: 3883 - protein, 9 aa, Artificial Sequence
  Dual specificity protein phosphatase 5 (337-345)
SLIGHLQTL

SEQ ID NO: 3884 - protein, 10 aa, Artificial Sequence
  TSC22 domain family protein 3 (27-36)
SLLGGDVVSV

SEQ ID NO: 3885 - protein, 9 aa, Artificial Sequence
  Cancer/testis antigen 1 (157-165)
SLLMWITQC

SEQ ID NO: 3886 - protein, 9 aa, Artificial Sequence
  Serine/threonine-protein phosphatase 2A 65 kDa regulatory subunit A alpha isoform (403-411)
SLLPAIVEL

SEQ ID NO: 3887 - protein, 11 aa, Artificial Sequence
  Protein transport protein Sec23B (138-148)
SLLPPDALVGL

SEQ ID NO: 3888 - protein, 11 aa, Artificial Sequence
  Protein transport protein Sec23A (156-166)
SLLPPTALVGL

SEQ ID NO: 3889 - protein, 9 aa, Artificial Sequence
  Vimentin (226-234)
SLQEEIAFL

SEQ ID NO: 3890 - protein, 9 aa, Artificial Sequence
  CD59oprotein (106-114)
SLSEKTVLL

SEQ ID NO: 3891 - protein, 9 aa, Artificial Sequence
  Collagen alpha-5(IV) chain (18-26)
SLWGQPAEA

SEQ ID NO: 3892 - protein, 9 aa, Artificial Sequence
  AT-rich interactive domain-containing protein 3A (372-380)
SPKLPVSSL

SEQ ID NO: 3893 - protein, 11 aa, Artificial Sequence
  Polypyrimidine tract-binding protein 1 (141-151)
SPNQARAQAAL

SEQ ID NO: 3894 - protein, 9 aa, Artificial Sequence
  Spermine synthase (128-136)
SPYQNIKIL

SEQ ID NO: 3895 - protein, 9 aa, Artificial Sequence
  Eukaryotic translation initiation factor 3 subunit D (61-69)
SQFGGGSQY

SEQ ID NO: 3896 - protein, 9 aa, Artificial Sequence
  Ornithine decarboxylase (180-188)
SSEQTFMYY

SEQ ID NO: 3897 - protein, 9 aa, Artificial Sequence
  Glutamine-fructose-6-phosphate aminotransferase (isomerizing) 1 (95-103)
STDHIPILY

SEQ ID NO: 3898 - protein, 10 aa, Artificial Sequence
  Cellular tumor antigen p53 (149-157)
STPPPGATRV

SEQ ID NO: 3899 - protein, 9 aa, Artificial Sequence
  Eukaryotic translation initiation factor 3 subunit L (226-234)
SVLNVLHSL

SEQ ID NO: 3900 - protein, 9 aa, Artificial Sequence
  L-dopachrome tautomerase (180-188)
SVYDFFVWL

SEQ ID NO: 3901 - protein, 9 aa, Artificial Sequence
  Mammaglobin-A (32-40)
TINPQVSKT

SEQ ID NO: 3902 - protein, 9 aa, Artificial Sequence
  L-dopachrome tautomerase (360-368)
TLDSQVMSL

SEQ ID NO: 3903 - protein, 9 aa, Artificial Sequence
  Protein BTG2 (101-109)
TLWVDPYEV

SEQ ID NO: 3904 - protein, 9 aa, Artificial Sequence
  DNA-directed RNA polymerase II subunit RPB1 (527-535)
TPQSNRPVM

SEQ ID NO: 3905 - protein, 11 aa, Artificial Sequence
  Heat shock cognate 71 kDa protein (22-32)
TVFDAKRLIGR

SEQ ID NO: 3906 - protein, 9 aa, Artificial Sequence
  Carcinoembryonic antigen-related cell adhesion molecule 5 (652-660)
TYACFVSNL

SEQ ID NO: 3907 - protein, 9 aa, Artificial Sequence
  Receptor tyrosine-protein kinase erbB-2 (63-71)
TYLPTNASL

SEQ ID NO: 3908 - protein, 8 aa, Artificial Sequence
  Serine/threonine-protein phosphatase 2A 65 kDa regulatory subunit A alpha isoform (263-270)
VADKFTEL

SEQ ID NO: 3909 - protein, 9 aa, Artificial Sequence
  Actin, cytoplasmic 2 (76-84)
VALDFEQEM

SEQ ID NO: 3910 - protein, 17 aa, Artificial Sequence
  HLA class I histocompatibility antigen, A-2 alpha chain (27-43)
VDDTQFVRFDSDAASQR

SEQ ID NO: 3911 - protein, 19 aa, Artificial Sequence
  HLA class I histocompatibility antigen, A-2 alpha chain (27-45)
VDDTQFVRFDSDAASQRME

SEQ ID NO: 3912 - protein, 20 aa, Artificial Sequence
  HLA class I histocompatibility antigen, A-2 alpha chain (27-46)
VDDTQFVRFDSDAASQRMEP

SEQ ID NO: 3913 - protein, 21 aa, Artificial Sequence
  HLA class I histocompatibility antigen, A-2 alpha chain (27-47)
VDDTQFVRFDSDAASQRMEPR

SEQ ID NO: 3914 - protein, 9 aa, Artificial Sequence
  Myeloblastin (169-177)
VLQELNVTV

SEQ ID NO: 3915 - protein, 10 aa, Artificial Sequence
  Melanocyte protein PMEL (483-492)
VLYRYGSFSV

SEQ ID NO: 3916 - protein, 9 aa, Artificial Sequence
  HLA class I histocompatibility antigen, Cw-3 alpha chain (3-11)
VMAPRTLIL

SEQ ID NO: 3917 - protein, 9 aa, Artificial Sequence
  HLA class I histocompatibility antigen, A-2 alpha chain (3-11)
VMAPRTLVL

SEQ ID NO: 3918 - protein, 9 aa, Artificial Sequence
  Importin subunit alpha-5 (434-442)
VMDSKIVQV

SEQ ID NO: 3919 - protein, 9 aa, Artificial Sequence
  60S acidic ribosomal protein P2 (65-73)
VPAGGAVAV

SEQ ID NO: 3920 - protein, 12 aa, Artificial Sequence
  rRNA 2'-O-methyltransferase fibrillarin (174-185)
VSDIVGPDGLVY

SEQ ID NO: 3921 - protein, 15 aa, Artificial Sequence
  Beta-2-microglobulin (84-98)
VTLSQPKIVKWDRDM

SEQ ID NO: 3922 - protein, 9 aa, Artificial Sequence
  L-dopachrome tautomerase (82-90)
VVMGTLVAL

SEQ ID NO: 3923 - protein, 20 aa, Artificial Sequence
  Cancer/testis antigen 1 (161-180)
WITQCFLPVFLAQPPSGQRR

SEQ ID NO: 3924 - protein, 16 aa, Artificial Sequence
  Melanocyte protein PMEL (44-59)
WNRQLYPEWTEAQRLD

SEQ ID NO: 3925 - protein, 9 aa, Artificial Sequence
  Elongation factor 2 (265-273)
YFDPANGKF

SEQ ID NO: 3926 - protein, 9 aa, Artificial Sequence
  Cyclin-A2 (178-186)
YHEDIHTYL

SEQ ID NO: 3927 - protein, 9 aa, Artificial Sequence
  DNA (cytosine-5)-methyltransferase 1 (254-262)
YLDDPDLKY

SEQ ID NO: 3928 - protein, 9 aa, Artificial Sequence
  Melanocyte protein PMEL (280-288)
YLEPGPVTA

SEQ ID NO: 3929 - protein, 9 aa, Artificial Sequence
  Myosin-9 (260-268)
YLLEKSRAI

SEQ ID NO: 3930 - protein, 9 aa, Artificial Sequence
  Probable ATP-dependent RNA helicase DDX5 (148-156)
YLLPAIVHI

SEQ ID NO: 3931 - protein, 9 aa, Artificial Sequence
  Carcinoembryonic antigen-related cell adhesion molecule 5 (605-613)
YLSGANLNL

SEQ ID NO: 3932 - protein, 9 aa, Artificial Sequence
  Myosin-9 (9-17)
YLYVDKNFI

SEQ ID NO: 3933 - protein, 9 aa, Artificial Sequence
  Tyrosinase (369-377)
YMDGTMSQV

SEQ ID NO: 3934 - protein, 9 aa, Artificial Sequence
  Tyrosinase (369-377)
YMNGTMSQV

SEQ ID NO: 3935 - protein, 9 aa, Artificial Sequence
  Cellular tumor antigen p53 (103-111)
YQGSYGFRL

SEQ ID NO: 3936 - protein, 12 aa, Artificial Sequence
  Cytochrome c oxidase subunit 2 (110-121)
YTDYGGLIFNSY

SEQ ID NO: 3937 - protein, 9 aa, Artificial Sequence
  HLA class I histocompatibility antigen, Cw-7 alpha chain (12-20)
FAYDGKDYI

SEQ ID NO: 3938 - protein, 9 aa, Artificial Sequence
  HLA class I histocompatibility antigen, alpha chain E (137-145)
FAYDGKDYL

SEQ ID NO: 3939 - protein, 9 aa, Artificial Sequence
  IST1 homolog (326-334)
FVLPELPSV

SEQ ID NO: 3940 - protein, 10 aa, Artificial Sequence
  60S ribosomal protein L35 (19-28)
KQLDDLKVEL

SEQ ID NO: 3941 - protein, 15 aa, Artificial Sequence
  Triosephosphate isomerase (23-37)
GELIGTLNAAKVPAD

SEQ ID NO: 3942 - protein, 14 aa, Artificial Sequence
  HLA class II histocompatibility antigen, DR alpha chain (40-53)
LEEFGRFASFEAQG

SEQ ID NO: 3943 - protein, 9 aa, Artificial Sequence
  Sorting nexin-5 (257-265)
EEPTVIKKY

SEQ ID NO: 3944 - protein, 10 aa, Artificial Sequence
  Melanoma-associated antigen 4 (230-239)
GVYDGREHTV

SEQ ID NO: 3945 - protein, 9 aa, Artificial Sequence
  HLA class I histocompatibility antigen, B-39 alpha chain (3-11)
VMAPRTVLL

SEQ ID NO: 3946 - protein, 9 aa, Artificial Sequence
  Ubiquilin-4 (442-450)
NPRAMQALL

SEQ ID NO: 3947 - protein, 9 aa, Artificial Sequence
  HLA class I histocompatibility antigen, Cw-7 alpha chain (3-11)
VMAPRALLL

SEQ ID NO: 3948 - protein, 15 aa, Artificial Sequence
  Gamma-secretase C-terminal fragment 59 (562-576)
DAEFRHDSGYEVHHQ

SEQ ID NO: 3949 - protein, 10 aa, Artificial Sequence
  Gamma-secretase C-terminal fragment 59 (565-574)
FRHDSGYEVH

SEQ ID NO: 3950 - protein, 9 aa, Artificial Sequence
  HLA class I histocompatibility antigen, Cw-2 alpha chain (3-11)
VMAPRTLLL

SEQ ID NO: 3951 - protein, 13 aa, Artificial Sequence
  Gamma-secretase C-terminal fragment 59 (562-574)
DAEFRHDSGYEVH

SEQ ID NO: 3952 - protein, 8 aa, Artificial Sequence
  Beta-2-microglobulin (91-98)
IVKWDRDM

SEQ ID NO: 3953 - protein, 14 aa, Artificial Sequence
  HLA class II histocompatibility antigen, DR alpha chain (50-63)
EAQGALANIAVDKA

SEQ ID NO: 3954 - protein, 15 aa, Artificial Sequence
  Interferon-induced transmembrane protein 1 (69-83)
VGDVTGAQAYASTAK

SEQ ID NO: 3955 - protein, 15 aa, Artificial Sequence
  Gamma-secretase C-terminal fragment 59 (560-574)
FAEDVGSNKGAIIGL

SEQ ID NO: 3956 - protein, 11 aa, Artificial Sequence
  Amyloid beta A4 protein (20-30)
FAEDVGSNKGA

SEQ ID NO: 3957 - protein, 9 aa, Artificial Sequence
  Heat shock 70 kDa protein 1-like (395-403)
LLDVAPLSL

SEQ ID NO: 3958 - protein, 9 aa, Artificial Sequence
  Heat shock 70 kDa protein 1B (391-399)
LLLLDVAPL

SEQ ID NO: 3959 - protein, 16 aa, Artificial Sequence
  HLA class I histocompatibility antigen, B-15 alpha chain (53-68)
DDTQFVRFDSDAASPR

SEQ ID NO: 3960 - protein, 16 aa, Artificial Sequence
  HLA class I histocompatibility antigen, Cw-7 alpha chain (153-168)
DLRSWTAADTAAQITQ

SEQ ID NO: 3961 - protein, 15 aa, Artificial Sequence
  HLA class I histocompatibility antigen, B-15 alpha chain (54-68)
DTQFVRFDSDAASPR

SEQ ID NO: 3962 - protein, 17 aa, Artificial Sequence
  HLA class I histocompatibility antigen, A-2 alpha chain (29-45)
DTQFVRFDSDAASQRME

SEQ ID NO: 3963 - protein, 12 aa, Artificial Sequence
  HLA class I histocompatibility antigen, B-15 alpha chain (57-68)
FVRFDSDAASPR

SEQ ID NO: 3964 - protein, 11 aa, Artificial Sequence
  HLA class I histocompatibility antigen, A-1 alpha chain (32-42)
FVRFDSDAASQ

SEQ ID NO: 3965 - protein, 15 aa, Artificial Sequence
  HLA class I histocompatibility antigen, B-15 alpha chain (154-168)
LSSWTAADTAAQITQ

SEQ ID NO: 3966 - protein, 17 aa, Artificial Sequence
  HLA class I histocompatibility antigen, B-15 alpha chain (52-68)
VDDTQFVRFDSDAASPR

SEQ ID NO: 3967 - protein, 9 aa, Artificial Sequence
  Vimentin (116-124)
NYIDKVRFL

SEQ ID NO: 3968 - protein, 9 aa, Artificial Sequence
  G antigen 12H (9-17)
YYWPRPRRY

SEQ ID NO: 3969 - protein, 9 aa, Artificial Sequence
  Transaldolase (168-176)
LLFSFAQAV

SEQ ID NO: 3970 - protein, 17 aa, Artificial Sequence
  T cell receptor beta chain (42-57)
CKPISGHNSLFQWYRQT

SEQ ID NO: 3971 - protein, 9 aa, Artificial Sequence
  Putative pre-mRNA-splicing factor ATP-dependent RNA helicase DHX16 (410-418)
AAIANHQVL

SEQ ID NO: 3972 - protein, 9 aa, Artificial Sequence
  14-3-3 protein gamma (25-33)
AAMKNVTEL

SEQ ID NO: 3973 - protein, 9 aa, Artificial Sequence
  Serine/threonine-protein kinase SMG1 (111-119)
ALNNLLHSL

SEQ ID NO: 3974 - protein, 9 aa, Artificial Sequence
  Cyclin-L1 (148-156)
DVINVFHHL

SEQ ID NO: 3975 - protein, 9 aa, Artificial Sequence
  Fructose-bisphosphate aldolase A (15-23)
ELSDIAHRI

SEQ ID NO: 3976 - protein, 9 aa, Artificial Sequence
  Glyceraldehyde-3-phosphate dehydrogenase (173-181)
GLMTTVHAI

SEQ ID NO: 3977 - protein, 9 aa, Artificial Sequence
  Elongation of very long chain fatty acids protein 1 (135-143)
GQVTFLHVF

SEQ ID NO: 3978 - protein, 9 aa, Artificial Sequence
  Microtubule-associated protein RP/EB family member 2 (234-242)
QLNEQVHSL

SEQ ID NO: 3979 - protein, 9 aa, Artificial Sequence
  T-complex protein 1 subunit epsilon (79-87)
SMMDVDHQI

SEQ ID NO: 3980 - protein, 9 aa, Artificial Sequence
  Sphingolipid delta(4)-desaturase DES1 (83-91)
SMTLAIHEI

SEQ ID NO: 3981 - protein, 9 aa, Artificial Sequence
  Elongation of very long chain fatty acids protein 5 (171-179)
TLNSFIHVL

SEQ ID NO: 3982 - protein, 9 aa, Artificial Sequence
  ORM1-like protein 2 (50-58)
TLTNVIHNL

SEQ ID NO: 3983 - protein, 10 aa, Artificial Sequence
  Baculoviral IAP repeat-containing protein 7 (280-289)
QLCPICRAPV

SEQ ID NO: 3984 - protein, 10 aa, Artificial Sequence
  E3 ubiquitin-protein ligase TRIM68 (55-64)
YTCPLCRAPV

SEQ ID NO: 3985 - protein, 11 aa, Artificial Sequence
  Putative HTLV-1-related endogenous sequence (14-24)
PTRAPSGPRPP

SEQ ID NO: 3986 - protein, 11 aa, Artificial Sequence
  Putative HTLV-1-related endogenous sequence (117-127)
RRREGPDRSPR

SEQ ID NO: 3987 - protein, 9 aa, Artificial Sequence
  Myelin basic protein (175-183)
GTLSKIFKL

SEQ ID NO: 3988 - protein, 9 aa, Artificial Sequence
  Myelin proteolipid protein (45-53)
KLIETYFSK

SEQ ID NO: 3989 - protein, 9 aa, Artificial Sequence
  Gamma-secretase C-terminal fragment 59 (563-571)
AEFRHDSGY

SEQ ID NO: 3990 - protein, 9 aa, Artificial Sequence
  SAM and SH3 domain-containing protein 1 (305-313)
ALYSGVHKK

SEQ ID NO: 3991 - protein, 10 aa, Artificial Sequence
  E3 ubiquitin-protein ligase SIAH1 (6-15)
ATALPTGTSK

SEQ ID NO: 3992 - protein, 9 aa, Artificial Sequence
  Muscleblind-like protein 2 (359-367)
ATANQIILK

SEQ ID NO: 3993 - protein, 9 aa, Artificial Sequence
  Annexin A1 (63-71)
ATIIDILTK

SEQ ID NO: 3994 - protein, 9 aa, Artificial Sequence
  Nuclear ubiquitous casein and cyclin-dependent kinase substrate 1 (176-184)
ATVTPSPVK

SEQ ID NO: 3995 - protein, 9 aa, Artificial Sequence
  Pleiotropic regulator 1 (118-126)
AVALPLQTK

SEQ ID NO: 3996 - protein, 12 aa, Artificial Sequence
  NADH dehydrogenase (ubiquinone) 1 alpha subcomplex subunit 3 (29-40)
AVILPPLSPYFK

SEQ ID NO: 3997 - protein, 9 aa, Artificial Sequence
  CD99 antigen (177-185)
AVQRTLLEK

SEQ ID NO: 3998 - protein, 9 aa, Artificial Sequence
  Guanine nucleotide-binding protein G(o) subunit alpha (93-101)
AVTDVIIAK

SEQ ID NO: 3999 - protein, 14 aa, Artificial Sequence
  Calsyntenin-1 (56-69)
DPPLIALDKDAPLR

SEQ ID NO: 4000 - protein, 9 aa, Artificial Sequence
  GPI transamidase component PIG-T (161-169)
DTDHYFLRY

SEQ ID NO: 4001 - protein, 14 aa, Artificial Sequence
  Perilipin-3 (222-235)
DVASVQQQRQEQSY

SEQ ID NO: 4002 - protein, 9 aa, Artificial Sequence
  WD40 repeat-containing protein SMU1 (9-17)
DVIRLIMQY

SEQ ID NO: 4003 - protein, 10 aa, Artificial Sequence
  Protein S100-B (35-44)
ELINNELSHF

SEQ ID NO: 4004 - protein, 11 aa, Artificial Sequence
  Annexin A11 (430-440)
ETDLLDIRSEY

SEQ ID NO: 4005 - protein, 9 aa, Artificial Sequence
  Histone H2B type 2-F (66-74)
FVNDIFERI

SEQ ID NO: 4006 - protein, 8 aa, Artificial Sequence
  Calmodulin (145-152)
FVQMMTAK

SEQ ID NO: 4007 - protein, 14 aa, Artificial Sequence
  Phosphoinositide-3-kinase-interacting protein 1 (30-43)
GHLYREDQTSPAPG

SEQ ID NO: 4008 - protein, 9 aa, Artificial Sequence
  THO complex subunit 4 (147-155)
GTADVHFER

SEQ ID NO: 4009 - protein, 9 aa, Artificial Sequence
  Neuroblast differentiation-associated protein AHNAK (1210-1218)
GTFGGLGSK

SEQ ID NO: 4010 - protein, 9 aa, Artificial Sequence
  Phosphoserine aminotransferase (119-127)
GTINIVHPK

SEQ ID NO: 4011 - protein, 9 aa, Artificial Sequence
  Histone deacetylase 7 (159-167)
HSERHVLLY

SEQ ID NO: 4012 - protein, 9 aa, Artificial Sequence
  Gelsolin (48-56)
IIYKGGTSR

SEQ ID NO: 4013 - protein, 10 aa, Artificial Sequence
  Tight junction protein ZO-1 (562-571)
IPNKNRAEQL

SEQ ID NO: 4014 - protein, 13 aa, Artificial Sequence
  Calmodulin (126-138)
IREADIDGDGQVN

SEQ ID NO: 4015 - protein, 17 aa, Artificial Sequence
  POTE ankyrin domain family member F (1057-1073)
ISKQEYDESGPSIVHRK

SEQ ID NO: 4016 - protein, 9 aa, Artificial Sequence
  NADH dehydrogenase (ubiquinone) iron-sulfur protein 7, mitochondrial (66-74)
IVAGTLTNK

SEQ ID NO: 4017 - protein, 9 aa, Artificial Sequence
  LIM domain transcription factor LMO4 (29-37)
KIADRFLLY

SEQ ID NO: 4018 - protein, 10 aa, Artificial Sequence
  Spectrin beta chain, non-erythrocytic 1 (1939-1948)
KPRDVSSVEL

SEQ ID NO: 4019 - protein, 9 aa, Artificial Sequence
  NADH dehydrogenase (ubiquinone) 1 subunit C2 (106-114)
KTYGEIFEK

SEQ ID NO: 4020 - protein, 15 aa, Artificial Sequence
  Testican-2 (317-331)
LERIQIQEAAKKKPG

SEQ ID NO: 4021 - protein, 9 aa, Artificial Sequence
  Alpha-adducin (37-45)
LTDRELEEY

SEQ ID NO: 4022 - protein, 10 aa, Artificial Sequence
  V-type proton ATPase subunit F (46-55)
NEIEDTFRQF

SEQ ID NO: 4023 - protein, 8 aa, Artificial Sequence
  40S ribosomal protein SA (149-156)
NTDSPLRY

SEQ ID NO: 4024 - protein, 9 aa, Artificial Sequence
  Bcl-2-associated transcription factor 1 (428-436)
NTEEEGLKY

SEQ ID NO: 4025 - protein, 11 aa, Artificial Sequence
  ATP synthase-coupling factor 6, mitochondrial (98-108)
PKFEVIEKPQA

SEQ ID NO: 4026 - protein, 13 aa, Artificial Sequence
  Phosphatidylethanolamine-binding protein 1 (2-14)
PVDLSKWSGPLSL

SEQ ID NO: 4027 - protein, 9 aa, Artificial Sequence
  40S ribosomal protein S29 (5-13)
QLYWSHPRK

SEQ ID NO: 4028 - protein, 10 aa, Artificial Sequence
  Septin-2 (291-300)
RLYPWGVVEV

SEQ ID NO: 4029 - protein, 9 aa, Artificial Sequence
  Methyl-CpG-binding domain protein 3 (74-82)
SIFKQPVTK

SEQ ID NO: 4030 - protein, 9 aa, Artificial Sequence
  Transformation/transcription domain-associated protein (1806-1814)
SITSVFITK

SEQ ID NO: 4031 - protein, 10 aa, Artificial Sequence
  Transcription factor HES-1 (101-110)
STDPSVLGKY

SEQ ID NO: 4032 - protein, 9 aa, Artificial Sequence
  Protein transport protein Sec23B (115-123)
STIEYVIQR

SEQ ID NO: 4033 - protein, 11 aa, Artificial Sequence
  Paralemmin-2 (155-165)
STIGPEGVHQK

SEQ ID NO: 4034 - protein, 10 aa, Artificial Sequence
  Sodium/potassium-transporting ATPase subunit alpha-3 (946-955)
SVFQQGMKNK

SEQ ID NO: 4035 - protein, 11 aa, Artificial Sequence
  Stathmin (31-41)
SVPEFPLSPPK

SEQ ID NO: 4036 - protein, 9 aa, Artificial Sequence
  Heterogeneous nuclear ribonucleoprotein L-like (68-76)
SVSPVVHVR

SEQ ID NO: 4037 - protein, 8 aa, Artificial Sequence
  Nodal modulator 3 (247-254)
TAIRHHVL

SEQ ID NO: 4038 - protein, 11 aa, Artificial Sequence
  Interferon-induced GTP-binding protein Mx2 (194-204)
TIIDLPGITRV

SEQ ID NO: 4039 - protein, 9 aa, Artificial Sequence
  Neuronal membraneoprotein M6-b (264-272)
TTYNYAVLK

SEQ ID NO: 4040 - protein, 9 aa, Artificial Sequence
  Contactin-1 (759-767)
VTNPDTGRY

SEQ ID NO: 4041 - protein, 8 aa, Artificial Sequence
  Cytosolic non-specific dipeptidase (468-475)
YEVSQLKD

SEQ ID NO: 4042 - protein, 9 aa, Artificial Sequence
  Septin-2 (121-129)
YIDEQFERY

SEQ ID NO: 4043 - protein, 10 aa, Artificial Sequence
  Noelin-2 (405-414)
YTDVPFHNQY

SEQ ID NO: 4044 - protein, 11 aa, Artificial Sequence
  Serine/threonine-protein kinase DCLK1 (176-186)
YTERDASGMLY

SEQ ID NO: 4045 - protein, 8 aa, Artificial Sequence
  U2 small nuclear ribonucleoprotein B'' (205-212)
DALQGFKI

SEQ ID NO: 4046 - protein, 15 aa, Artificial Sequence
  Melanocyte protein PMEL (45-59)
NRQLYPEWTEAQRLD

SEQ ID NO: 4047 - protein, 9 aa, Artificial Sequence
  Nuclear autoantigenic sperm protein (281-289)
VLNEQVKEA

SEQ ID NO: 4048 - protein, 9 aa, Artificial Sequence
  60S ribosomal protein L5 (218-226)
AYKKQFSQY

SEQ ID NO: 4049 - protein, 9 aa, Artificial Sequence
  Endoplasmic reticulum-Golgi intermediate compartment protein 1 (258-266)
AIIGGTFTV

SEQ ID NO: 4050 - protein, 9 aa, Artificial Sequence
  Programmed cell death protein 4 (283-291)
ALDKATVLL

SEQ ID NO: 4051 - protein, 9 aa, Artificial Sequence
  Endoplasmin (381-389)
ALKDKIEKA

SEQ ID NO: 4052 - protein, 9 aa, Artificial Sequence
  Glyceraldehyde-3-phosphate dehydrogenase (302-310)
ALNDHFVKL

SEQ ID NO: 4053 - protein, 9 aa, Artificial Sequence
  Eukaryotic translation initiation factor 3 subunit F (349-357)
ALNEKLVNL

SEQ ID NO: 4054 - protein, 9 aa, Artificial Sequence
  Cofilin-1 (6-14)
AVSDGVIKV

SEQ ID NO: 4055 - protein, 9 aa, Artificial Sequence
  Actin, cytoplasmic 2 (21-29)
FAGDDAPRA

SEQ ID NO: 4056 - protein, 10 aa, Artificial Sequence
  Pyruvate kinase PKM (12-21)
FIQTQQLHAA

SEQ ID NO: 4057 - protein, 10 aa, Artificial Sequence
  Dolichyl-diphosphooligosaccharide-proteinosyltransferase subunit STT3A (59-68)
FLAEEGFYKF

SEQ ID NO: 4058 - protein, 10 aa, Artificial Sequence
  5'(3')-deoxyribonucleotidase, cytosolic type (71-80)
FLDLEPIPGA

SEQ ID NO: 4059 - protein, 8 aa, Artificial Sequence
  CKLF-like MARVEL transmembrane domain-containing protein 6 (79-86)
FLLSLLIL

SEQ ID NO: 4060 - protein, 9 aa, Artificial Sequence
  Cleavage and polyadenylation specificity factor subunit 1 (185-193)
FLPSYIIDV

SEQ ID NO: 4061 - protein, 8 aa, Artificial Sequence
  Neutral amino acid transporter B(0) (89-96)
FVFPGELL

SEQ ID NO: 4062 - protein, 10 aa, Artificial Sequence
  Glyceraldehyde-3-phosphate dehydrogenase (169-178)
GIVEGLMTTV

SEQ ID NO: 4063 - protein, 9 aa, Artificial Sequence
  Protein PRRC1 (212-220)
GIWGFIKGV

SEQ ID NO: 4064 - protein, 9 aa, Artificial Sequence
  Probable ATP-dependent RNA helicase DDX49 (311-319)
GLDIPTVQV

SEQ ID NO: 4065 - protein, 8 aa, Artificial Sequence
  Nuclear pore complex protein Nup160 (1223-1230)
GLFDTAIS

SEQ ID NO: 4066 - protein, 13 aa, Artificial Sequence
  ATP synthase subunit beta, mitochondrial (203-215)
GLFGGAGVGKTVL

SEQ ID NO: 4067 - protein, 9 aa, Artificial Sequence
  Signal peptidase complex subunit 2 (79-87)
GLIDGRLTI

SEQ ID NO: 4068 - protein, 11 aa, Artificial Sequence
  Pyruvate kinase PKM (122-132)
GLIKGSGTAEV

SEQ ID NO: 4069 - protein, 10 aa, Artificial Sequence
  Protein kinase C iota type (241-250)
GLQDFDLLRV

SEQ ID NO: 4070 - protein, 9 aa, Artificial Sequence
  Histone acetyltransferase p300 (2240-2248)
GQIGQLPQA

SEQ ID NO: 4071 - protein, 9 aa, Artificial Sequence
  Histone H2A type 1-A (107-115)
GVLPNIQAV

SEQ ID NO: 4072 - protein, 10 aa, Artificial Sequence
  Small nuclear ribonucleoprotein G (67-76)
IIMLEALERV

SEQ ID NO: 4073 - protein, 9 aa, Artificial Sequence
  Heat shock 70 kDa protein 1-like (174-182)
IINEPTAAA

SEQ ID NO: 4074 - protein, 9 aa, Artificial Sequence
  Glyceraldehyde-3-phosphate dehydrogenase (206-214)
IIPASTGAA

SEQ ID NO: 4075 - protein, 12 aa, Artificial Sequence
  Nucleosome assembly protein 1-like 1 (319-330)
ILAADFEIGHFL

SEQ ID NO: 4076 - protein, 9 aa, Artificial Sequence
  Glyceraldehyde-3-phosphate dehydrogenase (273-281)
ILGYTEHQV

SEQ ID NO: 4077 - protein, 9 aa, Artificial Sequence
  40S ribosomal protein S11 (72-80)
ILSGVVTKM

SEQ ID NO: 4078 - protein, 9 aa, Artificial Sequence
  Structural maintenance of chromosomes protein 3 (436-444)
KLDQDLNEV

SEQ ID NO: 4079 - protein, 13 aa, Artificial Sequence
  Centrin-2 (111-123)
KLFDDDETGKISF

SEQ ID NO: 4080 - protein, 11 aa, Artificial Sequence
  GTP-binding nuclear protein Ran (167-177)
KLIGDPNLEFV

SEQ ID NO: 4081 - protein, 11 aa, Artificial Sequence
  40S ribosomal protein S3a (227-237)
KLMELHGEGSS

SEQ ID NO: 4082 - protein, 10 aa, Artificial Sequence
  ATP-dependent RNA helicase A (696-705)
KVFDPVPVGV

SEQ ID NO: 4083 - protein, 8 aa, Artificial Sequence
  Gamma-interferon-inducible lysosomal thiol reductase (27-34)
LLDVPTAA

SEQ ID NO: 4084 - protein, 9 aa, Artificial Sequence
  Heat shock cognate 71 kDa protein (393-401)
LLDVTPLSL

SEQ ID NO: 4085 - protein, 8 aa, Artificial Sequence
  T-complex protein 1 subunit eta (68-75)
LLDVVHPA

SEQ ID NO: 4086 - protein, 9 aa, Artificial Sequence
  T-complex protein 1 subunit eta (68-76)
LLDVVHPAA

SEQ ID NO: 4087 - protein, 9 aa, Artificial Sequence
  Transmembrane emp24 domain-containing protein 10 (23-31)
LLGPRLVLA

SEQ ID NO: 4088 - protein, 11 aa, Artificial Sequence
  Glyceraldehyde-3-phosphate dehydrogenase (174-184)
LMTTVHAITAT

SEQ ID NO: 4089 - protein, 9 aa, Artificial Sequence
  Proteasome-associated protein ECM29 homolog (162-170)
NLAEKPKTV

SEQ ID NO: 4090 - protein, 9 aa, Artificial Sequence
  GPN-loop GTPase 1 (42-50)
NLDPAVHEV

SEQ ID NO: 4091 - protein, 9 aa, Artificial Sequence
  60S ribosomal protein L10a (143-151)
NMVAKVDEV

SEQ ID NO: 4092 - protein, 9 aa, Artificial Sequence
  Heterogeneous nuclear ribonucleoproteins C1/C2 (142-150)
RVPPPPPIA

SEQ ID NO: 4093 - protein, 8 aa, Artificial Sequence
  Hydroxymethylglutaryl-CoA synthase, cytoplasmic (447-454)
SLFEGTWY

SEQ ID NO: 4094 - protein, 9 aa, Artificial Sequence
  Hydroxymethylglutaryl-CoA synthase, cytoplasmic (482-490)
SLFEGTWYL

SEQ ID NO: 4095 - protein, 7 aa, Artificial Sequence
  Sterol O-acyltransferase 1 (127-133)
SLLDELL

SEQ ID NO: 4096 - protein, 9 aa, Artificial Sequence
  Tuberin (526-534)
SLLDIIEKV

SEQ ID NO: 4097 - protein, 9 aa, Artificial Sequence
  Eukaryotic translation elongation factor 1 epsilon-1 (8-16)
SLLEKSLGL

SEQ ID NO: 4098 - protein, 9 aa, Artificial Sequence
  Neuroblast differentiation-associated protein AHNAK (2580-2588)
SMPDFDLHL

SEQ ID NO: 4099 - protein, 9 aa, Artificial Sequence
  Phosphoinositide 3-kinase regulatory subunit 4 (906-914)
SQVPEVTTV

SEQ ID NO: 4100 - protein, 12 aa, Artificial Sequence
  Annexin A2 (184-195)
SVIDYELIDQDA

SEQ ID NO: 4101 - protein, 11 aa, Artificial Sequence
  U2 small nuclear ribonucleoprotein A' (213-223)
TLAEVERLKGL

SEQ ID NO: 4102 - protein, 9 aa, Artificial Sequence
  Serine/threonine-protein kinase SIK1 (473-481)
TLAEVSTRL

SEQ ID NO: 4103 - protein, 9 aa, Artificial Sequence
  G2/mitotic-specific cyclin-B1 (321-329)
TLAKYLMEL

SEQ ID NO: 4104 - protein, 11 aa, Artificial Sequence
  Nucleolin (501-511)
TLQEVFEKATF

SEQ ID NO: 4105 - protein, 10 aa, Artificial Sequence
  L-lactate dehydrogenase B chain (323-332)
TLWDIQKDLK

SEQ ID NO: 4106 - protein, 9 aa, Artificial Sequence
  L-lactate dehydrogenase A chain (322-330)
TLWGIQKEL

SEQ ID NO: 4107 - protein, 9 aa, Artificial Sequence
  Aladin (17-25)
TLYEHNNEL

SEQ ID NO: 4108 - protein, 11 aa, Artificial Sequence
  Microtubule-associated protein 4 (335-345)
VLPTETEVAPA

SEQ ID NO: 4109 - protein, 9 aa, Artificial Sequence
  Peroxiredoxin-5, mitochondrial (184-192)
VVQDGIVKA

SEQ ID NO: 4110 - protein, 10 aa, Artificial Sequence
  HLA class I histocompatibility antigen, B-7 alpha chain (140-149)
YAYDGKDYIA

SEQ ID NO: 4111 - protein, 7 aa, Artificial Sequence
  Carbamoyl-phosphate synthase (ammonia), mitochondrial (389-395)
YLFDSFF

SEQ ID NO: 4112 - protein, 8 aa, Artificial Sequence
  Bax inhibitor 1 (140-147)
YLFLGGIL

SEQ ID NO: 4113 - protein, 10 aa, Artificial Sequence
  Coiled-coil domain-containing protein 12 (62-71)
YVPEDEDLKK

SEQ ID NO: 4114 - protein, 8 aa, Artificial Sequence
  Small nuclear ribonucleoprotein-associated proteins B and B' (18-25)
RIFIGTFK

SEQ ID NO: 4115 - protein, 18 aa, Artificial Sequence
  ATP synthase-coupling factor 6, mitochondrial (91-108)
PTFKFEDPKFEVIEKPQA

SEQ ID NO: 4116 - protein, 9 aa, Artificial Sequence
  Kinectin (794-802)
SLVEELKKV

SEQ ID NO: 4117 - protein, 9 aa, Artificial Sequence
  Kinectin (600-608)
VLAEELHKV

SEQ ID NO: 4118 - protein, 11 aa, Artificial Sequence
  HLA class I histocompatibility antigen, B-15 alpha chain (193-203)
RRYLENGKETL

SEQ ID NO: 4119 - protein, 9 aa, Artificial Sequence
  Keratin, type I cytoskeletal 18 (307-315)
ALLNIKVKL

SEQ ID NO: 4120 - protein, 10 aa, Artificial Sequence
  Heat shock protein HSP 90-beta (346-355)
AEDKENYKKF

SEQ ID NO: 4121 - protein, 9 aa, Artificial Sequence
  40S ribosomal protein S5 (12-20)
AETPDIKLF

SEQ ID NO: 4122 - protein, 12 aa, Artificial Sequence
  Ribonucleoside-diphosphate reductase subunit M2 (165-176)
EEVDLSKDIQHW

SEQ ID NO: 4123 - protein, 10 aa, Artificial Sequence
  Nucleosome assembly protein 1-like 4 (86-95)
EEVHDLERKY

SEQ ID NO: 4124 - protein, 9 aa, Artificial Sequence
  U4/U6 small nuclear ribonucleoprotein Prp31 (105-113)
NELNIIHKF

SEQ ID NO: 4125 - protein, 12 aa, Artificial Sequence
  ELAV-like protein 3 (161-172)
FIRFDKRIEAEE

SEQ ID NO: 4126 - protein, 10 aa, Artificial Sequence
  ELAV-like protein 3 (29-38)
KTNLIVNYLP

SEQ ID NO: 4127 - protein, 9 aa, Artificial Sequence
  Minor histocompatibility protein HA-1 (137-145)
VLHDDLLEA

SEQ ID NO: 4128 - protein, 14 aa, Artificial Sequence
  Glyceraldehyde-3-phosphate dehydrogenase (26-39)
GKVDIVAINDPFID

SEQ ID NO: 4129 - protein, 14 aa, Artificial Sequence
  Low affinity immunoglobulin epsilon Fc receptor (10-23)
ISQELEELRAEQQR

SEQ ID NO: 4130 - protein, 9 aa, Artificial Sequence
  26S proteasome non-ATPase regulatory subunit 2 (299-307)
GRHGVFLEL

SEQ ID NO: 4131 - protein, 9 aa, Artificial Sequence
  ATP-dependent RNA helicase DDX3X (234-242)
FLLPILSQI

SEQ ID NO: 4132 - protein, 9 aa, Artificial Sequence
  Putative homeodomain transcription factor 2 (652-660)
AQLLHVHEI

SEQ ID NO: 4133 - protein, 9 aa, Artificial Sequence
  Transcription factor BTF3 (47-55)
ETIMNQEKL

SEQ ID NO: 4134 - protein, 9 aa, Artificial Sequence
  Ribosome biogenesis protein BRX1 homolog (141-149)
FLVQNIHTL

SEQ ID NO: 4135 - protein, 9 aa, Artificial Sequence
  Microtubule-actin cross-linking factor 1, isoforms 1/2/3/5 (2558-2566)
QAIKNGQAL

SEQ ID NO: 4136 - protein, 13 aa, Artificial Sequence
  HLA class I histocompatibility antigen, B-8 alpha chain (111-123)
QSEAGSHTLQSMY

SEQ ID NO: 4137 - protein, 9 aa, Artificial Sequence
  Dynamin-2 (390-398)
YAIKNIHGV

SEQ ID NO: 4138 - protein, 9 aa, Artificial Sequence
  ELAV-like protein 4 (96-104)
DPKDAEKAI

SEQ ID NO: 4139 - protein, 9 aa, Artificial Sequence
  ELAV-like protein 4 (318-326)
GPFGAVNNV

SEQ ID NO: 4140 - protein, 9 aa, Artificial Sequence
  ELAV-like protein 4 (197-205)
KPSGATEPI

SEQ ID NO: 4141 - protein, 9 aa, Artificial Sequence
  ELAV-like protein 4 (265-273)
PPSACSPRF

SEQ ID NO: 4142 - protein, 9 aa, Artificial Sequence
  ELAV-like protein 4 (270-278)
SPRFSPITI

SEQ ID NO: 4143 - protein, 12 aa, Artificial Sequence
  ATP-dependent RNA helicase DDX3Y (176-187)
HIENFSDIDMGE

SEQ ID NO: 4144 - protein, 9 aa, Artificial Sequence
  Histone demethylase UTY (719-727)
LLIADNPQL

SEQ ID NO: 4145 - protein, 9 aa, Artificial Sequence
  Pumilio homolog 3 (149-157)
RTLDKVLEV

SEQ ID NO: 4146 - protein, 9 aa, Artificial Sequence
  Histone H4 (83-91)
TAMDVVYAL

SEQ ID NO: 4147 - protein, 9 aa, Artificial Sequence
  Histone H3.2 (119-127)
TIMPKDIQL

SEQ ID NO: 4148 - protein, 13 aa, Artificial Sequence
  Protein S100-A9 (67-79)
DTNADKQLSFEEF

SEQ ID NO: 4149 - protein, 16 aa, Artificial Sequence
  Annexin A2 (209-224)
DVPKWISIMTERSVPH

SEQ ID NO: 4150 - protein, 13 aa, Artificial Sequence
  Glyceraldehyde-3-phosphate dehydrogenase (269-281)
ISWYDNEFGYSNR

SEQ ID NO: 4151 - protein, 18 aa, Artificial Sequence
  Macrophage migration inhibitory factor (3-20)
IVNTNVPRASVPDGFLSE

SEQ ID NO: 4152 - protein, 9 aa, Artificial Sequence
  Hemoglobin subunit alpha (41-49)
LRVDPVNFK

SEQ ID NO: 4153 - protein, 18 aa, Artificial Sequence
  40S ribosomal protein S17 (118-135)
QVTQPTVGMNFKTPRGPV

SEQ ID NO: 4154 - protein, 16 aa, Artificial Sequence
  Collagen alpha-1(I) chain (857-872)
RLPIIDVAPLDVGAPD

SEQ ID NO: 4155 - protein, 16 aa, Artificial Sequence
  Collagen alpha-2(I) chain (949-964)
RPKDYEVDATLKSLNN

SEQ ID NO: 4156 - protein, 11 aa, Artificial Sequence
  T-complex protein 1 subunit theta (369-379)
AEAFEAIPRAL

SEQ ID NO: 4157 - protein, 9 aa, Artificial Sequence
  Cullin-1 (484-492)
AEASMISKL

SEQ ID NO: 4158 - protein, 9 aa, Artificial Sequence
  DNA replication licensing factor MCM7 (328-336)
AEEDFYEKL

SEQ ID NO: 4159 - protein, 10 aa, Artificial Sequence
  BolA-like protein 2 (61-70)
AEELPHIHAF

SEQ ID NO: 4160 - protein, 9 aa, Artificial Sequence
  DNA topoisomerase 2-beta (526-534)
AEINNIIKI

SEQ ID NO: 4161 - protein, 10 aa, Artificial Sequence
  Cofilin-1 (150-159)
AEKLGGSAVI

SEQ ID NO: 4162 - protein, 9 aa, Artificial Sequence
  Proteasome subunit alpha type-4 (137-145)
AEKVEIATL

SEQ ID NO: 4163 - protein, 9 aa, Artificial Sequence
  Bifunctional glutamate/proline-tRNA ligase (1393-1401)
AENEAETKL

SEQ ID NO: 4164 - protein, 10 aa, Artificial Sequence
  Sodium/potassium-transporting ATPase subunit alpha-1 (677-686)
AENGFLPIHL

SEQ ID NO: 4165 - protein, 10 aa, Artificial Sequence
  Eukaryotic translation initiation factor 4 gamma 1 (1531-1540)
AEQQGKGVAL

SEQ ID NO: 4166 - protein, 12 aa, Artificial Sequence
  T-complex protein 1 subunit eta (76-87)
AEVGDGTTSVTL

SEQ ID NO: 4167 - protein, 9 aa, Artificial Sequence
  MICOS complex subunit MIC60 (166-174)
GEGKPTPAL

SEQ ID NO: 4168 - protein, 11 aa, Artificial Sequence
  Peptidyl-prolyl cis-trans isomerase A (80-90)
GEKFEDENFIL

SEQ ID NO: 4169 - protein, 9 aa, Artificial Sequence
  NADH dehydrogenase (ubiquinone) 1 beta subcomplex subunit 7 (127-135)
GEVDPKVAL

SEQ ID NO: 4170 - protein, 10 aa, Artificial Sequence
  G2/mitotic-specific cyclin-B1 (62-71)
GEVDVEQHTL

SEQ ID NO: 4171 - protein, 14 aa, Artificial Sequence
  Zinc finger MYM-type protein 2 (207-220)
GEYLPSKGAGNNVL

SEQ ID NO: 4172 - protein, 10 aa, Artificial Sequence
  Transforming protein RhoA (46-55)
IEVDGKQVEL

SEQ ID NO: 4173 - protein, 11 aa, Artificial Sequence
  40S ribosomal protein S17 (96-106)
IEVDPDTKEML

SEQ ID NO: 4174 - protein, 10 aa, Artificial Sequence
  Putative endoplasmin-like protein (341-350)
KEDEDDKTVL

SEQ ID NO: 4175 - protein, 10 aa, Artificial Sequence
  Plasminogen activator inhibitor 1 RNA-binding protein (182-191)
KEEGPKEMTL

SEQ ID NO: 4176 - protein, 9 aa, Artificial Sequence
  Uncharacterized protein C20orf24 (7-15)
KEEPPQPQL

SEQ ID NO: 4177 - protein, 10 aa, Artificial Sequence
  Importin subunit beta-1 (183-192)
KEEPSNNVKL

SEQ ID NO: 4178 - protein, 11 aa, Artificial Sequence
  Heat shock protein HSP 90-beta (452-462)
KEFDGKSLVSV

SEQ ID NO: 4179 - protein, 9 aa, Artificial Sequence
  Melanoma-associated antigen D2 (337-345)
KEIDKNDHL

SEQ ID NO: 4180 - protein, 10 aa, Artificial Sequence
  Protein Spindly (380-389)
KEIESTKGEL

SEQ ID NO: 4181 - protein, 10 aa, Artificial Sequence
  Coatomer subunit epsilon (241-250)
KENDFDRLVL

SEQ ID NO: 4182 - protein, 9 aa, Artificial Sequence
  Targeting protein for Xklp2 (238-246)
KEVNFTSEL

SEQ ID NO: 4183 - protein, 9 aa, Artificial Sequence
  H/ACA ribonucleoprotein complex subunit 4 (151-159)
KEYVGIVRL

SEQ ID NO: 4184 - protein, 10 aa, Artificial Sequence
  H/ACA ribonucleoprotein complex subunit 3 (8-17)
NEQGDRVYTL

SEQ ID NO: 4185 - protein, 10 aa, Artificial Sequence
  Cerebellar degeneration-related protein 2 (148-157)
RELEETNQKL

SEQ ID NO: 4186 - protein, 9 aa, Artificial Sequence
  Exocyst complex component 2 (640-648)
RLFENYIEL

SEQ ID NO: 4187 - protein, 9 aa, Artificial Sequence
  1-phosphatidylinositol 3-phosphate 5-kinase (1841-1849)
SEEDFIRSL

SEQ ID NO: 4188 - protein, 10 aa, Artificial Sequence
  Hydroxymethylglutaryl-CoA synthase, cytoplasmic (246-255)
SEYPIVDGKL

SEQ ID NO: 4189 - protein, 11 aa, Artificial Sequence
  Proteasome activator complex subunit 3 (220-230)
TEIDEKEYISL

SEQ ID NO: 4190 - protein, 15 aa, Artificial Sequence
  HLA class I histocompatibility antigen, B-15 alpha chain (240-254)
TWQRDGEDQTQDTEL

SEQ ID NO: 4191 - protein, 10 aa, Artificial Sequence
  Nuclear pore complex protein Nup205 (350-359)
VEDDRTLQSL

SEQ ID NO: 4192 - protein, 10 aa, Artificial Sequence
  Septin-2 (86-95)
VEIEERGVKL

SEQ ID NO: 4193 - protein, 9 aa, Artificial Sequence
  Hemoglobin subunit alpha (25-33)
YGAEALERM

SEQ ID NO: 4194 - protein, 14 aa, Artificial Sequence
  HLA class I histocompatibility antigen, A-1 alpha chain (29-42)
DTQFVRFDSDAASQ

SEQ ID NO: 4195 - protein, 9 aa, Artificial Sequence
  Neutral amino acid transporter B(0) (533-541)
VASEKESVM

SEQ ID NO: 4196 - protein, 9 aa, Artificial Sequence
  Lysosomal protective protein (20-28)
IRAAPPPLF

SEQ ID NO: 4197 - protein, 9 aa, Artificial Sequence
  Serine/threonine-protein kinase 38-like (444-452)
KRFEGLTQR

SEQ ID NO: 4198 - protein, 16 aa, Artificial Sequence
  Alpha-1B-glycoprotein (173-188)
APVELILSDETLPAPE

SEQ ID NO: 4199 - protein, 13 aa, Artificial Sequence
  Neuropilin-2 (696-708)
EGQYARLISPPVH

SEQ ID NO: 4200 - protein, 15 aa, Artificial Sequence
  Calreticulin (106-120)
GGGYVKLFPNSLDQT

SEQ ID NO: 4201 - protein, 19 aa, Artificial Sequence
  Annexin A2 (50-68)
GVDEVTIVNILTNRSNAQR

SEQ ID NO: 4202 - protein, 15 aa, Artificial Sequence
  Filamin-A (2114-2128)
NPAEFVVNTSNAGAG

SEQ ID NO: 4203 - protein, 17 aa, Artificial Sequence
  Syntenin-1 (25-41)
NPANPAILSEASAPIPH

SEQ ID NO: 4204 - protein, 14 aa, Artificial Sequence
  Transferrin receptor protein 1 (680-693)
RVEYHFLSPYVSPK

SEQ ID NO: 4205 - protein, 13 aa, Artificial Sequence
  Cathepsin D (230-242)
SFYLSRDPDAQPG

SEQ ID NO: 4206 - protein, 21 aa, Artificial Sequence
  HLA class I histocompatibility antigen, B-51 alpha chain (27-47)
VDDTQFVRFDSDAASPRTEPR

SEQ ID NO: 4207 - protein, 17 aa, Artificial Sequence
  Profilin-1 (35-51)
VPGKTFVNITPAEVGVL

SEQ ID NO: 4208 - protein, 9 aa, Artificial Sequence
  Lymphocyte-specific protein 1 (197-205)
KLIDRTESL

SEQ ID NO: 4209 - protein, 9 aa, Artificial Sequence
  Synemin (426-434)
RTFSPTYGL

SEQ ID NO: 4210 - protein, 9 aa, Artificial Sequence
  Insulin receptor substrate 2 (1097-1105)
RVASPTSGV

SEQ ID NO: 4211 - protein, 9 aa, Artificial Sequence
  ETS translocation variant 5 (45-53)
ELFQDLSQL

SEQ ID NO: 4212 - protein, 9 aa, Artificial Sequence
  E3 ubiquitin-protein ligase Mdm2 (53-61)
VLFYLGQYI

SEQ ID NO: 4213 - protein, 9 aa, Artificial Sequence
  U1 small nuclear ribonucleoprotein 70 kDa (423-431)
YLAPENGYL

SEQ ID NO: 4214 - protein, 9 aa, Artificial Sequence
  Coatomer subunit gamma-1 (147-155)
AIVDKVPSV

SEQ ID NO: 4215 - protein, 9 aa, Artificial Sequence
  T-complex protein 1 subunit gamma (129-137)
ALDDMISTL

SEQ ID NO: 4216 - protein, 9 aa, Artificial Sequence
  DCN1-like protein 1 (94-102)
ALDPASISV

SEQ ID NO: 4217 - protein, 9 aa, Artificial Sequence
  U3 small nucleolar ribonucleoprotein protein IMP3 (78-86)
ALLDKLYAL

SEQ ID NO: 4218 - protein, 9 aa, Artificial Sequence
  Nuclear pore complex protein Nup205 (318-326)
ALLDRIVSV

SEQ ID NO: 4219 - protein, 9 aa, Artificial Sequence
  Phosphoglycerate kinase 1 (354-362)
ALMDEVVKA

SEQ ID NO: 4220 - protein, 9 aa, Artificial Sequence
  Diphthamide biosynthesis protein 1 (138-146)
AQDFRVLYV

SEQ ID NO: 4221 - protein, 9 aa, Artificial Sequence
  Methionine aminopeptidase 2 (433-441)
AQFEHTILL

SEQ ID NO: 4222 - protein, 9 aa, Artificial Sequence
  GTP-binding nuclear protein Ran (215-223)
AQYEHDLEV

SEQ ID NO: 4223 - protein, 11 aa, Artificial Sequence
  60S acidic ribosomal protein P0 (108-118)
FLADPSAFVAA

SEQ ID NO: 4224 - protein, 11 aa, Artificial Sequence
  60S ribosomal protein L10a (110-120)
FLASESLIKQI

SEQ ID NO: 4225 - protein, 9 aa, Artificial Sequence
  Dipeptidyl peptidase 9 (806-814)
FLDENVHFF

SEQ ID NO: 4226 - protein, 9 aa, Artificial Sequence
  ATP-binding cassette sub-family F member 2 (539-547)
FLDEPTNHL

SEQ ID NO: 4227 - protein, 9 aa, Artificial Sequence
  Chloride intracellular channel protein 4 (178-186)
FLDGNEMTL

SEQ ID NO: 4228 - protein, 9 aa, Artificial Sequence
  3-hydroxy-3-methylglutaryl-coenzyme A reductase (113-121)
FLDKELTGL

SEQ ID NO: 4229 - protein, 9 aa, Artificial Sequence
  Acyl-protein thioesterase 2 (218-226)
FLEKLLPPV

SEQ ID NO: 4230 - protein, 9 aa, Artificial Sequence
  Macrophage migration inhibitory factor (17-25)
FLSELTQQL

SEQ ID NO: 4231 - protein, 9 aa, Artificial Sequence
  26S proteasome non-ATPase regulatory subunit 14 (61-69)
FVDDYTVRV

SEQ ID NO: 4232 - protein, 10 aa, Artificial Sequence
  Golgi-specific brefeldin A-resistance guanine nucleotide exchange factor 1 (1053-1062)
FVDPNGKISL

SEQ ID NO: 4233 - protein, 9 aa, Artificial Sequence
  E3 ubiquitin-protein ligase BRE1A (401-409)
HLDEARTLL

SEQ ID NO: 4234 - protein, 9 aa, Artificial Sequence
  Abl interactor 2 (89-97)
ILDDIGHGV

SEQ ID NO: 4235 - protein, 9 aa, Artificial Sequence
  Nuclear pore complex protein Nup88 (183-191)
ILDPHVVLL

SEQ ID NO: 4236 - protein, 9 aa, Artificial Sequence
  Thioredoxin-like protein 4A (40-48)
KMDEVLYSI

SEQ ID NO: 4237 - protein, 9 aa, Artificial Sequence
  Protein BTG2 (73-81)
KMDPIISRV

SEQ ID NO: 4238 - protein, 9 aa, Artificial Sequence
  Elongation factor 2 (159-167)
KMDRALLEL

SEQ ID NO: 4239 - protein, 8 aa, Artificial Sequence
  Transmembrane emp24 domain-containing protein 2 (42-49)
KMGLIFEV

SEQ ID NO: 4240 - protein, 8 aa, Artificial Sequence
  60S ribosomal protein L19 (119-126)
LMEHIHKL

SEQ ID NO: 4241 - protein, 9 aa, Artificial Sequence
  Glycogen phosphorylase, muscle form (271-279)
NLAENISRV

SEQ ID NO: 4242 - protein, 9 aa, Artificial Sequence
  Junction plakoglobin (5-13)
NLMEQPIKV

SEQ ID NO: 4243 - protein, 10 aa, Artificial Sequence
  Dolichyl-diphosphooligosaccharide-proteinosyltransferase subunit 2 (51-60)
RLDELGGVYL

SEQ ID NO: 4244 - protein, 9 aa, Artificial Sequence
  Putative eukaryotic translation initiation factor 2 subunit 3-like protein (17-25)
RQDLTTLDV

SEQ ID NO: 4245 - protein, 9 aa, Artificial Sequence
  Serine/threonine-protein kinase/endoribonuclease IRE1 (37-45)
TLDGSLHAV

SEQ ID NO: 4246 - protein, 11 aa, Artificial Sequence
  Interferon-induced GTP-binding protein Mx1 (175-185)
TLIDLPGITRV

SEQ ID NO: 4247 - protein, 9 aa, Artificial Sequence
  Mitotic spindle-associated MMXD complex subunit MIP18 (97-105)
TLIGLSIKV

SEQ ID NO: 4248 - protein, 9 aa, Artificial Sequence
  Sulfiredoxin-1 (114-122)
TLSDLRVYL

SEQ ID NO: 4249 - protein, 10 aa, Artificial Sequence
  Nucleolar GTP-binding protein 1 (322-331)
TLTEEGVIKV

SEQ ID NO: 4250 - protein, 9 aa, Artificial Sequence
  10 kDa heat shock protein, mitochondrial (81-89)
VLDDKDYFL

SEQ ID NO: 4251 - protein, 9 aa, Artificial Sequence
  Anoctamin-6 (137-145)
VLDDKLVFV

SEQ ID NO: 4252 - protein, 9 aa, Artificial Sequence
  Nucleolar pre-ribosomal-associated protein 1 (1314-1322)
VLDQKILLL

SEQ ID NO: 4253 - protein, 11 aa, Artificial Sequence
  RNA-binding protein 34 (333-343)
VLFENTDSVHL

SEQ ID NO: 4254 - protein, 9 aa, Artificial Sequence
  Eukaryotic translation initiation factor 4 gamma 1 (680-688)
VLMTEDIKL

SEQ ID NO: 4255 - protein, 11 aa, Artificial Sequence
  Phosphoglycerate kinase 1 (407-417)
VLPGVDALSNI

SEQ ID NO: 4256 - protein, 10 aa, Artificial Sequence
  S-adenosylmethionine synthase isoform type-2 (235-244)
YLDEDTIYHL

SEQ ID NO: 4257 - protein, 9 aa, Artificial Sequence
  Transmembrane protein 209 (409-417)
YLFERIKEL

SEQ ID NO: 4258 - protein, 10 aa, Artificial Sequence
  HLA class I histocompatibility antigen, B-13 alpha chain (26-35)
YVDDTQFVRF

SEQ ID NO: 4259 - protein, 12 aa, Artificial Sequence
  Melanoma antigen recognized by T-cells 1 (100-111)
APPAYEKLSAEQ

SEQ ID NO: 4260 - protein, 15 aa, Artificial Sequence
  Melanoma antigen recognized by T-cells 1 (100-114)
APPAYEKLSAEQSPP

SEQ ID NO: 4261 - protein, 16 aa, Artificial Sequence
  Melanoma antigen recognized by T-cells 1 (100-115)
APPAYEKLSAEQSPPP

SEQ ID NO: 4262 - protein, 17 aa, Artificial Sequence
  Melanoma antigen recognized by T-cells 1 (100-116)
APPAYEKLSAEQSPPPY

SEQ ID NO: 4263 - protein, 12 aa, Artificial Sequence
  Melanoma antigen recognized by T-cells 1 (99-110)
NAPPAYEKLSAE

SEQ ID NO: 4264 - protein, 20 aa, Artificial Sequence
  Melanoma antigen recognized by T-cells 1 (97-116)
VPNAPPAYEKLSAEQSPPPY

SEQ ID NO: 4265 - protein, 16 aa, Artificial Sequence
  Gamma-secretase C-terminal fragment 59 (581-596)
FAEDVGSNKGAIIGLM

SEQ ID NO: 4266 - protein, 9 aa, Artificial Sequence
  Ubiquitin carboxyl-terminal hydrolase 11 (583-591)
FTWEGLYNV

SEQ ID NO: 4267 - protein, 10 aa, Artificial Sequence
  Ataxin-10 (324-333)
QVFPGLLERV

SEQ ID NO: 4268 - protein, 9 aa, Artificial Sequence
  Vacuolar protein sorting-associated protein 13B (29-37)
SLWGGDVVL

SEQ ID NO: 4269 - protein, 10 aa, Artificial Sequence
  Farnesyl pyrophosphate synthase (238-247)
YLDLFGDPSV

SEQ ID NO: 4270 - protein, 9 aa, Artificial Sequence
  Suppressor of SWI4 1 homolog (26-34)
AANPHSFVF

SEQ ID NO: 4271 - protein, 11 aa, Artificial Sequence
  Golgin subfamily A member 7 (65-75)
AEAEKLGGQSY

SEQ ID NO: 4272 - protein, 9 aa, Artificial Sequence
  DNA replication licensing factor MCM4 (741-749)
AEAHAKVRL

SEQ ID NO: 4273 - protein, 9 aa, Artificial Sequence
  Stomatin-like protein 2, mitochondrial (255-263)
AEAIRILAA

SEQ ID NO: 4274 - protein, 9 aa, Artificial Sequence
  Nuclear pore complex protein Nup107 (415-423)
AEDELFNRY

SEQ ID NO: 4275 - protein, 11 aa, Artificial Sequence
  N-alpha-acetyltransferase 10 (45-55)
AEDENGKIVGY

SEQ ID NO: 4276 - protein, 11 aa, Artificial Sequence
  Cytochrome c oxidase subunit 6B1 (2-12)
AEDMETKIKNY

SEQ ID NO: 4277 - protein, 9 aa, Artificial Sequence
  General transcription factor II-I repeat domain-containing protein 2B (397-405)
AEFIKFTVI

SEQ ID NO: 4278 - protein, 9 aa, Artificial Sequence
  Heterogeneous nuclear ribonucleoprotein A0 (110-118)
AEGDLIEHF

SEQ ID NO: 4279 - protein, 11 aa, Artificial Sequence
  60S ribosomal protein L8 (33-43)
AEGIHTGQFVY

SEQ ID NO: 4280 - protein, 9 aa, Artificial Sequence
  Condensin complex subunit 3 (712-720)
AEGLAKLMF

SEQ ID NO: 4281 - protein, 9 aa, Artificial Sequence
  T-complex protein 1 subunit gamma (109-117)
AEHFLEQQM

SEQ ID NO: 4282 - protein, 10 aa, Artificial Sequence
  Spectrin beta chain, non-erythrocytic 1 (1958-1967)
AEIDARNDSF

SEQ ID NO: 4283 - protein, 9 aa, Artificial Sequence
  Regulation of nuclear pre-mRNA domain-containing protein 1A (232-240)
AEIDDRKQL

SEQ ID NO: 4284 - protein, 10 aa, Artificial Sequence
  40S ribosomal protein SA (218-227)
AEKAVTKEEF

SEQ ID NO: 4285 - protein, 9 aa, Artificial Sequence
  Helicase SRCAP (394-402)
AESLQPKGY

SEQ ID NO: 4286 - protein, 9 aa, Artificial Sequence
  Spartin (569-577)
AETVQTVRY

SEQ ID NO: 4287 - protein, 9 aa, Artificial Sequence
  Uncharacterized protein ZMYM6NB (44-52)
AEVFPLKVF

SEQ ID NO: 4288 - protein, 10 aa, Artificial Sequence
  CLIP-associating protein 1 (357-366)
AEYDNFFQHL

SEQ ID NO: 4289 - protein, 9 aa, Artificial Sequence
  Alpha-actinin-4 (306-314)
AIDQLHLEY

SEQ ID NO: 4290 - protein, 9 aa, Artificial Sequence
  Nucleolar protein 58 (12-20)
AIFKVLNEK

SEQ ID NO: 4291 - protein, 10 aa, Artificial Sequence
  Serine/threonine-protein kinase Kist (151-160)
AIIDHIFASK

SEQ ID NO: 4292 - protein, 10 aa, Artificial Sequence
  Transcription factor Sp2 (106-115)
AIQNPTMINK

SEQ ID NO: 4293 - protein, 9 aa, Artificial Sequence
  Apolipoprotein L1 (142-150)
ALADGVQKV

SEQ ID NO: 4294 - protein, 9 aa, Artificial Sequence
  Tankyrase-2 (1234-1242)
ALAEYVIYR

SEQ ID NO: 4295 - protein, 9 aa, Artificial Sequence
  Uncharacterized protein C19orf43 (126-134)
ALKTGIVAK

SEQ ID NO: 4296 - protein, 10 aa, Artificial Sequence
  Heat shock protein HSP 90-alpha (740-749)
ALRDNSTMGY

SEQ ID NO: 4297 - protein, 9 aa, Artificial Sequence
  X-ray repair cross-complementing protein 5 (376-384)
ALSSLIHAL

SEQ ID NO: 4298 - protein, 10 aa, Artificial Sequence
  Nucleolar protein 7 (190-199)
AQAFIHNSLY

SEQ ID NO: 4299 - protein, 9 aa, Artificial Sequence
  U5 small nuclear ribonucleoprotein 200 kDa helicase (1246-1254)
AQDEHLITF

SEQ ID NO: 4300 - protein, 9 aa, Artificial Sequence
  15 kDa selenoprotein (78-86)
AQFETKKLY

SEQ ID NO: 4301 - protein, 10 aa, Artificial Sequence
  Prelamin-A/C (169-178)
AQHEDQVEQY

SEQ ID NO: 4302 - protein, 9 aa, Artificial Sequence
  Ribosomal RNA processing protein 1 homolog B (90-98)
AQHLFIQTF

SEQ ID NO: 4303 - protein, 9 aa, Artificial Sequence
  116 kDa U5 small nuclear ribonucleoprotein component (574-582)
AQIFRPLKF

SEQ ID NO: 4304 - protein, 9 aa, Artificial Sequence
  Paraneoplastic antigen Ma1 (246-254)
AQIKFLNTY

SEQ ID NO: 4305 - protein, 10 aa, Artificial Sequence
  Retinoic acid-induced protein 1 (1522-1531)
AQKQPGHTNY

SEQ ID NO: 4306 - protein, 9 aa, Artificial Sequence
  ADP-ribosylation factor GTPase-activating protein 2 (233-241)
AQKVSSQSF

SEQ ID NO: 4307 - protein, 9 aa, Artificial Sequence
  Nucleolar protein 56 (144-152)
AQLGLGHSY

SEQ ID NO: 4308 - protein, 9 aa, Artificial Sequence
  Catenin beta-1 (481-489)
AQNAVRLHY

SEQ ID NO: 4309 - protein, 11 aa, Artificial Sequence
  nuclear pore complex protein Nup98 isoform 2 proprotein (110-120)
AQNKPTGFGNF

SEQ ID NO: 4310 - protein, 11 aa, Artificial Sequence
  RNA-binding protein 14 (530-540)
AQQHPQAAASY

SEQ ID NO: 4311 - protein, 9 aa, Artificial Sequence
  Eukaryotic initiation factor 4A-I (113-121)
AQQIQKVVM

SEQ ID NO: 4312 - protein, 9 aa, Artificial Sequence
  Septin-7 (21-29)
AQQKNLEGY

SEQ ID NO: 4313 - protein, 9 aa, Artificial Sequence
  Protein polybromo-1 (234-242)
AQRIQNGSY

SEQ ID NO: 4314 - protein, 10 aa, Artificial Sequence
  Annexin A2 (66-75)
AQRQDIAFAY

SEQ ID NO: 4315 - protein, 10 aa, Artificial Sequence
  Annexin A4 (49-58)
AQRQEIRTAY

SEQ ID NO: 4316 - protein, 10 aa, Artificial Sequence
  Centromere protein F (348-357)
AQYDQASTKY

SEQ ID NO: 4317 - protein, 11 aa, Artificial Sequence
  60S ribosomal protein L22-like 1 (118-128)
ASDKETYELRY

SEQ ID NO: 4318 - protein, 10 aa, Artificial Sequence
  Histone H2B type 1-A (76-85)
ASEASRLAHY

SEQ ID NO: 4319 - protein, 10 aa, Artificial Sequence
  ADP-dependent glucokinase (24-33)
ASEFPGAQHY

SEQ ID NO: 4320 - protein, 9 aa, Artificial Sequence
  Heterogeneous nuclear ribonucleoprotein U (205-213)
ASYGVSKGK

SEQ ID NO: 4321 - protein, 10 aa, Artificial Sequence
  High affinity cAMP-specific 3',5'-cyclic phosphodiesterase 7A (294-303)
ATDISRQNEY

SEQ ID NO: 4322 - protein, 9 aa, Artificial Sequence
  E3 ubiquitin-protein ligase UBR2 (31-39)
ATDLTREVY

SEQ ID NO: 4323 - protein, 9 aa, Artificial Sequence
  m7GpppX diphosphatase (135-143)
ATEKHLQKY

SEQ ID NO: 4324 - protein, 11 aa, Artificial Sequence
  Microtubule-actin cross-linking factor 1, isoforms 1/2/3/5 (326-336)
ATEVDSRWQEY

SEQ ID NO: 4325 - protein, 9 aa, Artificial Sequence
  YTH domain-containing protein 1 (92-100)
ATEYKNEEY

SEQ ID NO: 4326 - protein, 9 aa, Artificial Sequence
  Eukaryotic translation initiation factor 5A-1 (146-154)
AVAIKAMAK

SEQ ID NO: 4327 - protein, 10 aa, Artificial Sequence
  Activating transcription factor 7-interacting protein 1 (621-630)
AVFDKTLAEL

SEQ ID NO: 4328 - protein, 9 aa, Artificial Sequence
  Transmembrane protein 258 (16-24)
AVFPHLTVV

SEQ ID NO: 4329 - protein, 11 aa, Artificial Sequence
  U3 small nucleolar RNA-associated protein 6 homolog (467-477)
AVIGADSVTLK

SEQ ID NO: 4330 - protein, 9 aa, Artificial Sequence
  Nucleolar RNA helicase 2 (357-365)
AVIGDVIRV

SEQ ID NO: 4331 - protein, 10 aa, Artificial Sequence
  Nucleosome assembly protein 1-like 1 (107-116)
AVLYQPLFDK

SEQ ID NO: 4332 - protein, 10 aa, Artificial Sequence
  MICOS complex subunit MIC60 (247-256)
AVNAHSNILK

SEQ ID NO: 4333 - protein, 9 aa, Artificial Sequence
  Elongation of very long chain fatty acids protein 5 (276-284)
AVNGHTNSF

SEQ ID NO: 4334 - protein, 9 aa, Artificial Sequence
  DNA-directed RNA polymerase II subunit RPB7 (87-95)
AVVTQVNKV

SEQ ID NO: 4335 - protein, 9 aa, Artificial Sequence
  RRP12-like protein (704-712)
DEAAISKLY

SEQ ID NO: 4336 - protein, 11 aa, Artificial Sequence
  26S protease regulatory subunit 6B (265-275)
DEIDAIATKRF

SEQ ID NO: 4337 - protein, 11 aa, Artificial Sequence
  26S protease regulatory subunit 7 (275-285)
DEIDAIGGARF

SEQ ID NO: 4338 - protein, 11 aa, Artificial Sequence
  26S protease regulatory subunit 4 (285-295)
DEIDAIGTKRY

SEQ ID NO: 4339 - protein, 9 aa, Artificial Sequence
  Nucleolar protein 11 (17-25)
DENSVIKSF

SEQ ID NO: 4340 - protein, 9 aa, Artificial Sequence
  Prothymosin alpha (16-24)
DLKEKKEVV

SEQ ID NO: 4341 - protein, 10 aa, Artificial Sequence
  Vezatin (553-562)
DSDFRKDDFY

SEQ ID NO: 4342 - protein, 9 aa, Artificial Sequence
  Protein AF-10 (379-387)
DSDLRNDSY

SEQ ID NO: 4343 - protein, 9 aa, Artificial Sequence
  Negative elongation factor C/D (348-356)
DTDISLIRY

SEQ ID NO: 4344 - protein, 9 aa, Artificial Sequence
  Transcription factor E2F1 (237-245)
DTDSQRLAY

SEQ ID NO: 4345 - protein, 9 aa, Artificial Sequence
  RNA-binding protein 6 (398-406)
DTDYRSMEY

SEQ ID NO: 4346 - protein, 10 aa, Artificial Sequence
  Eukaryotic translation initiation factor 4 gamma 3 (1509-1518)
DTEKELQALY

SEQ ID NO: 4347 - protein, 11 aa, Artificial Sequence
  Next to BRCA1 gene 1 protein (720-730)
DTSRPLGDSMY

SEQ ID NO: 4348 - protein, 9 aa, Artificial Sequence
  Mitochondrial import receptor subunit TOM7 homolog (7-15)
EAKQRLQQL

SEQ ID NO: 4349 - protein, 10 aa, Artificial Sequence
  Heterogeneous nuclear ribonucleoprotein U-like protein 1 (585-594)
EEADKLVRQY

SEQ ID NO: 4350 - protein, 9 aa, Artificial Sequence
  Poly (ADP-ribose) polymerase 1 (809-817)
EEAEIIRKY

SEQ ID NO: 4351 - protein, 10 aa, Artificial Sequence
  RB1 protein (1-10)
EEERLSIQNF

SEQ ID NO: 4352 - protein, 10 aa, Artificial Sequence
  Eukaryotic translation initiation factor 3 subunit C (81-90)
EEFELLGKAY

SEQ ID NO: 4353 - protein, 9 aa, Artificial Sequence
  Condensin-2 complex subunit G2 (490-498)
EEGAVDKSY

SEQ ID NO: 4354 - protein, 10 aa, Artificial Sequence
  Prelamin-A/C (53-62)
EELDFQKNIY

SEQ ID NO: 4355 - protein, 9 aa, Artificial Sequence
  Signal transducer and activator of transcription 1-alpha/beta (281-289)
EELEQKYTY

SEQ ID NO: 4356 - protein, 9 aa, Artificial Sequence
  Poly (ADP-ribose) polymerase 1 (168-176)
EELGFRPEY

SEQ ID NO: 4357 - protein, 9 aa, Artificial Sequence
  BolA-like protein 2 (62-70)
EELPHIHAF

SEQ ID NO: 4358 - protein, 9 aa, Artificial Sequence
  Signal transducer and activator of transcription 3 (285-293)
EELQQKVSY

SEQ ID NO: 4359 - protein, 10 aa, Artificial Sequence
  Ataxin-2-like protein (284-293)
EENYGVKTTY

SEQ ID NO: 4360 - protein, 9 aa, Artificial Sequence
  G patch domain-containing protein 4 (16-24)
EEQLLKHGW

SEQ ID NO: 4361 - protein, 10 aa, Artificial Sequence
  Golgi resident protein GCP60 (489-498)
EEVYAGSHQY

SEQ ID NO: 4362 - protein, 9 aa, Artificial Sequence
  AP-1 complex subunit sigma-3 (146-154)
EEYMNKPTF

SEQ ID NO: 4363 - protein, 9 aa, Artificial Sequence
  Transferrin receptor protein 1 (575-583)
ELIERIPEL

SEQ ID NO: 4364 - protein, 9 aa, Artificial Sequence
  Cleavage stimulation factor subunit 3 (52-60)
ETALLVDRY

SEQ ID NO: 4365 - protein, 11 aa, Artificial Sequence
  ATP-dependent RNA helicase DDX24 (571-581)
ETDEKDFYLYY

SEQ ID NO: 4366 - protein, 10 aa, Artificial Sequence
  Mediator of RNA polymerase II transcription subunit 23 (175-184)
ETDHINQIGY

SEQ ID NO: 4367 - protein, 10 aa, Artificial Sequence
  Sorting and assembly machinery component 50 homolog (206-215)
ETDRGMSAEY

SEQ ID NO: 4368 - protein, 11 aa, Artificial Sequence
  Protein polybromo-1 (1182-1192)
ETEHEPTKMFY

SEQ ID NO: 4369 - protein, 11 aa, Artificial Sequence
  Protein LAP2 (803-813)
ETEHLENGNKY

SEQ ID NO: 4370 - protein, 9 aa, Artificial Sequence
  Spectrin beta chain, erythrocytic (299-307)
ETEKMIEKY

SEQ ID NO: 4371 - protein, 10 aa, Artificial Sequence
  E3 ubiquitin-protein ligase RBBP6 (790-799)
ETEREYFNRY

SEQ ID NO: 4372 - protein, 9 aa, Artificial Sequence
  Putative eukaryotic translation initiation factor 2 subunit 3-like protein (322-330)
FAEHNDLQY

SEQ ID NO: 4373 - protein, 9 aa, Artificial Sequence
  40S ribosomal protein S18 (28-36)
FAITAIKGV

SEQ ID NO: 4374 - protein, 9 aa, Artificial Sequence
  Keratinocyte-associated protein 2 (110-118)
FASGLIHRV

SEQ ID NO: 4375 - protein, 9 aa, Artificial Sequence
  Dolichyl-diphosphooligosaccharide-proteinosyltransferase subunit DAD1 (99-107)
FASTILHLV

SEQ ID NO: 4376 - protein, 9 aa, Artificial Sequence
  Minor histocompatibility antigen H13 (236-244)
FEAPIKLVF

SEQ ID NO: 4377 - protein, 9 aa, Artificial Sequence
  Catenin alpha-2 (609-617)
FIDASRLVY

SEQ ID NO: 4378 - protein, 11 aa, Artificial Sequence
  TBC1 domain family member 31 (560-570)
FIDHDITSQLY

SEQ ID NO: 4379 - protein, 9 aa, Artificial Sequence
  Poly (ADP-ribose) polymerase 4 (797-805)
FIFSDTHEL

SEQ ID NO: 4380 - protein, 11 aa, Artificial Sequence
  Basic leucine zipper and W2 domain-containing protein 1 (53-63)
FLDASGAKLDY

SEQ ID NO: 4381 - protein, 10 aa, Artificial Sequence
  Neutral alpha-glucosidase AB (604-613)
FLDDGHTFNY

SEQ ID NO: 4382 - protein, 10 aa, Artificial Sequence
  RuvB-like 2 (433-442)
FLDESRSTQY

SEQ ID NO: 4383 - protein, 9 aa, Artificial Sequence
  Signal transducer and activator of transcription 1-alpha/beta (14-22)
FLEQVHQLY

SEQ ID NO: 4384 - protein, 9 aa, Artificial Sequence
  Protein MCM10 homolog (333-341)
FLFGEVHKA

SEQ ID NO: 4385 - protein, 10 aa, Artificial Sequence
  Hemoglobin subunit alpha (5-14)
FLSFPTTKTY

SEQ ID NO: 4386 - protein, 9 aa, Artificial Sequence
  Plexin-C1 (1065-1073)
FLVTVIHTL

SEQ ID NO: 4387 - protein, 9 aa, Artificial Sequence
  DNA repair protein XRCC1 (161-169)
FQNPFRSEL

SEQ ID NO: 4388 - protein, 9 aa, Artificial Sequence
  Protein AATF (298-306)
FQYPDTRYL

SEQ ID NO: 4389 - protein, 9 aa, Artificial Sequence
  Short transient receptor potential channel 4-associated protein (457-465)
FSDHHENKY

SEQ ID NO: 4390 - protein, 9 aa, Artificial Sequence
  Cell cycle progression protein 1 (186-194)
FSDYLHPQY

SEQ ID NO: 4391 - protein, 9 aa, Artificial Sequence
  Dihydrofolate reductase, mitochondrial (149-157)
FSEIDLEKY

SEQ ID NO: 4392 - protein, 10 aa, Artificial Sequence
  Splicing factor 3A subunit 3 (130-139)
FTDEEGYGRY

SEQ ID NO: 4393 - protein, 10 aa, Artificial Sequence
  Bifunctional glutamate/proline-tRNA ligase (48-57)
FTDVNSILRY

SEQ ID NO: 4394 - protein, 11 aa, Artificial Sequence
  RNMT-activating mini protein (19-29)
FTENDKEYQEY

SEQ ID NO: 4395 - protein, 9 aa, Artificial Sequence
  ATP-dependent RNA helicase DDX24 (801-809)
FTESQKTKY

SEQ ID NO: 4396 - protein, 9 aa, Artificial Sequence
  Eukaryotic translation initiation factor 4 gamma 1 (1377-1385)
FVAEQKVEY

SEQ ID NO: 4397 - protein, 9 aa, Artificial Sequence
  Coatomer subunit delta (9-17)
FVETESVRY

SEQ ID NO: 4398 - protein, 9 aa, Artificial Sequence
  Coatomer subunit alpha (641-649)
FVKDEKTRF

SEQ ID NO: 4399 - protein, 9 aa, Artificial Sequence
  Mothers against decapentaplegic homolog 9 (418-426)
FVKGWGAEY

SEQ ID NO: 4400 - protein, 10 aa, Artificial Sequence
  Ubiquitin-like protein FUBI (4-13)
FVRAQELHTF

SEQ ID NO: 4401 - protein, 9 aa, Artificial Sequence
  Lysine-tRNA ligase (119-127)
GEDPYPHKF

SEQ ID NO: 4402 - protein, 9 aa, Artificial Sequence
  Cytochrome c oxidase subunit 6A1, mitochondrial (7-15)
GEEGSARMW

SEQ ID NO: 4403 - protein, 9 aa, Artificial Sequence
  Polycomb protein SUZ12 (549-557)
GEVEQQRTY

SEQ ID NO: 4404 - protein, 10 aa, Artificial Sequence
  SNARE-associated protein Snapin (127-136)
GIYPPGSPGK

SEQ ID NO: 4405 - protein, 11 aa, Artificial Sequence
  Ataxin-10 (379-389)
GLADASLLKKV

SEQ ID NO: 4406 - protein, 9 aa, Artificial Sequence
  Signal recognition particle 54 kDa protein (302-310)
GLIDKVNEL

SEQ ID NO: 4407 - protein, 9 aa, Artificial Sequence
  Probable JmjC domain-containing histone demethylation protein 2C (846-854)
GQAHPSASY

SEQ ID NO: 4408 - protein, 9 aa, Artificial Sequence
  Putative ATP-dependent RNA helicase DDX11-like protein 8 (825-833)
GQAPPGKAL

SEQ ID NO: 4409 - protein, 9 aa, Artificial Sequence
  General transcription factor 3C polypeptide 1 (604-612)
GQDKPHETY

SEQ ID NO: 4410 - protein, 10 aa, Artificial Sequence
  Tonsoku-like protein (670-679)
GQDPHSSQAF

SEQ ID NO: 4411 - protein, 9 aa, Artificial Sequence
  Nuclear pore complex protein Nup214 (1208-1216)
GQFSKPFSF

SEQ ID NO: 4412 - protein, 11 aa, Artificial Sequence
  ATP-dependent 6-phosphofructokinase, platelet type (125-135)
GQIDKEAVQKY

SEQ ID NO: 4413 - protein, 9 aa, Artificial Sequence
  Alpha-endosulfine (45-53)
GQKPGGSDF

SEQ ID NO: 4414 - protein, 9 aa, Artificial Sequence
  Heterogeneous nuclear ribonucleoprotein U (812-820)
GQKPWSQHY

SEQ ID NO: 4415 - protein, 11 aa, Artificial Sequence
  60S ribosomal protein L26 (64-74)
GQQIGKVVQVY

SEQ ID NO: 4416 - protein, 10 aa, Artificial Sequence
  60S ribosomal protein L8 (3-12)
GQRKGAGSVF

SEQ ID NO: 4417 - protein, 9 aa, Artificial Sequence
  60S ribosomal protein L28 (69-77)
GQRKPATSY

SEQ ID NO: 4418 - protein, 9 aa, Artificial Sequence
  DNA mismatch repair protein Msh2 (157-165)
GQRQVGVGY

SEQ ID NO: 4419 - protein, 9 aa, Artificial Sequence
  Chromodomain-helicase-DNA-binding protein 8 (210-218)
GQSKAVKVY

SEQ ID NO: 4420 - protein, 9 aa, Artificial Sequence
  Cell division cycle protein 27 homolog (325-333)
GQTGTKSVF

SEQ ID NO: 4421 - protein, 9 aa, Artificial Sequence
  Transmembrane protein 43 (137-145)
GQVKKETRY

SEQ ID NO: 4422 - protein, 9 aa, Artificial Sequence
  Clathrin heavy chain 1 (496-504)
GQVQKIVLY

SEQ ID NO: 4423 - protein, 10 aa, Artificial Sequence
  Disintegrin and metalloproteinase domain-containing protein 10 (19-28)
GQYGNPLNKY

SEQ ID NO: 4424 - protein, 11 aa, Artificial Sequence
  Protein transport protein Sec23B (560-570)
GQYNKEDPTSF

SEQ ID NO: 4425 - protein, 9 aa, Artificial Sequence
  Protein CASP (561-569)
GSDDTELRY

SEQ ID NO: 4426 - protein, 10 aa, Artificial Sequence
  Gem-associated protein 5 (444-453)
GTDDGKVGLY

SEQ ID NO: 4427 - protein, 9 aa, Artificial Sequence
  Ribosomal biogenesis protein LAS1L (107-115)
GTDELRLLY

SEQ ID NO: 4428 - protein, 9 aa, Artificial Sequence
  WD repeat-containing protein 34 (398-406)
GTDGHVHLY

SEQ ID NO: 4429 - protein, 11 aa, Artificial Sequence
  DnaJ homolog subfamily B member 4 (38-48)
GTDGQGGTFRY

SEQ ID NO: 4430 - protein, 9 aa, Artificial Sequence
  Tyrosine-protein kinase Fyn (31-39)
GTDPTPQHY

SEQ ID NO: 4431 - protein, 9 aa, Artificial Sequence
  Activating signal cointegrator 1 (235-243)
GTLNQPLTK

SEQ ID NO: 4432 - protein, 9 aa, Artificial Sequence
  Putative mitochondrial import inner membrane translocase subunit Tim23B (113-121)
GTMTGMLYK

SEQ ID NO: 4433 - protein, 10 aa, Artificial Sequence
  Peroxisomal acyl-coenzyme A oxidase 1 (263-272)
GTYVKPLSNK

SEQ ID NO: 4434 - protein, 9 aa, Artificial Sequence
  HLA class II histocompatibility antigen, DO alpha chain (37-45)
GTYVSSVPR

SEQ ID NO: 4435 - protein, 9 aa, Artificial Sequence
  Poly (ADP-ribose) polymerase 14 (924-932)
GVFGFPLGR

SEQ ID NO: 4436 - protein, 10 aa, Artificial Sequence
  Cytosolic non-specific dipeptidase (106-115)
GVYGGSVHEA

SEQ ID NO: 4437 - protein, 10 aa, Artificial Sequence
  Mediator of RNA polymerase II transcription subunit 18 (127-136)
HEFVAKGHLF

SEQ ID NO: 4438 - protein, 10 aa, Artificial Sequence
  60S ribosomal protein L7 (192-201)
HEIYTVGKRF

SEQ ID NO: 4439 - protein, 9 aa, Artificial Sequence
  Coatomer subunit alpha (103-111)
HEYPWILSA

SEQ ID NO: 4440 - protein, 10 aa, Artificial Sequence
  Zinc finger protein 548 (24-33)
HLDEAQRLLY

SEQ ID NO: 4441 - protein, 9 aa, Artificial Sequence
  Protein FAM32A (95-103)
HLDTLTEHY

SEQ ID NO: 4442 - protein, 9 aa, Artificial Sequence
  Heat shock protein HSP 90-alpha A2 (189-197)
HLKEDQTEY

SEQ ID NO: 4443 - protein, 9 aa, Artificial Sequence
  Myc-associated zinc finger protein (411-419)
HLNSHVRQV

SEQ ID NO: 4444 - protein, 9 aa, Artificial Sequence
  Heterogeneous nuclear ribonucleoproteins A2/B1 (127-135)
HLRDYFEEY

SEQ ID NO: 4445 - protein, 9 aa, Artificial Sequence
  V-type proton ATPase 116 kDa subunit a isoform 4 (722-730)
HQAIHTIEY

SEQ ID NO: 4446 - protein, 9 aa, Artificial Sequence
  Elongation of very long chain fatty acids protein 5 (137-145)
HQITVLHVY

SEQ ID NO: 4447 - protein, 9 aa, Artificial Sequence
  Zinc finger protein 770 (99-107)
HQQLHNETY

SEQ ID NO: 4448 - protein, 9 aa, Artificial Sequence
  Protein SSXT (207-215)
HQQPPSQQY

SEQ ID NO: 4449 - protein, 9 aa, Artificial Sequence
  Zinc finger and BTB domain-containing protein 43 (140-148)
HQSPSSSSY

SEQ ID NO: 4450 - protein, 9 aa, Artificial Sequence
  Signal transducing adapter molecule 2 (410-418)
HQVTVAQSY

SEQ ID NO: 4451 - protein, 9 aa, Artificial Sequence
  Cirhin (556-564)
HSDQQVFEY

SEQ ID NO: 4452 - protein, 10 aa, Artificial Sequence
  Catenin beta-1 (645-654)
HSRNEGVATY

SEQ ID NO: 4453 - protein, 10 aa, Artificial Sequence
  U3 small nucleolar RNA-associated protein 6 homolog (267-276)
HTDDPLTWDY

SEQ ID NO: 4454 - protein, 9 aa, Artificial Sequence
  DTW domain-containing protein 1 (175-183)
HTDILKEKY

SEQ ID NO: 4455 - protein, 10 aa, Artificial Sequence
  Bone morphogenetic protein receptor type-2 (316-325)
HTELPRGDHY

SEQ ID NO: 4456 - protein, 9 aa, Artificial Sequence
  Dedicator of cytokinesis protein 7 (913-921)
IASDIVSRF

SEQ ID NO: 4457 - protein, 9 aa, Artificial Sequence
  Filamin-A (898-906)
IIDHHDNTY

SEQ ID NO: 4458 - protein, 9 aa, Artificial Sequence
  SUMO-activating enzyme subunit 1 (309-317)
ILAQEIVKA

SEQ ID NO: 4459 - protein, 10 aa, Artificial Sequence
  Superkiller viralicidic activity 2-like 2 (470-479)
ILFSEGLIKA

SEQ ID NO: 4460 - protein, 9 aa, Artificial Sequence
  60S ribosomal protein L15 (133-141)
ILIDPFHKA

SEQ ID NO: 4461 - protein, 9 aa, Artificial Sequence
  Transcription elongation factor SPT6 (1267-1275)
IMKIDIEKF

SEQ ID NO: 4462 - protein, 9 aa, Artificial Sequence
  X-ray repair cross-complementing protein 5 (528-536)
IPLSKIKTL

SEQ ID NO: 4463 - protein, 9 aa, Artificial Sequence
  Eukaryotic translation initiation factor 3 subunit C (783-791)
IQEESLRTY

SEQ ID NO: 4464 - protein, 9 aa, Artificial Sequence
  60S ribosomal protein L18a (95-103)
IQIMKVEEI

SEQ ID NO: 4465 - protein, 9 aa, Artificial Sequence
  Catalase (398-406)
IQKKAVKNF

SEQ ID NO: 4466 - protein, 9 aa, Artificial Sequence
  Tuftelin-interacting protein 11 (336-344)
IQNDRQLQY

SEQ ID NO: 4467 - protein, 9 aa, Artificial Sequence
  Hepatoma-derived growth factor-related protein 2 (84-92)
IQNNPHASY

SEQ ID NO: 4468 - protein, 9 aa, Artificial Sequence
  Putative annexin A2-like protein (319-327)
IQQDTKGDY

SEQ ID NO: 4469 - protein, 9 aa, Artificial Sequence
  Interferon-induced GTP-binding protein Mx1 (206-214)
IQRQETISL

SEQ ID NO: 4470 - protein, 9 aa, Artificial Sequence
  Protein transport protein Sec16A (1602-1610)
IQRTEAYEY

SEQ ID NO: 4471 - protein, 9 aa, Artificial Sequence
  Transcription elongation factor SPT5 (984-992)
IQVKVRDTY

SEQ ID NO: 4472 - protein, 11 aa, Artificial Sequence
  Splicing factor 3B subunit 4 (6-16)
ISERNQDATVY

SEQ ID NO: 4473 - protein, 9 aa, Artificial Sequence
  40S ribosomal protein S16 (87-95)
ISKALVAYY

SEQ ID NO: 4474 - protein, 9 aa, Artificial Sequence
  Serine/threonine-protein kinase 17B (51-59)
ISKSTGQEY

SEQ ID NO: 4475 - protein, 9 aa, Artificial Sequence
  Pre-mRNA-splicing factor CWC22 homolog (146-154)
ITDKNSLAY

SEQ ID NO: 4476 - protein, 10 aa, Artificial Sequence
  Serine/threonine-protein kinase mTOR (664-673)
ITDPDPDIRY

SEQ ID NO: 4477 - protein, 10 aa, Artificial Sequence
  AAC42003.1 (85-94)
ITDSAGHILY

SEQ ID NO: 4478 - protein, 9 aa, Artificial Sequence
  E3 ubiquitin-protein ligase RNF213 (4163-4171)
ITEDKTELY

SEQ ID NO: 4479 - protein, 9 aa, Artificial Sequence
  RNA polymerase I-specific transcription initiation factor RRN3 (516-524)
ITNKYQLVF

SEQ ID NO: 4480 - protein, 9 aa, Artificial Sequence
  Nuclear receptor corepressor 2 (1441-1449)
ITQGTPLKY

SEQ ID NO: 4481 - protein, 11 aa, Artificial Sequence
  HLA class II histocompatibility antigen, DQ alpha 1 chain (3-13)
IVADHVASYGV

SEQ ID NO: 4482 - protein, 9 aa, Artificial Sequence
  Putative eukaryotic translation initiation factor 2 subunit 3-like protein (59-67)
KAISGVHTV

SEQ ID NO: 4483 - protein, 9 aa, Artificial Sequence
  Nuclear pore membraneoprotein 210 (219-227)
KARIQEAVY

SEQ ID NO: 4484 - protein, 9 aa, Artificial Sequence
  Heat shock protein HSP 90-beta (452-460)
KEFDGKSLV

SEQ ID NO: 4485 - protein, 9 aa, Artificial Sequence
  NADH dehydrogenase (ubiquinone) 1 beta subcomplex subunit 10 (121-129)
KEVEQFTQV

SEQ ID NO: 4486 - protein, 9 aa, Artificial Sequence
  Lysine-specific histone demethylase 1A (454-462)
KIKELHQQY

SEQ ID NO: 4487 - protein, 9 aa, Artificial Sequence
  Thioredoxin-interacting protein (6-14)
KIKSFEVVF

SEQ ID NO: 4488 - protein, 9 aa, Artificial Sequence
  60S ribosomal protein L27 (67-75)
KIKSFVKVY

SEQ ID NO: 4489 - protein, 9 aa, Artificial Sequence
  60S ribosomal protein L5 (117-125)
KIYEGQVEV

SEQ ID NO: 4490 - protein, 10 aa, Artificial Sequence
  Putative elongation factor 1-alpha-like 3 (386-395)
KLEDGPKFLK

SEQ ID NO: 4491 - protein, 10 aa, Artificial Sequence
  Long-chain-fatty-acid-CoA ligase 4 (40-49)
KLFDHAVSKF

SEQ ID NO: 4492 - protein, 9 aa, Artificial Sequence
  Signal recognition particle receptor subunit alpha (81-89)
KLIDDVHRL

SEQ ID NO: 4493 - protein, 11 aa, Artificial Sequence
  Embryonic stem cell-specific 5-hydroxymethylcytosine-binding protein (239-249)
KLIHPTENITF

SEQ ID NO: 4494 - protein, 9 aa, Artificial Sequence
  Dolichyl-diphosphooligosaccharide-proteinosyltransferase subunit DAD1 (25-33)
KLLDAYLLY

SEQ ID NO: 4495 - protein, 10 aa, Artificial Sequence
  DNA-directed RNA polymerases I, II, and III subunit RPABC5 (58-67)
KLLNYAPLEK

SEQ ID NO: 4496 - protein, 9 aa, Artificial Sequence
  Dystonin (4751-4759)
KLSDLDNKL

SEQ ID NO: 4497 - protein, 10 aa, Artificial Sequence
  60S ribosomal protein L23a (115-124)
KLYDIDVAKV

SEQ ID NO: 4498 - protein, 10 aa, Artificial Sequence
  ATP-citrate synthase (650-659)
KLYRPGSVAY

SEQ ID NO: 4499 - protein, 9 aa, Artificial Sequence
  Protein quaking (81-89)
KLYVPVKEY

SEQ ID NO: 4500 - protein, 9 aa, Artificial Sequence
  Homocysteine-responsive endoplasmic reticulum-resident ubiquitin-like domain member 1 protein (92-100)
KMPEINAKV

SEQ ID NO: 4501 - protein, 9 aa, Artificial Sequence
  Transducin-like enhancer protein 2 (76-84)
KQAEIVKRL

SEQ ID NO: 4502 - protein, 9 aa, Artificial Sequence
  Gamma-interferon-inducible protein 16 (309-317)
KQASGNIVY

SEQ ID NO: 4503 - protein, 10 aa, Artificial Sequence
  Cytoplasmic dynein 1 heavy chain 1 (1181-1190)
KQFEKQVELY

SEQ ID NO: 4504 - protein, 10 aa, Artificial Sequence
  Staphylococcal nuclease domain-containing protein 1 (869-878)
KQFQKVITEY

SEQ ID NO: 4505 - protein, 10 aa, Artificial Sequence
  Cytoplasmic dynein 1 heavy chain 1 (652-661)
KQIDRQLTAY

SEQ ID NO: 4506 - protein, 9 aa, Artificial Sequence
  Thioredoxin (3-11)
KQIESKTAF

SEQ ID NO: 4507 - protein, 9 aa, Artificial Sequence
  Ribonucleoside-diphosphate reductase large subunit (529-537)
KQIFETIYY

SEQ ID NO: 4508 - protein, 9 aa, Artificial Sequence
  ADP/ATP translocase 2 (43-51)
KQITADKQY

SEQ ID NO: 4509 - protein, 10 aa, Artificial Sequence
  Lamin-B receptor (234-243)
KQKDPSLLNF

SEQ ID NO: 4510 - protein, 10 aa, Artificial Sequence
  Asparagine synthetase (glutamine-hydrolyzing) (272-281)
KQLKEAQVQY

SEQ ID NO: 4511 - protein, 11 aa, Artificial Sequence
  Heterogeneous nuclear ribonucleoprotein L (455-465)
KQPAIMPGQSY

SEQ ID NO: 4512 - protein, 10 aa, Artificial Sequence
  Caprin-1 (536-545)
KQQNQYQASY

SEQ ID NO: 4513 - protein, 9 aa, Artificial Sequence
  DNA-dependent protein kinase catalytic subunit (2970-2978)
KQYDEALNK

SEQ ID NO: 4514 - protein, 10 aa, Artificial Sequence
  Alpha-actinin-4 (691-700)
KQYERSIVDY

SEQ ID NO: 4515 - protein, 9 aa, Artificial Sequence
  RAC-beta serine/threonine-protein kinase (30-38)
KSDGSFIGY

SEQ ID NO: 4516 - protein, 9 aa, Artificial Sequence
  Replication factor C subunit 1 (870-878)
KSDLFFHDY

SEQ ID NO: 4517 - protein, 10 aa, Artificial Sequence
  Pre-mRNA-processing factor 40 homolog A (164-173)
KSDSGKPYYY

SEQ ID NO: 4518 - protein, 9 aa, Artificial Sequence
  Helicase-like transcription factor (499-507)
KSDVHLNFY

SEQ ID NO: 4519 - protein, 9 aa, Artificial Sequence
  Pre-mRNA-splicing factor RBM22 (109-117)
KSDVNKEYY

SEQ ID NO: 4520 - protein, 9 aa, Artificial Sequence
  Kinesin-like protein KIF18A (241-249)
KTASINQNV

SEQ ID NO: 4521 - protein, 10 aa, Artificial Sequence
  Vacuolar protein sorting-associated protein 13A (1399-1408)
KTDDLTMVLY

SEQ ID NO: 4522 - protein, 9 aa, Artificial Sequence
  Chromodomain-helicase-DNA-binding protein 8 (165-173)
KTDESLTKY

SEQ ID NO: 4523 - protein, 9 aa, Artificial Sequence
  Raftlin (114-122)
KTDLHNEGY

SEQ ID NO: 4524 - protein, 9 aa, Artificial Sequence
  Coiled-coil domain-containing protein 94 (90-98)
KTDPENTDY

SEQ ID NO: 4525 - protein, 11 aa, Artificial Sequence
  Signal-induced proliferation-associated 1-like protein 2 (436-446)
KTDSTGTHSLY

SEQ ID NO: 4526 - protein, 11 aa, Artificial Sequence
  Pre-mRNA-processing-splicing factor 8 (341-351)
KTEDPDLPAFY

SEQ ID NO: 4527 - protein, 11 aa, Artificial Sequence
  Serine/arginine-rich splicing factor 3 (23-33)
KTELERAFGYY

SEQ ID NO: 4528 - protein, 10 aa, Artificial Sequence
  T-complex protein 1 subunit zeta-2 (196-205)
KTEVNSGFFY

SEQ ID NO: 4529 - protein, 9 aa, Artificial Sequence
  Periphilin-1 (297-305)
KTKEIEQVY

SEQ ID NO: 4530 - protein, 10 aa, Artificial Sequence
  Metastasis-associated protein MTA2 (311-320)
KTTDRYIQQK

SEQ ID NO: 4531 - protein, 9 aa, Artificial Sequence
  Spatacsin (1273-1281)
KVANIILSY

SEQ ID NO: 4532 - protein, 9 aa, Artificial Sequence
  Heterogeneous nuclear ribonucleoprotein A/B (227-235)
KVAQPKEVY

SEQ ID NO: 4533 - protein, 9 aa, Artificial Sequence
  Protein RRP5 homolog (1680-1688)
KVFERAVQY

SEQ ID NO: 4534 - protein, 9 aa, Artificial Sequence
  60 kDa heat shock protein, mitochondrial (344-352)
KVGEVIVTK

SEQ ID NO: 4535 - protein, 9 aa, Artificial Sequence
  Protein transport protein Sec61 subunit beta (67-75)
KVGPVPVLV

SEQ ID NO: 4536 - protein, 9 aa, Artificial Sequence
  40S ribosomal protein S19 (29-37)
KVPEWVDTV

SEQ ID NO: 4537 - protein, 9 aa, Artificial Sequence
  Protein DEK (315-323)
KVYENYPTY

SEQ ID NO: 4538 - protein, 9 aa, Artificial Sequence
  Cyclin-dependent kinases regulatory subunit 2 (11-19)
KYFDEHYEY

SEQ ID NO: 4539 - protein, 9 aa, Artificial Sequence
  Protein disulfide-isomerase A3 (16-24)
LAAARLAAA

SEQ ID NO: 4540 - protein, 9 aa, Artificial Sequence
  Heterogeneous nuclear ribonucleoprotein R (193-201)
LEYEDHKSA

SEQ ID NO: 4541 - protein, 9 aa, Artificial Sequence
  Lamina-associated polypeptide 2, isoform alpha (313-321)
LIKETTTGY

SEQ ID NO: 4542 - protein, 9 aa, Artificial Sequence
  60S ribosomal protein L28 (17-25)
LIKRNKQTY

SEQ ID NO: 4543 - protein, 9 aa, Artificial Sequence
  ATP synthase F(0) complex subunit C1, mitochondrial (21-29)
LIRPVSASF

SEQ ID NO: 4544 - protein, 9 aa, Artificial Sequence
  Cytospin-A (469-477)
LLDEHHISY

SEQ ID NO: 4545 - protein, 10 aa, Artificial Sequence
  Zinc finger protein 557 (59-68)
LLDPAQRTLY

SEQ ID NO: 4546 - protein, 10 aa, Artificial Sequence
  Clathrin heavy chain 1 (421-430)
LLDQGQLNKY

SEQ ID NO: 4547 - protein, 10 aa, Artificial Sequence
  Zinc finger protein 669 (106-115)
LLDSSQKNLY

SEQ ID NO: 4548 - protein, 10 aa, Artificial Sequence
  WD repeat-containing protein 6 (358-367)
LLEDKHFQSY

SEQ ID NO: 4549 - protein, 9 aa, Artificial Sequence
  Signal transducer and activator of transcription 6 (56-64)
LLSDTVQHL

SEQ ID NO: 4550 - protein, 9 aa, Artificial Sequence
  Antigen peptide transporter 1 (684-692)
LLYESPERY

SEQ ID NO: 4551 - protein, 9 aa, Artificial Sequence
  Retinoic acid receptor RXR-gamma (423-431)
LPALRSIGL

SEQ ID NO: 4552 - protein, 9 aa, Artificial Sequence
  Eukaryotic translation initiation factor 2-alpha kinase 1 (221-229)
LQHPNIVGY

SEQ ID NO: 4553 - protein, 9 aa, Artificial Sequence
  CDK5 regulatory subunit-associated protein 2 (355-363)
LQKAQTQEF

SEQ ID NO: 4554 - protein, 9 aa, Artificial Sequence
  Trifunctional purine biosynthetic protein adenosine-3 (429-437)
LQQPRSLTY

SEQ ID NO: 4555 - protein, 9 aa, Artificial Sequence
  Farnesyl pyrophosphate synthase (341-349)
LQRATPEQY

SEQ ID NO: 4556 - protein, 9 aa, Artificial Sequence
  R3H domain-containing protein 4 (70-78)
LQRLENTQY

SEQ ID NO: 4557 - protein, 9 aa, Artificial Sequence
  WD repeat-containing protein 27 (15-23)
LSDIVIEKY

SEQ ID NO: 4558 - protein, 9 aa, Artificial Sequence
  UAP56-interacting factor (99-107)
LSDKNIEQY

SEQ ID NO: 4559 - protein, 9 aa, Artificial Sequence
  Histone acetyltransferase KAT8 (325-333)
LSDLGKLSY

SEQ ID NO: 4560 - protein, 10 aa, Artificial Sequence
  Probable tRNA N6-adenosine threonylcarbamoyltransferase (315-324)
LSDSGVTQRY

SEQ ID NO: 4561 - protein, 10 aa, Artificial Sequence
  Deoxynucleotidyltransferase terminal-interacting protein 2 (252-261)
LSEINKPNFY

SEQ ID NO: 4562 - protein, 11 aa, Artificial Sequence
  Serpin B8 (74-84)
LSEVNRTGTQY

SEQ ID NO: 4563 - protein, 9 aa, Artificial Sequence
  ATP synthase subunit alpha, mitochondrial (160-168)
LTDADAMKY

SEQ ID NO: 4564 - protein, 9 aa, Artificial Sequence
  1,4-alpha-glucan-branching enzyme (569-577)
LTDDDLLRY

SEQ ID NO: 4565 - protein, 10 aa, Artificial Sequence
  26S proteasome non-ATPase regulatory subunit 2 (391-400)
LTDDGNKWLY

SEQ ID NO: 4566 - protein, 9 aa, Artificial Sequence
  Phosphatidylinositol 4,5-bisphosphate 3-kinase catalytic subunit alpha isoform (623-631)
LTDDKLSQY

SEQ ID NO: 4567 - protein, 9 aa, Artificial Sequence
  Probable threonine-tRNA ligase 2, cytoplasmic (435-443)
LTDFIREEY

SEQ ID NO: 4568 - protein, 10 aa, Artificial Sequence
  Coiled-coil domain-containing protein 127 (209-218)
LTDIFQHDTY

SEQ ID NO: 4569 - protein, 10 aa, Artificial Sequence
  Elongation factor 2 (162-171)
LTDITKGVQY

SEQ ID NO: 4570 - protein, 10 aa, Artificial Sequence
  Tuberin (146-155)
LTDNGRHITY

SEQ ID NO: 4571 - protein, 9 aa, Artificial Sequence
  Glucosylceramidase (252-260)
LTDPEAAKY

SEQ ID NO: 4572 - protein, 10 aa, Artificial Sequence
  ATPase family AAA domain-containing protein 5 (1663-1672)
LTDVREQNKY

SEQ ID NO: 4573 - protein, 9 aa, Artificial Sequence
  Casein kinase II subunit alpha (128-136)
LTDYDIRFY

SEQ ID NO: 4574 - protein, 10 aa, Artificial Sequence
  Gamma-tubulin complex component 2 (88-97)
LTEDKETLQY

SEQ ID NO: 4575 - protein, 9 aa, Artificial Sequence
  Integrator complex subunit 11 (242-250)
LTEKANHYY

SEQ ID NO: 4576 - protein, 9 aa, Artificial Sequence
  Pogo transposable element with KRAB domain (64-72)
LTEQQKALY

SEQ ID NO: 4577 - protein, 10 aa, Artificial Sequence
  Nuclear factor erythroid 2-related factor 2 (197-206)
LTEVDNYHFY

SEQ ID NO: 4578 - protein, 11 aa, Artificial Sequence
  Serpin B9 (74-84)
LTEVNKAGTQY

SEQ ID NO: 4579 - protein, 9 aa, Artificial Sequence
  Folliculin-interacting protein 2 (997-1005)
LVADLVHTV

SEQ ID NO: 4580 - protein, 9 aa, Artificial Sequence
  Pogo transposable element with KRAB domain (261-269)
LVDQRVAEY

SEQ ID NO: 4581 - protein, 10 aa, Artificial Sequence
  Exportin-5 (20-29)
MMDPNSTQRY

SEQ ID NO: 4582 - protein, 10 aa, Artificial Sequence
  Protein transport protein Sec61 subunit gamma (5-14)
MQFVEPSRQF

SEQ ID NO: 4583 - protein, 9 aa, Artificial Sequence
  Catenin beta-1 (662-670)
MSEDKPQDY

SEQ ID NO: 4584 - protein, 9 aa, Artificial Sequence
  Brefeldin A-inhibited guanine nucleotide-exchange protein 1 (574-582)
NAANIFERL

SEQ ID NO: 4585 - protein, 11 aa, Artificial Sequence
  Charged multivesicular body protein 5 (63-73)
NEIQEALSRSY

SEQ ID NO: 4586 - protein, 9 aa, Artificial Sequence
  Clathrin heavy chain 1 (935-943)
NENSLFKSL

SEQ ID NO: 4587 - protein, 9 aa, Artificial Sequence
  Calpain small subunit 1 (93-101)
NESEEVRQF

SEQ ID NO: 4588 - protein, 9 aa, Artificial Sequence
  PR domain zinc finger protein 15 (791-799)
NEVDGEYRY

SEQ ID NO: 4589 - protein, 11 aa, Artificial Sequence
  Nucleolar pre-ribosomal-associated protein 1 (127-137)
NEVDPGDWQKF

SEQ ID NO: 4590 - protein, 9 aa, Artificial Sequence
  DnaJ homolog subfamily C member 11 (261-269)
NLDKNTVGY

SEQ ID NO: 4591 - protein, 9 aa, Artificial Sequence
  Ubiquitin-conjugating enzyme E2 variant 3 (190-198)
NLDSQRLQY

SEQ ID NO: 4592 - protein, 9 aa, Artificial Sequence
  Clathrin heavy chain 1 (74-82)
NPASKVIAL

SEQ ID NO: 4593 - protein, 9 aa, Artificial Sequence
  Spermatid perinuclear RNA-binding protein (397-405)
NQIRPGLQY

SEQ ID NO: 4594 - protein, 9 aa, Artificial Sequence
  Dystonin (3331-3339)
NQKPPSAEF

SEQ ID NO: 4595 - protein, 9 aa, Artificial Sequence
  Microtubule-actin cross-linking factor 1, isoforms 1/2/3/5 (5369-5377)
NQKPPSAEY

SEQ ID NO: 4596 - protein, 9 aa, Artificial Sequence
  Cytosolic carboxypeptidase 1 (749-757)
NSDINSNHY

SEQ ID NO: 4597 - protein, 10 aa, Artificial Sequence
  DNA repair protein RAD51 homolog 1 (99-108)
NTDHQTQLLY

SEQ ID NO: 4598 - protein, 9 aa, Artificial Sequence
  Eukaryotic translation initiation factor 3 subunit C-like protein (462-470)
NTDPHSQEY

SEQ ID NO: 4599 - protein, 10 aa, Artificial Sequence
  Methionine aminopeptidase 1 (74-83)
NTDPWAGYRY

SEQ ID NO: 4600 - protein, 9 aa, Artificial Sequence
  Tyrosine-protein phosphatase non-receptor type 11 (414-422)
NTERTVWQY

SEQ ID NO: 4601 - protein, 9 aa, Artificial Sequence
  Protein UXT (66-74)
NVIERLQEA

SEQ ID NO: 4602 - protein, 9 aa, Artificial Sequence
  Nardilysin (107-115)
PSDPKQYRY

SEQ ID NO: 4603 - protein, 11 aa, Artificial Sequence
  Mediator of RNA polymerase II transcription subunit 13 (1456-1466)
PTDGDSHAVTY

SEQ ID NO: 4604 - protein, 9 aa, Artificial Sequence
  Absent in melanoma 1 protein (1215-1223)
PTDPKVVVY

SEQ ID NO: 4605 - protein, 11 aa, Artificial Sequence
  Ubiquitin carboxyl-terminal hydrolase 22 (453-463)
PTDSLNNDNKY

SEQ ID NO: 4606 - protein, 11 aa, Artificial Sequence
  ADP-sugar pyrophosphatase (6-16)
PTESSQNGKQY

SEQ ID NO: 4607 - protein, 9 aa, Artificial Sequence
  Vimentin (311-319)
QAKQESTEY

SEQ ID NO: 4608 - protein, 11 aa, Artificial Sequence
  Nuclear autoantigenic sperm protein (67-77)
QEAASLLGKKY

SEQ ID NO: 4609 - protein, 9 aa, Artificial Sequence
  Ras GTPase-activating protein-binding protein 1 (243-251)
QEDLRTFSW

SEQ ID NO: 4610 - protein, 10 aa, Artificial Sequence
  Nuclear pore complex protein Nup155 (718-727)
QEFLDRNSQF

SEQ ID NO: 4611 - protein, 9 aa, Artificial Sequence
  Cytosolic non-specific dipeptidase (28-36)
QEIPVNVRF

SEQ ID NO: 4612 - protein, 9 aa, Artificial Sequence
  Putative ATP-dependent RNA helicase DDX11-like protein 8 (240-248)
QLAQFVHEV

SEQ ID NO: 4613 - protein, 10 aa, Artificial Sequence
  Zinc finger protein 550 (19-28)
QLDLAQRTLY

SEQ ID NO: 4614 - protein, 10 aa, Artificial Sequence
  Zinc finger protein 674 (24-33)
QLDSAQKNLY

SEQ ID NO: 4615 - protein, 9 aa, Artificial Sequence
  Proteasome activator complex subunit 3 (33-41)
QLVDIIEKV

SEQ ID NO: 4616 - protein, 9 aa, Artificial Sequence
  Nucleoporin NUP188 homolog (1544-1552)
QQALHTVQY

SEQ ID NO: 4617 - protein, 9 aa, Artificial Sequence
  Homocysteine-responsive endoplasmic reticulum-resident ubiquitin-like domain member 1 protein (174-182)
QQIYARQYY

SEQ ID NO: 4618 - protein, 9 aa, Artificial Sequence
  Signal recognition particle subunit SRP72 (107-115)
QTDKLKELY

SEQ ID NO: 4619 - protein, 9 aa, Artificial Sequence
  Oxysterol-binding protein-related protein 8 (674-682)
QTEATQEKY

SEQ ID NO: 4620 - protein, 9 aa, Artificial Sequence
  Probable cation-transporting ATPase 13A3 (131-139)
QTESQQIRY

SEQ ID NO: 4621 - protein, 9 aa, Artificial Sequence
  Band 4.1-like protein 2 (42-50)
QTETKTITY

SEQ ID NO: 4622 - protein, 9 aa, Artificial Sequence
  26S proteasome non-ATPase regulatory subunit 13 (164-172)
QTIGNHASY

SEQ ID NO: 4623 - protein, 11 aa, Artificial Sequence
  60S ribosomal protein L28 (23-33)
QTYSTEPNNLK

SEQ ID NO: 4624 - protein, 11 aa, Artificial Sequence
  Cytochrome b-c1 complex subunit 9 (34-44)
RAFDQGADAIY

SEQ ID NO: 4625 - protein, 9 aa, Artificial Sequence
  Mitotic checkpoint protein BUB3 (186-194)
RAFPNKQGY

SEQ ID NO: 4626 - protein, 10 aa, Artificial Sequence
  X-ray repair cross-complementing protein 5 (296-305)
RANPQVGVAF

SEQ ID NO: 4627 - protein, 11 aa, Artificial Sequence
  Exocyst complex component 4 (551-561)
READLDFARQY

SEQ ID NO: 4628 - protein, 10 aa, Artificial Sequence
  Signal peptidase complex subunit 2 (185-194)
REAEFTKSIA

SEQ ID NO: 4629 - protein, 9 aa, Artificial Sequence
  Patatin-like phospholipase domain-containing protein 2 (30-38)
REHAPFLVA

SEQ ID NO: 4630 - protein, 8 aa, Artificial Sequence
  Tubulin beta-4A chain (2-9)
REIVHLQA

SEQ ID NO: 4631 - protein, 9 aa, Artificial Sequence
  ATP-binding cassette sub-family F member 3 (425-433)
REYEAQQQY

SEQ ID NO: 4632 - protein, 9 aa, Artificial Sequence
  Pre-mRNA-splicing factor ATP-dependent RNA helicase DHX15 (399-407)
RIFEPPPPK

SEQ ID NO: 4633 - protein, 10 aa, Artificial Sequence
  Actin-related protein 2/3 complex subunit 2 (9-18)
RIIEETLALK

SEQ ID NO: 4634 - protein, 9 aa, Artificial Sequence
  Protein FAM60A (102-110)
RIKSNQISK

SEQ ID NO: 4635 - protein, 10 aa, Artificial Sequence
  Chromobox protein homolog 6 (91-100)
RISDVHFSVK

SEQ ID NO: 4636 - protein, 10 aa, Artificial Sequence
  Splicing factor 3B subunit 1 (276-285)
RIYNDDKNTY

SEQ ID NO: 4637 - protein, 9 aa, Artificial Sequence
  FAS-associated factor 2 (75-83)
RIYSYVVSR

SEQ ID NO: 4638 - protein, 9 aa, Artificial Sequence
  26S proteasome non-ATPase regulatory subunit 3 (107-115)
RLNHYVLYK

SEQ ID NO: 4639 - protein, 11 aa, Artificial Sequence
  Cell division cycle protein 27 homolog (214-224)
RLNLESSNSKY

SEQ ID NO: 4640 - protein, 10 aa, Artificial Sequence
  Histone deacetylase 9 (670-679)
RLQETGLLNK

SEQ ID NO: 4641 - protein, 11 aa, Artificial Sequence
  F-box only protein 5 (140-150)
RLYEDSGYSSF

SEQ ID NO: 4642 - protein, 10 aa, Artificial Sequence
  ATP-binding cassette sub-family D member 1 (172-181)
RLYFSQQTYY

SEQ ID NO: 4643 - protein, 10 aa, Artificial Sequence
  V-type proton ATPase subunit d 1 (169-178)
RLYPEGLAQL

SEQ ID NO: 4644 - protein, 9 aa, Artificial Sequence
  Vimentin (13-21)
RMFGGPGTA

SEQ ID NO: 4645 - protein, 11 aa, Artificial Sequence
  Enhancer of rudimentary homolog (42-52)
RMNPNSPSITY

SEQ ID NO: 4646 - protein, 10 aa, Artificial Sequence
  ATP synthase subunit epsilon-like protein, mitochondrial (6-15)
RQAGLSYIRY

SEQ ID NO: 4647 - protein, 9 aa, Artificial Sequence
  Polyadenylate-binding protein 1 (374-382)
RQAHLTNQY

SEQ ID NO: 4648 - protein, 10 aa, Artificial Sequence
  Vimentin (310-319)
RQAKQESTEY

SEQ ID NO: 4649 - protein, 9 aa, Artificial Sequence
  Caprin-1 (297-305)
RQFMAETQF

SEQ ID NO: 4650 - protein, 10 aa, Artificial Sequence
  Splicing factor 3B subunit 1 (517-526)
RQITDKAREF

SEQ ID NO: 4651 - protein, 9 aa, Artificial Sequence
  Protein OS-9 (639-647)
RQKELESNY

SEQ ID NO: 4652 - protein, 10 aa, Artificial Sequence
  Interferon-induced, double-stranded RNA-activated protein kinase (18-27)
RQKQGVVLKY

SEQ ID NO: 4653 - protein, 10 aa, Artificial Sequence
  Alpha-taxilin (77-86)
RQLEDILSTY

SEQ ID NO: 4654 - protein, 11 aa, Artificial Sequence
  Prelamin-A/C (390-400)
RQNGDDPLLTY

SEQ ID NO: 4655 - protein, 11 aa, Artificial Sequence
  Spectrin beta chain, non-erythrocytic 1 (1161-1171)
RQNLLSQSHAY

SEQ ID NO: 4656 - protein, 10 aa, Artificial Sequence
  Tetratricopeptide repeat protein 9C (19-28)
RQPDNAKALY

SEQ ID NO: 4657 - protein, 9 aa, Artificial Sequence
  Eukaryotic translation initiation factor 3 subunit C (905-913)
RQQQSQTAY

SEQ ID NO: 4658 - protein, 11 aa, Artificial Sequence
  ATP-dependent RNA helicase DDX3X (603-613)
RQSSGASSSSF

SEQ ID NO: 4659 - protein, 9 aa, Artificial Sequence
  40S ribosomal protein S29 (44-52)
RQYAKDIGF

SEQ ID NO: 4660 - protein, 11 aa, Artificial Sequence
  Transmembrane emp24 domain-containing protein 4 (33-43)
RQYGSEGRFTF

SEQ ID NO: 4661 - protein, 9 aa, Artificial Sequence
  Non-receptor tyrosine-protein kinase TYK2 (521-529)
RSFPSVREL

SEQ ID NO: 4662 - protein, 9 aa, Artificial Sequence
  E3 ubiquitin-protein ligase AMFR (229-237)
RTAHVILRY

SEQ ID NO: 4663 - protein, 9 aa, Artificial Sequence
  Proteasome subunit alpha type-2 (113-121)
RVASVMQEY

SEQ ID NO: 4664 - protein, 10 aa, Artificial Sequence
  Calmodulin (91-100)
RVFDKDGNGY

SEQ ID NO: 4665 - protein, 10 aa, Artificial Sequence
  Nucleolysin TIA-1 isoform p40 (244-253)
RVFPDKGYSF

SEQ ID NO: 4666 - protein, 10 aa, Artificial Sequence
  Nucleolysin TIAR (213-222)
RVFPEKGYSF

SEQ ID NO: 4667 - protein, 10 aa, Artificial Sequence
  Kinesin-like protein KIF20A (466-475)
RVFQGFFTGR

SEQ ID NO: 4668 - protein, 11 aa, Artificial Sequence
  Fatty acid synthase (1694-1704)
RVFTTVGSAEK

SEQ ID NO: 4669 - protein, 11 aa, Artificial Sequence
  Non-specific lipid-transfer protein (13-23)
RVFVVGVGMTK

SEQ ID NO: 4670 - protein, 11 aa, Artificial Sequence
  26S protease regulatory subunit 7 (239-249)
RVIGSELVQKY

SEQ ID NO: 4671 - protein, 10 aa, Artificial Sequence
  Ectonucleoside triphosphate diphosphohydrolase 1 (97-106)
RVKGPGISKF

SEQ ID NO: 4672 - protein, 9 aa, Artificial Sequence
  FACT complex subunit SSRP1 (316-324)
RVMKALVNR

SEQ ID NO: 4673 - protein, 9 aa, Artificial Sequence
  DNA replication licensing factor MCM4 (387-395)
RVNVTGIYR

SEQ ID NO: 4674 - protein, 9 aa, Artificial Sequence
  Double-stranded RNA-binding protein Staufen homolog 1 (457-465)
RVQGFQVEY

SEQ ID NO: 4675 - protein, 9 aa, Artificial Sequence
  Serine/threonine-protein phosphatase 6 regulatory subunit 3 (45-53)
RVSDINFTL

SEQ ID NO: 4676 - protein, 10 aa, Artificial Sequence
  SUMO-specific isopeptidase USPL1 (717-726)
RVTSQVSNLK

SEQ ID NO: 4677 - protein, 9 aa, Artificial Sequence
  5'-nucleotidase domain-containing protein 1 (141-149)
RVVDYLTKL

SEQ ID NO: 4678 - protein, 9 aa, Artificial Sequence
  Serine/arginine-rich splicing factor 6 (3-11)
RVYIGRLSY

SEQ ID NO: 4679 - protein, 9 aa, Artificial Sequence
  Serine/threonine-protein kinase SMG1 (36-44)
SADPDNLKY

SEQ ID NO: 4680 - protein, 9 aa, Artificial Sequence
  Serine/threonine-protein kinase 17A (293-301)
SAVDFIRTL

SEQ ID NO: 4681 - protein, 10 aa, Artificial Sequence
  A-kinase anchor protein 2 (685-694)
SEAAELRSTA

SEQ ID NO: 4682 - protein, 9 aa, Artificial Sequence
  Zinc finger protein Rlf (1399-1407)
SEAGSAARF

SEQ ID NO: 4683 - protein, 9 aa, Artificial Sequence
  Histone-lysine N-methyltransferase SETD2 (461-469)
SEEEYKKTY

SEQ ID NO: 4684 - protein, 9 aa, Artificial Sequence
  U5 small nuclear ribonucleoprotein 200 kDa helicase (1010-1018)
SEIELFRVF

SEQ ID NO: 4685 - protein, 10 aa, Artificial Sequence
  Nesprin-2 (320-329)
SENDTYFKKY

SEQ ID NO: 4686 - protein, 10 aa, Artificial Sequence
  Uncharacterized protein C14orf119 (121-130)
SEPDFVAKFY

SEQ ID NO: 4687 - protein, 11 aa, Artificial Sequence
  Fructose-bisphosphate aldolase A (408-418)
SESLFVSNHAY

SEQ ID NO: 4688 - protein, 9 aa, Artificial Sequence
  Cyclin-G-associated kinase (305-313)
SIAEVVHQL

SEQ ID NO: 4689 - protein, 9 aa, Artificial Sequence
  26S proteasome non-ATPase regulatory subunit 3 (418-426)
SLADIAQKL

SEQ ID NO: 4690 - protein, 10 aa, Artificial Sequence
  Peroxisomal membrane protein 2 (66-75)
SLDVGGPLRY

SEQ ID NO: 4691 - protein, 9 aa, Artificial Sequence
  Nucleoporin GLE1 (288-296)
SLISGIIRA

SEQ ID NO: 4692 - protein, 9 aa, Artificial Sequence
  Nucleolar protein 7 (197-205)
SLYGPGTNR

SEQ ID NO: 4693 - protein, 9 aa, Artificial Sequence
  Nuclear pore complex protein Nup93 (787-795)
SQARTLITF

SEQ ID NO: 4694 - protein, 9 aa, Artificial Sequence
  60S ribosomal export protein NMD3 (228-236)
SQDIHSNTY

SEQ ID NO: 4695 - protein, 9 aa, Artificial Sequence
  14 kDa phosphohistidine phosphatase (83-91)
SQDKKIHVY

SEQ ID NO: 4696 - protein, 9 aa, Artificial Sequence
  MKI67 FHA domain-interacting nucleolar phosphoprotein (66-74)
SQFGTVTRF

SEQ ID NO: 4697 - protein, 10 aa, Artificial Sequence
  Kinesin-associated protein 3 (208-217)
SQFHGLITHY

SEQ ID NO: 4698 - protein, 9 aa, Artificial Sequence
  Heterogeneous nuclear ribonucleoprotein U (697-705)
SQHYHQGYY

SEQ ID NO: 4699 - protein, 11 aa, Artificial Sequence
  U4/U6 small nuclear ribonucleoprotein Prp4 (224-234)
SQIGDDRPISY

SEQ ID NO: 4700 - protein, 9 aa, Artificial Sequence
  DCN1-like protein 1 (7-15)
SQKDKVRQF

SEQ ID NO: 4701 - protein, 9 aa, Artificial Sequence
  General transcription factor 3C polypeptide 1 (1442-1450)
SQMKSYQSF

SEQ ID NO: 4702 - protein, 9 aa, Artificial Sequence
  Transmembrane emp24 domain-containing protein 3 (196-204)
SQVLLLKSF

SEQ ID NO: 4703 - protein, 9 aa, Artificial Sequence
  E3 ubiquitin-protein ligase MARCH7 (122-130)
SQVPRSSSM

SEQ ID NO: 4704 - protein, 9 aa, Artificial Sequence
  Midasin (130-138)
SSDANPVRY

SEQ ID NO: 4705 - protein, 9 aa, Artificial Sequence
  Arf-GAP with coiled-coil, ANK repeat and PH domain-containing protein 2 (251-259)
SSDDSKLEY

SEQ ID NO: 4706 - protein, 10 aa, Artificial Sequence
  Zinc finger protein 330 (258-267)
SSDKYGDTSY

SEQ ID NO: 4707 - protein, 10 aa, Artificial Sequence
  Protein FAM208B (1580-1589)
SSDNATLTHY

SEQ ID NO: 4708 - protein, 9 aa, Artificial Sequence
  Heat shock 70 kDa protein 14 (75-83)
SSDPQAQKY

SEQ ID NO: 4709 - protein, 9 aa, Artificial Sequence
  Spectrin beta chain, non-erythrocytic 1 (769-777)
SSDVGHDEY

SEQ ID NO: 4710 - protein, 9 aa, Artificial Sequence
  Signal transducer and activator of transcription 3 (613-621)
SSKEGGVTF

SEQ ID NO: 4711 - protein, 10 aa, Artificial Sequence
  COP9 signalosome complex subunit 6 (241-250)
STDKFKTDFY

SEQ ID NO: 4712 - protein, 9 aa, Artificial Sequence
  Axin-1 (71-79)
STDPRPASY

SEQ ID NO: 4713 - protein, 11 aa, Artificial Sequence
  Proteasome subunit beta type-8 (261-271)
STDVSDLLHQY

SEQ ID NO: 4714 - protein, 9 aa, Artificial Sequence
  Dedicator of cytokinesis protein 11 (109-117)
STDWHVVNY

SEQ ID NO: 4715 - protein, 9 aa, Artificial Sequence
  Mitochondrial Rho GTPase 2 (298-306)
STELNHLGY

SEQ ID NO: 4716 - protein, 9 aa, Artificial Sequence
  Cirhin (419-427)
STVSRFFLY

SEQ ID NO: 4717 - protein, 9 aa, Artificial Sequence
  Cysteine-rich PDZ-binding protein (64-72)
SVHQPGSHY

SEQ ID NO: 4718 - protein, 11 aa, Artificial Sequence
  Exosome complex exonuclease RRP44 (580-590)
SVINSKASLTY

SEQ ID NO: 4719 - protein, 9 aa, Artificial Sequence
  Collagen type IV alpha-3-binding protein (484-492)
SVIRKIPAL

SEQ ID NO: 4720 - protein, 9 aa, Artificial Sequence
  Vigilin (74-82)
SVITQVFHV

SEQ ID NO: 4721 - protein, 9 aa, Artificial Sequence
  WD repeat-containing protein 1 (458-466)
SVKEWTITY

SEQ ID NO: 4722 - protein, 9 aa, Artificial Sequence
  Cytoplasmic FMR1-interacting protein 1 (214-222)
SVKNDHSAY

SEQ ID NO: 4723 - protein, 9 aa, Artificial Sequence
  Ribosomal biogenesis protein LAS1L (538-546)
SVKPASSSF

SEQ ID NO: 4724 - protein, 10 aa, Artificial Sequence
  Eukaryotic translation initiation factor 3 subunit I (39-48)
SVNGERLGTY

SEQ ID NO: 4725 - protein, 11 aa, Artificial Sequence
  Bone morphogenetic protein receptor type-2 (815-825)
SVNSHAATTQY

SEQ ID NO: 4726 - protein, 9 aa, Artificial Sequence
  Epidermal growth factor receptor substrate 15 (746-754)
SVSNVVITK

SEQ ID NO: 4727 - protein, 11 aa, Artificial Sequence
  E3 ubiquitin-protein ligase Topors (191-201)
SVYSPSGPVNR

SEQ ID NO: 4728 - protein, 11 aa, Artificial Sequence
  Tubulin beta chain (48-58)
SVYYNEATGGK

SEQ ID NO: 4729 - protein, 9 aa, Artificial Sequence
  Cohesin subunit SA-2 (881-889)
TAADIFKQY

SEQ ID NO: 4730 - protein, 9 aa, Artificial Sequence
  Phosphatidylinositol 3,4,5-trisphosphate-dependent Rac exchanger 1 protein (345-353)
TADYHSNGY

SEQ ID NO: 4731 - protein, 9 aa, Artificial Sequence
  Phospholipid-transporting ATPase IG (35-43)
TEAYIAQRF

SEQ ID NO: 4732 - protein, 10 aa, Artificial Sequence
  RNMT-activating mini protein (20-29)
TENDKEYQEY

SEQ ID NO: 4733 - protein, 9 aa, Artificial Sequence
  Vacuolar protein sorting-associated protein 26A (225-233)
TETETIAKY

SEQ ID NO: 4734 - protein, 9 aa, Artificial Sequence
  Ribosomal RNA processing protein 1 homolog B (77-85)
TIAQLVHAV

SEQ ID NO: 4735 - protein, 9 aa, Artificial Sequence
  Heterogeneous nuclear ribonucleoproteins A2/B1 (164-172)
TINGHNAEV

SEQ ID NO: 4736 - protein, 9 aa, Artificial Sequence
  Transformation/transcription domain-associated protein (378-386)
TLADLVHHV

SEQ ID NO: 4737 - protein, 10 aa, Artificial Sequence
  Syntaxin-binding protein 3 (187-196)
TLDENPGVRY

SEQ ID NO: 4738 - protein, 9 aa, Artificial Sequence
  Centrosomal protein CEP57L1 (127-135)
TLLEKQLEY

SEQ ID NO: 4739 - protein, 11 aa, Artificial Sequence
  Pleckstrin homology domain-containing family B member 2 (103-113)
TLQDSRTNTAY

SEQ ID NO: 4740 - protein, 9 aa, Artificial Sequence
  Zinc finger protein 706 (46-54)
TQMPDPKTF

SEQ ID NO: 4741 - protein, 9 aa, Artificial Sequence
  SWI/SNF-related matrix-associated actin-dependent regulator of chromatin subfamily D member 2 (452-460)
TQRDFMLSF

SEQ ID NO: 4742 - protein, 9 aa, Artificial Sequence
  V-type proton ATPase subunit E 2 (48-56)
TQRLKIMEY

SEQ ID NO: 4743 - protein, 9 aa, Artificial Sequence
  DNA replication licensing factor MCM7 (654-662)
TQRPADVIF

SEQ ID NO: 4744 - protein, 10 aa, Artificial Sequence
  40S ribosomal protein S13 (18-27)
TSDDVKEQIY

SEQ ID NO: 4745 - protein, 9 aa, Artificial Sequence
  Cation-independent mannose-6-phosphate receptor (877-885)
TSDGRQTTY

SEQ ID NO: 4746 - protein, 11 aa, Artificial Sequence
  Bifunctional glutamate/proline-tRNA ligase (269-279)
TSDHFETIMKY

SEQ ID NO: 4747 - protein, 10 aa, Artificial Sequence
  Nucleoporin Nup37 (108-117)
TSDLQDKNEY

SEQ ID NO: 4748 - protein, 11 aa, Artificial Sequence
  RNA polymerase II elongation factor ELL (458-468)
TSETPDYLLKY

SEQ ID NO: 4749 - protein, 11 aa, Artificial Sequence
  Heterogeneous nuclear ribonucleoprotein F (256-266)
TTDLFGRDLSY

SEQ ID NO: 4750 - protein, 9 aa, Artificial Sequence
  Tetratricopeptide repeat protein 13 (710-718)
TTEERTQLY

SEQ ID NO: 4751 - protein, 10 aa, Artificial Sequence
  Heterogeneous nuclear ribonucleoproteins A2/B1 (20-29)
TTEESLRNYY

SEQ ID NO: 4752 - protein, 9 aa, Artificial Sequence
  Tapasin (372-380)
TTEQHGARY

SEQ ID NO: 4753 - protein, 10 aa, Artificial Sequence
  Condensin-2 complex subunit D3 (675-684)
TTESQELSRY

SEQ ID NO: 4754 - protein, 9 aa, Artificial Sequence
  Endoplasmic reticulum-Golgi intermediate compartment protein 3 (40-48)
TTEVHPELY

SEQ ID NO: 4755 - protein, 9 aa, Artificial Sequence
  Coatomer subunit gamma-1 (759-767)
TVADHIQKV

SEQ ID NO: 4756 - protein, 9 aa, Artificial Sequence
  Threonine-tRNA ligase, cytoplasmic (150-158)
TVIAKVNNV

SEQ ID NO: 4757 - protein, 9 aa, Artificial Sequence
  Transmembrane emp24 domain-containing protein 3 (153-161)
TVIDSQTHY

SEQ ID NO: 4758 - protein, 10 aa, Artificial Sequence
  Importin subunit alpha-5 (433-442)
TVMDSKIVQV

SEQ ID NO: 4759 - protein, 9 aa, Artificial Sequence
  Sodium/potassium-transporting ATPase subunit alpha-3 (268-276)
TVMGRIATL

SEQ ID NO: 4760 - protein, 9 aa, Artificial Sequence
  Band 4.1-like protein 2 (777-785)
VEEEPRPAA

SEQ ID NO: 4761 - protein, 9 aa, Artificial Sequence
  26S protease regulatory subunit 4 (176-184)
VEKAPQETY

SEQ ID NO: 4762 - protein, 9 aa, Artificial Sequence
  Choline/ethanolaminephosphotransferase 1 (268-276)
VIFTGGVGK

SEQ ID NO: 4763 - protein, 9 aa, Artificial Sequence
  28S ribosomal protein S17, mitochondrial (34-42)
VLDPYLLKY

SEQ ID NO: 4764 - protein, 10 aa, Artificial Sequence
  Protein Niban (367-376)
VLFEKEVNEV

SEQ ID NO: 4765 - protein, 9 aa, Artificial Sequence
  Caprin-1 (232-240)
VLKEIVERV

SEQ ID NO: 4766 - protein, 9 aa, Artificial Sequence
  Ribonucleoside-diphosphate reductase large subunit (245-253)
VLKEKIAKY

SEQ ID NO: 4767 - protein, 11 aa, Artificial Sequence
  Histone H4 (22-32)
VLRDNIQGITK

SEQ ID NO: 4768 - protein, 9 aa, Artificial Sequence
  Cytoplasmic dynein 1 heavy chain 1 (3839-3847)
VLYENPNLK

SEQ ID NO: 4769 - protein, 9 aa, Artificial Sequence
  Ubiquitin carboxyl-terminal hydrolase 7 (195-203)
VQADAPHGV

SEQ ID NO: 4770 - protein, 10 aa, Artificial Sequence
  E3 ubiquitin-protein ligase RNF19A (143-152)
VQADVQKERY

SEQ ID NO: 4771 - protein, 9 aa, Artificial Sequence
  Interleukin enhancer-binding factor 2 (97-105)
VQIEEVRQV

SEQ ID NO: 4772 - protein, 11 aa, Artificial Sequence
  Proteasome subunit alpha type-2 (102-112)
VQRVASVMQEY

SEQ ID NO: 4773 - protein, 9 aa, Artificial Sequence
  Transitional endoplasmic reticulum ATPase (747-755)
VSDNDIRKY

SEQ ID NO: 4774 - protein, 9 aa, Artificial Sequence
  Nuclear factor NF-kappa-B p100 subunit (317-325)
VSDSKQFTY

SEQ ID NO: 4775 - protein, 10 aa, Artificial Sequence
  Nuclear factor NF-kappa-B p100 subunit (317-326)
VSDSKQFTYY

SEQ ID NO: 4776 - protein, 11 aa, Artificial Sequence
  Phospholipase D2 (65-75)
VTAQVVGTERY

SEQ ID NO: 4777 - protein, 9 aa, Artificial Sequence
  Acidic fibroblast growth factor intracellular-binding protein (29-37)
VTDAVALRV

SEQ ID NO: 4778 - protein, 10 aa, Artificial Sequence
  Alanine-tRNA ligase, cytoplasmic (480-489)
VTDDSPKYNY

SEQ ID NO: 4779 - protein, 11 aa, Artificial Sequence
  Histone-lysine N-methyltransferase 2C (1500-1510)
VTDGAILGKLY

SEQ ID NO: 4780 - protein, 10 aa, Artificial Sequence
  Attractin (145-154)
VTDGPGNYKY

SEQ ID NO: 4781 - protein, 10 aa, Artificial Sequence
  Proteasome-associated protein ECM29 homolog (1150-1159)
VTDKSMVDKY

SEQ ID NO: 4782 - protein, 10 aa, Artificial Sequence
  Histone-lysine N-methyltransferase, H3 lysine-79 specific (77-86)
VTDPEKLNNY

SEQ ID NO: 4783 - protein, 9 aa, Artificial Sequence
  Dynamin-1-like protein (55-63)
VTDSIRDEY

SEQ ID NO: 4784 - protein, 10 aa, Artificial Sequence
  Pyridine nucleotide-disulfide oxidoreductase domain-containing protein 1 (98-107)
VTEDGNQHVY

SEQ ID NO: 4785 - protein, 9 aa, Artificial Sequence
  Filamin-A (2353-2361)
VTEIDQDKY

SEQ ID NO: 4786 - protein, 11 aa, Artificial Sequence
  Staphylococcal nuclease domain-containing protein 1 (687-697)
VTEITDDLHFY

SEQ ID NO: 4787 - protein, 9 aa, Artificial Sequence
  E3 ubiquitin-protein ligase RNF213 (4915-4923)
VTELHVISY

SEQ ID NO: 4788 - protein, 9 aa, Artificial Sequence
  Eukaryotic translation initiation factor 3 subunit C-like protein (23-31)
VTKPVGGNY

SEQ ID NO: 4789 - protein, 10 aa, Artificial Sequence
  Heterogeneous nuclear ribonucleoprotein U (696-705)
WSQHYHQGYY

SEQ ID NO: 4790 - protein, 10 aa, Artificial Sequence
  Chromodomain-helicase-DNA-binding protein 7 (859-868)
WTDILSHGRY

SEQ ID NO: 4791 - protein, 9 aa, Artificial Sequence
  Polypyrimidine tract-binding protein 3 (269-277)
YADPVNAHY

SEQ ID NO: 4792 - protein, 9 aa, Artificial Sequence
  HLA class I histocompatibility antigen, B-15 alpha chain (140-148)
YAYDGKDYI

SEQ ID NO: 4793 - protein, 11 aa, Artificial Sequence
  HLA class I histocompatibility antigen, B-52 alpha chain (140-150)
YAYDGKDYIAL

SEQ ID NO: 4794 - protein, 9 aa, Artificial Sequence
  Cell division cycle-associated 7-like protein (433-441)
YGYDNVKEY

SEQ ID NO: 4795 - protein, 11 aa, Artificial Sequence
  Mediator of RNA polymerase II transcription subunit 10 (70-80)
YIDQGRNPQLY

SEQ ID NO: 4796 - protein, 9 aa, Artificial Sequence
  Septin-7 (132-140)
YIDSKFEDY

SEQ ID NO: 4797 - protein, 9 aa, Artificial Sequence
  Hypoxia-inducible factor 1-alpha (111-119)
YISDNVNKY

SEQ ID NO: 4798 - protein, 10 aa, Artificial Sequence
  Ubiquitin carboxyl-terminal hydrolase 22 (118-127)
YIYDKDMEII

SEQ ID NO: 4799 - protein, 10 aa, Artificial Sequence
  Metastasis-associated protein MTA3 (123-132)
YLDKEDTFFY

SEQ ID NO: 4800 - protein, 9 aa, Artificial Sequence
  Oxysterol-binding protein-related protein 3 (75-83)
YLDKGILKY

SEQ ID NO: 4801 - protein, 10 aa, Artificial Sequence
  tRNA (adenine(58)-N(1))-methyltransferase non-catalytic subunit TRM6 (53-62)
YLDNVIGHSY

SEQ ID NO: 4802 - protein, 9 aa, Artificial Sequence
  Nucleolar complex protein 4 homolog (174-182)
YLDYDDTRY

SEQ ID NO: 4803 - protein, 9 aa, Artificial Sequence
  Signal transducer and activator of transcription 3 (14-22)
YLEQLHQLY

SEQ ID NO: 4804 - protein, 9 aa, Artificial Sequence
  Dystonin (981-989)
YLINEIDRI

SEQ ID NO: 4805 - protein, 9 aa, Artificial Sequence
  Geminin (150-158)
YMAELIERL

SEQ ID NO: 4806 - protein, 9 aa, Artificial Sequence
  Thymidylate synthase (235-243)
YMIAHITGL

SEQ ID NO: 4807 - protein, 11 aa, Artificial Sequence
  Chromodomain-helicase-DNA-binding protein 1-like (712-722)
YQDPDATSLKY

SEQ ID NO: 4808 - protein, 9 aa, Artificial Sequence
  Up-regulated during skeletal muscle growth protein 5 (10-18)
YQFTGIKKY

SEQ ID NO: 4809 - protein, 9 aa, Artificial Sequence
  Integrator complex subunit 3 (156-164)
YQKQPKIGY

SEQ ID NO: 4810 - protein, 9 aa, Artificial Sequence
  Pre-mRNA-processing-splicing factor 8 (2326-2334)
YSADREDLY

SEQ ID NO: 4811 - protein, 9 aa, Artificial Sequence
  Mitogen-activated protein kinase 6 (427-435)
YSDHHENKY

SEQ ID NO: 4812 - protein, 10 aa, Artificial Sequence
  RNA binding motif protein, X-linked-like-1 (272-281)
YSDHPSGGSY

SEQ ID NO: 4813 - protein, 10 aa, Artificial Sequence
  Cyclin-dependent kinases regulatory subunit 2 (8-17)
YSDKYFDEHY

SEQ ID NO: 4814 - protein, 9 aa, Artificial Sequence
  Serine/threonine-protein kinase PLK1 (417-425)
YSDKYGLGY

SEQ ID NO: 4815 - protein, 9 aa, Artificial Sequence
  Glycoprotein endo-alpha-1,2-mannosidase-like protein (102-110)
YSDLHAFYY

SEQ ID NO: 4816 - protein, 10 aa, Artificial Sequence
  Cold-inducible RNA-binding protein (151-160)
YSDRSSGGSY

SEQ ID NO: 4817 - protein, 10 aa, Artificial Sequence
  DNA mismatch repair protein Msh6 (469-478)
YSDSLVQKGY

SEQ ID NO: 4818 - protein, 10 aa, Artificial Sequence
  Serine hydroxymethyltransferase, cytosolic (73-82)
YSEGYPGQRY

SEQ ID NO: 4819 - protein, 11 aa, Artificial Sequence
  Store-operated calcium entry-associated regulatory factor (204-214)
YSEYPPFSHRY

SEQ ID NO: 4820 - protein, 11 aa, Artificial Sequence
  FACT complex subunit SPT16 (18-28)
YSNWRKGEDEY

SEQ ID NO: 4821 - protein, 9 aa, Artificial Sequence
  Histone-lysine N-methyltransferase EZH1 (729-737)
YSQADALKY

SEQ ID NO: 4822 - protein, 9 aa, Artificial Sequence
  RNA binding motif protein, X-linked-like-1 (327-335)
YSSSRSDLY

SEQ ID NO: 4823 - protein, 11 aa, Artificial Sequence
  Eukaryotic translation initiation factor 3 subunit I (38-48)
YSVNGERLGTY

SEQ ID NO: 4824 - protein, 11 aa, Artificial Sequence
  Trafficking protein particle complex subunit 4 (75-85)
YTADGKEVLEY

SEQ ID NO: 4825 - protein, 8 aa, Artificial Sequence
  DnaJ homolog subfamily C member 3 (284-291)
YTDATSKY

SEQ ID NO: 4826 - protein, 9 aa, Artificial Sequence
  Meckelin (401-409)
YTDENQHQY

SEQ ID NO: 4827 - protein, 10 aa, Artificial Sequence
  Serine/threonine-protein kinase pim-2 (194-203)
YTDFDGTRVY

SEQ ID NO: 4828 - protein, 10 aa, Artificial Sequence
  RNA-binding protein 7 (219-228)
YTDHGSDHHY

SEQ ID NO: 4829 - protein, 11 aa, Artificial Sequence
  Glutathione S-transferase Mu 2 (23-33)
YTDSSYEEKKY

SEQ ID NO: 4830 - protein, 10 aa, Artificial Sequence
  Protein patched homolog 1 (564-573)
YTDTHDNTRY

SEQ ID NO: 4831 - protein, 11 aa, Artificial Sequence
  ARF GTPase-activating protein GIT2 (492-502)
YTDTSNHSSLK

SEQ ID NO: 4832 - protein, 8 aa, Artificial Sequence
  Thioredoxin-related transmembrane protein 2 (199-206)
YTDVSTRY

SEQ ID NO: 4833 - protein, 10 aa, Artificial Sequence
  Zinc finger CCCH domain-containing protein 18 (65-74)
YTETEPYHNY

SEQ ID NO: 4834 - protein, 9 aa, Artificial Sequence
  Probable ATP-dependent RNA helicase DDX47 (236-244)
YYIFIPSKF

SEQ ID NO: 4835 - protein, 9 aa, Artificial Sequence
  ORM1-like protein 2 (59-67)
ATYVFLHTV

SEQ ID NO: 4836 - protein, 9 aa, Artificial Sequence
  Eukaryotic translation initiation factor 2 subunit 3 (202-210)
EQYEQILAF

SEQ ID NO: 4837 - protein, 9 aa, Artificial Sequence
  Tapasin (354-362)
HHSDGSVSL

SEQ ID NO: 4838 - protein, 9 aa, Artificial Sequence
  Cyclin-dependent kinases regulatory subunit 2 (59-67)
IHEPEPHIL

SEQ ID NO: 4839 - protein, 9 aa, Artificial Sequence
  Prelamin-A/C (341-349)
KAGQVVTIW

SEQ ID NO: 4840 - protein, 9 aa, Artificial Sequence
  AP-1 complex subunit beta-1 (249-257)
SHANSAVVL

SEQ ID NO: 4841 - protein, 9 aa, Artificial Sequence
  Proliferating cell nuclear antigen (152-160)
SHIGDAVVI

SEQ ID NO: 4842 - protein, 9 aa, Artificial Sequence
  Ubiquitin-60S ribosomal protein L40 (70-78)
STLHLVLRL

SEQ ID NO: 4843 - protein, 10 aa, Artificial Sequence
  HLA class I histocompatibility antigen, B-15 alpha chain (162-171)
TAAQITQRKW

SEQ ID NO: 4844 - protein, 9 aa, Artificial Sequence
  Septin-6 (73-81)
THTQPGVQL

SEQ ID NO: 4845 - protein, 9 aa, Artificial Sequence
  DNA topoisomerase 2-alpha (684-692)
YLYGQTTTY

SEQ ID NO: 4846 - protein, 10 aa, Artificial Sequence
  Coilin (257-266)
ISDGPSKVTL

SEQ ID NO: 4847 - protein, 9 aa, Artificial Sequence
  Cancer/testis antigen 1 (155-163)
QLSLLMWIT

SEQ ID NO: 4848 - protein, 9 aa, Artificial Sequence
  ATPase family AAA domain-containing protein 2 (1274-1282)
ASSSQIIHI

SEQ ID NO: 4849 - protein, 9 aa, Artificial Sequence
  Guanine nucleotide-binding protein G(I)/G(S)/G(T) subunit beta-2 (91-99)
HAIPLRSSW

SEQ ID NO: 4850 - protein, 9 aa, Artificial Sequence
  Acyl-CoA desaturase (115-123)
ITAGAHRLW

SEQ ID NO: 4851 - protein, 9 aa, Artificial Sequence
  Choline-phosphate cytidylyltransferase A (201-209)
STSDIITRI

SEQ ID NO: 4852 - protein, 9 aa, Artificial Sequence
  Serine/threonine-protein kinase pim-1 (191-199)
ALLKDTVYT

SEQ ID NO: 4853 - protein, 9 aa, Artificial Sequence
  Death-associated protein kinase 2 (1-9)
MLLDKNIPI

SEQ ID NO: 4854 - protein, 9 aa, Artificial Sequence
  HLA class I histocompatibility antigen, B-15 alpha chain (163-171)
AAQITQRKW

SEQ ID NO: 4855 - protein, 9 aa, Artificial Sequence
  Transcription termination factor 2 (113-121)
ETFHHSSNW

SEQ ID NO: 4856 - protein, 9 aa, Artificial Sequence
  Filamin-A (352-360)
GTHKVTVLF

SEQ ID NO: 4857 - protein, 9 aa, Artificial Sequence
  Filamin-A (452-460)
GVHTVHVTF

SEQ ID NO: 4858 - protein, 19 aa, Artificial Sequence
  C-1-tetrahydrofolate synthase, cytoplasmic (72-90)
HGNSSIIADQIALKLVGPE

SEQ ID NO: 4859 - protein, 19 aa, Artificial Sequence
  Major histocompatibility complex class I-related gene protein (3-21)
HSLRYFRLGVSDPIRGVPE

SEQ ID NO: 4860 - protein, 10 aa, Artificial Sequence
  Delta(24)-sterol reductase (310-319)
HTFQNDIHVY

SEQ ID NO: 4861 - protein, 8 aa, Artificial Sequence
  Protein SET (64-71)
IAKIPNFW

SEQ ID NO: 4862 - protein, 9 aa, Artificial Sequence
  Eukaryotic translation initiation factor 3 subunit C-like protein (385-393)
ISKQFHHQL

SEQ ID NO: 4863 - protein, 9 aa, Artificial Sequence
  Constitutive coactivator of PPAR-gamma-like protein 1 (982-990)
ISTPVIRTF

SEQ ID NO: 4864 - protein, 9 aa, Artificial Sequence
  T-complex protein 1 subunit gamma (160-168)
ITTKAISRW

SEQ ID NO: 4865 - protein, 9 aa, Artificial Sequence
  DNA replication complex GINS protein PSF1 (5-13)
KAMELIREL

SEQ ID NO: 4866 - protein, 9 aa, Artificial Sequence
  60S ribosomal protein L18a (2-10)
KASGTLREY

SEQ ID NO: 4867 - protein, 9 aa, Artificial Sequence
  14-3-3 protein gamma (152-160)
KAYSEAHEI

SEQ ID NO: 4868 - protein, 9 aa, Artificial Sequence
  AP-1 complex subunit mu-2 (348-356)
KSFPGGKEY

SEQ ID NO: 4869 - protein, 10 aa, Artificial Sequence
  Dolichol-phosphate mannosyltransferase subunit 1 (42-51)
KSFSESGINY

SEQ ID NO: 4870 - protein, 10 aa, Artificial Sequence
  Heterogeneous nuclear ribonucleoprotein M (203-212)
KSRGIGTVTF

SEQ ID NO: 4871 - protein, 9 aa, Artificial Sequence
  Plastin-3 (40-48)
KSSDIAKTF

SEQ ID NO: 4872 - protein, 9 aa, Artificial Sequence
  THO complex subunit 2 (398-406)
KTFPYQHRY

SEQ ID NO: 4873 - protein, 9 aa, Artificial Sequence
  Guanine nucleotide-binding protein subunit beta-2-like 1 (127-135)
KTIKLWNTL

SEQ ID NO: 4874 - protein, 9 aa, Artificial Sequence
  60S ribosomal protein L4 (163-171)
KTKEAVLLL

SEQ ID NO: 4875 - protein, 9 aa, Artificial Sequence
  Ribonucleoside-diphosphate reductase large subunit (52-60)
KTLERSYLL

SEQ ID NO: 4876 - protein, 10 aa, Artificial Sequence
  Hexokinase-2 (777-786)
KTRGIFETKF

SEQ ID NO: 4877 - protein, 9 aa, Artificial Sequence
  Ribosome-binding protein 1 (145-153)
KVAKVEPAV

SEQ ID NO: 4878 - protein, 9 aa, Artificial Sequence
  Proteasome subunit beta type-5 (92-100)
KVIEINPYL

SEQ ID NO: 4879 - protein, 9 aa, Artificial Sequence
  Anaphase-promoting complex subunit 2 (557-565)
KVRDQQLVY

SEQ ID NO: 4880 - protein, 19 aa, Artificial Sequence
  Protein-tyrosine kinase 2-beta (528-546)
QEEKSLDPMVYMNDTSPLT

SEQ ID NO: 4881 - protein, 9 aa, Artificial Sequence
  Vigilin (54-62)
RAKPEYHKF

SEQ ID NO: 4882 - protein, 8 aa, Artificial Sequence
  NEDD8 ultimate buster 1 (113-120)
RSKIAETF

SEQ ID NO: 4883 - protein, 9 aa, Artificial Sequence
  Pleiotropic regulator 1 (309-317)
RTKASVHTL

SEQ ID NO: 4884 - protein, 9 aa, Artificial Sequence
  Baculoviral IAP repeat-containing protein 6 (597-605)
RTLPVLLLY

SEQ ID NO: 4885 - protein, 9 aa, Artificial Sequence
  E3 ubiquitin-protein ligase CBL-B (66-74)
RTVEKTWKL

SEQ ID NO: 4886 - protein, 10 aa, Artificial Sequence
  Basigin (137-146)
RVRSHLAALW

SEQ ID NO: 4887 - protein, 12 aa, Artificial Sequence
  Phosphatidylinositol 4-kinase type 2-beta (74-85)
SRSSSAELDRSR

SEQ ID NO: 4888 - protein, 9 aa, Artificial Sequence
  Histone-binding protein RBBP7 (376-384)
TAKISDFSW

SEQ ID NO: 4889 - protein, 9 aa, Artificial Sequence
  Junction plakoglobin (207-215)
TTSRVLKVL

SEQ ID NO: 4890 - protein, 9 aa, Artificial Sequence
  High mobility group protein B3 (123-131)
VAKKLGEMW

SEQ ID NO: 4891 - protein, 11 aa, Artificial Sequence
  Heterogeneous nuclear ribonucleoprotein U-like protein 1 (427-437)
VGLPAAGKTTW

SEQ ID NO: 4892 - protein, 9 aa, Artificial Sequence
  Phosphoglycerate kinase 1 (328-336)
VTRAKQIVW

SEQ ID NO: 4893 - protein, 9 aa, Artificial Sequence
  Transcription elongation factor SPT5 (976-984)
VTTDIQVKV

SEQ ID NO: 4894 - protein, 19 aa, Artificial Sequence
  Lymphocyte antigen 75 (1307-1325)
YMASWVMLGITYRNKSLMW

SEQ ID NO: 4895 - protein, 9 aa, Artificial Sequence
  Guanine nucleotide-binding protein subunit beta-2-like 1 (302-310)
YTDNLVRVW

SEQ ID NO: 4896 - protein, 9 aa, Artificial Sequence
  40S ribosomal protein S21 (75-83)
ADGIVSKNF

SEQ ID NO: 4897 - protein, 10 aa, Artificial Sequence
  Pleiotropic regulator 1 (471-480)
AEADKTIKVY

SEQ ID NO: 4898 - protein, 9 aa, Artificial Sequence
  Putative RRN3-like protein RRN3P1 (4-12)
AEAFLEHLW

SEQ ID NO: 4899 - protein, 11 aa, Artificial Sequence
  Chloride intracellular channel protein 1 (157-167)
AEDEGVSQRKF

SEQ ID NO: 4900 - protein, 11 aa, Artificial Sequence
  Heat shock protein HSP 90-beta (346-356)
AEDKENYKKFY

SEQ ID NO: 4901 - protein, 11 aa, Artificial Sequence
  Transmembrane emp24 domain-containing protein 3 (50-60)
AEDLNSRVSYW

SEQ ID NO: 4902 - protein, 11 aa, Artificial Sequence
  Transmembrane emp24 domain-containing protein 7 (170-180)
AEDLNTRVAYW

SEQ ID NO: 4903 - protein, 10 aa, Artificial Sequence
  Plasminogen activator inhibitor 1 RNA-binding protein (236-245)
AEDSVMDHHF

SEQ ID NO: 4904 - protein, 10 aa, Artificial Sequence
  Eukaryotic translation elongation factor 1 epsilon-1 (65-74)
AEEKAIVQQW

SEQ ID NO: 4905 - protein, 9 aa, Artificial Sequence
  Transcription elongation factor SPT6 (985-993)
AEELERQGY

SEQ ID NO: 4906 - protein, 10 aa, Artificial Sequence
  G patch domain-containing protein 4 (15-24)
AEEQLLKHGW

SEQ ID NO: 4907 - protein, 10 aa, Artificial Sequence
  General transcription factor 3C polypeptide 1 (182-191)
AEESDLSRQY

SEQ ID NO: 4908 - protein, 10 aa, Artificial Sequence
  Myosin light polypeptide 6 (10-19)
AEFKEAFQLF

SEQ ID NO: 4909 - protein, 10 aa, Artificial Sequence
  Signal peptidase complex subunit 2 (187-196)
AEFTKSIAKF

SEQ ID NO: 4910 - protein, 9 aa, Artificial Sequence
  60S ribosomal protein L8 (33-41)
AEGIHTGQF

SEQ ID NO: 4911 - protein, 11 aa, Artificial Sequence
  Proteasome inhibitor PI31 subunit (114-124)
AEHLGDFHRTY

SEQ ID NO: 4912 - protein, 9 aa, Artificial Sequence
  Kinesin-like protein KIF20B (872-880)
AEIEDIRVL

SEQ ID NO: 4913 - protein, 10 aa, Artificial Sequence
  rRNA-processing protein FCF1 homolog (108-117)
AEIEKLGQKY

SEQ ID NO: 4914 - protein, 12 aa, Artificial Sequence
  Cyclin-dependent kinase 6 (17-28)
AEIGEGAYGKVF

SEQ ID NO: 4915 - protein, 11 aa, Artificial Sequence
  Delta(24)-sterol reductase (227-237)
AEIRIIPAKKY

SEQ ID NO: 4916 - protein, 11 aa, Artificial Sequence
  Filamin A (105-115)
AEIVEGENHTY

SEQ ID NO: 4917 - protein, 10 aa, Artificial Sequence
  Replication protein A 32 kDa subunit (83-92)
AEKAPTNIVY

SEQ ID NO: 4918 - protein, 10 aa, Artificial Sequence
  ATP-dependent RNA helicase DHX8 (57-66)
AEKNTTFDTF

SEQ ID NO: 4919 - protein, 11 aa, Artificial Sequence
  Cysteine andine-rich protein 1 (129-139)
AEKVIGAGKSW

SEQ ID NO: 4920 - protein, 10 aa, Artificial Sequence
  ER membrane protein complex subunit 2 (162-171)
AELYINEHDY

SEQ ID NO: 4921 - protein, 10 aa, Artificial Sequence
  Catenin beta-1 (478-487)
AEMAQNAVRL

SEQ ID NO: 4922 - protein, 9 aa, Artificial Sequence
  Cleavage stimulation factor subunit 1 (217-225)
AEMLRSISF

SEQ ID NO: 4923 - protein, 9 aa, Artificial Sequence
  DNA-dependent protein kinase catalytic subunit (193-201)
AENLFRAFL

SEQ ID NO: 4924 - protein, 11 aa, Artificial Sequence
  Proteasome subunit beta type-1 (211-221)
AERDVYTGDAL

SEQ ID NO: 4925 - protein, 9 aa, Artificial Sequence
  Exportin-2 (513-521)
AESIVVHTY

SEQ ID NO: 4926 - protein, 9 aa, Artificial Sequence
  Full=Zinc finger CCCH domain-containing protein 16 (227-235)
AEVAAEKSF

SEQ ID NO: 4927 - protein, 11 aa, Artificial Sequence
  Targeting protein for Xklp2 (638-648)
AEVEAQKAQQL

SEQ ID NO: 4928 - protein, 9 aa, Artificial Sequence
  Transmembrane emp24 domain-containing protein 3 (92-100)
AEVKGVYQF

SEQ ID NO: 4929 - protein, 10 aa, Artificial Sequence
  DNA-dependent protein kinase catalytic subunit (2320-2329)
AEVLGLILRY

SEQ ID NO: 4930 - protein, 10 aa, Artificial Sequence
  Spectrin beta chain, non-erythrocytic 1 (1304-1313)
DEARNLHSKW

SEQ ID NO: 4931 - protein, 9 aa, Artificial Sequence
  Protein KIAA0100 (696-704)
DEAVGVQKW

SEQ ID NO: 4932 - protein, 10 aa, Artificial Sequence
  Transcription elongation factor SPT6 (573-582)
DEFSHQVQEW

SEQ ID NO: 4933 - protein, 9 aa, Artificial Sequence
  Heat shock protein HSP 90-alpha (288-296)
DEMVSLKDY

SEQ ID NO: 4934 - protein, 10 aa, Artificial Sequence
  Cyclin-dependent kinase inhibitor 3 (22-31)
DEQTPIHISW

SEQ ID NO: 4935 - protein, 9 aa, Artificial Sequence
  Spectrin beta chain, non-erythrocytic 1 (741-749)
EEASLLHQF

SEQ ID NO: 4936 - protein, 11 aa, Artificial Sequence
  Eukaryotic translation initiation factor 3 subunit M (11-21)
EEDQAAELRAY

SEQ ID NO: 4937 - protein, 9 aa, Artificial Sequence
  Protein transport protein Sec23B (521-529)
EEGPDVLRW

SEQ ID NO: 4938 - protein, 11 aa, Artificial Sequence
  40S ribosomal protein S17 (36-46)
EEIAIIPSKKL

SEQ ID NO: 4939 - protein, 10 aa, Artificial Sequence
  Sigma non-opioid intracellular receptor 1 (40-49)
EEIAQLARQY

SEQ ID NO: 4940 - protein, 11 aa, Artificial Sequence
  DNA repair protein RAD50 (1002-1012)
EEINKIIRDLW

SEQ ID NO: 4941 - protein, 9 aa, Artificial Sequence
  Targeting protein for Xklp2 (351-359)
EELEKLQQY

SEQ ID NO: 4942 - protein, 9 aa, Artificial Sequence
  26S proteasome non-ATPase regulatory subunit 13 (26-34)
EELYTKKLW

SEQ ID NO: 4943 - protein, 12 aa, Artificial Sequence
  Nuclear pore complex protein Nup153 (1104-1115)
EEMPATKGGFSF

SEQ ID NO: 4944 - protein, 11 aa, Artificial Sequence
  Eukaryotic initiation factor 4A-I (396-406)
EEMPLNVADLI

SEQ ID NO: 4945 - protein, 9 aa, Artificial Sequence
  General transcription factor 3C polypeptide 1 (183-191)
EESDLSRQY

SEQ ID NO: 4946 - protein, 10 aa, Artificial Sequence
  Protein SCO1 homolog, mitochondrial (121-130)
EEVDQVARAY

SEQ ID NO: 4947 - protein, 10 aa, Artificial Sequence
  F-box/LRR-repeat protein 3 (394-403)
EEVLIPDQKY

SEQ ID NO: 4948 - protein, 9 aa, Artificial Sequence
  von Willebrand factor (1339-1347)
ELRRIASQV

SEQ ID NO: 4949 - protein, 5 aa, Artificial Sequence
  DNA nucleotidylexotransferase (64-68)
FRRGK

SEQ ID NO: 4950 - protein, 9 aa, Artificial Sequence
  Spectrin beta chain, non-erythrocytic 1 (1059-1067)
GEASKLQQF

SEQ ID NO: 4951 - protein, 10 aa, Artificial Sequence
  Endothelial differentiation-related factor 1 (35-44)
GEDVETSKKW

SEQ ID NO: 4952 - protein, 9 aa, Artificial Sequence
  Serine/arginine-rich splicing factor 9 (175-183)
GETSYIRVY

SEQ ID NO: 4953 - protein, 11 aa, Artificial Sequence
  Peroxiredoxin-5, mitochondrial (36-46)
GEWASGGVRSF

SEQ ID NO: 4954 - protein, 9 aa, Artificial Sequence
  Probable E3 ubiquitin-protein ligase makorin-2 (170-178)
HEMEKAFAF

SEQ ID NO: 4955 - protein, 10 aa, Artificial Sequence
  Antigen KI-67 (54-63)
HEQEAILHNF

SEQ ID NO: 4956 - protein, 10 aa, Artificial Sequence
  Mediator of RNA polymerase II transcription subunit 17 (187-196)
IEDPQIQAHW

SEQ ID NO: 4957 - protein, 9 aa, Artificial Sequence
  Actin, aortic smooth muscle (73-81)
IEHGIITNW

SEQ ID NO: 4958 - protein, 11 aa, Artificial Sequence
  DNA topoisomerase 2-alpha (921-931)
IEISELPVRTW

SEQ ID NO: 4959 - protein, 9 aa, Artificial Sequence
  Non-canonical poly(A) RNA polymerase PAPD5 (227-235)
IESVIKELW

SEQ ID NO: 4960 - protein, 15 aa, Artificial Sequence
  Interleukin-9 receptor (168-182)
ISPALEPMTTLLSYE

SEQ ID NO: 4961 - protein, 10 aa, Artificial Sequence
  T-complex protein 1 subunit gamma (6-15)
LEIKKIGDEY

SEQ ID NO: 4962 - protein, 11 aa, Artificial Sequence
  Trafficking protein particle complex subunit 5 (105-115)
LEQANDDARTF

SEQ ID NO: 4963 - protein, 10 aa, Artificial Sequence
  Eukaryotic translation initiation factor 3 subunit D (314-323)
MEATYINHNF

SEQ ID NO: 4964 - protein, 10 aa, Artificial Sequence
  Magnesium transporter protein 1 (242-251)
MEFLFNKTGW

SEQ ID NO: 4965 - protein, 9 aa, Artificial Sequence
  Transforming acidic coiled-coil-containing protein 3 (718-726)
MEKSFSDLF

SEQ ID NO: 4966 - protein, 10 aa, Artificial Sequence
  Membrane-associated tyrosine- and threonine-specific cdc2-inhibitory kinase (234-243)
MELPHGGEGW

SEQ ID NO: 4967 - protein, 9 aa, Artificial Sequence
  AAC83183.1 (92-100)
MESLTKHLF

SEQ ID NO: 4968 - protein, 10 aa, Artificial Sequence
  60S ribosomal protein L4 (212-221)
NEDNGIIKAF

SEQ ID NO: 4969 - protein, 11 aa, Artificial Sequence
  Protein transport protein Sec23B (420-430)
NELGVGGTSQW

SEQ ID NO: 4970 - protein, 10 aa, Artificial Sequence
  Long-chain-fatty-acid-CoA ligase 4 (65-74)
NEMQPNGKVF

SEQ ID NO: 4971 - protein, 10 aa, Artificial Sequence
  Mortality factor 4-like protein 1 (215-224)
NEVVAGIKEY

SEQ ID NO: 4972 - protein, 8 aa, Artificial Sequence
  Ig kappa chain C region (1-8)
NIVMTQSP

SEQ ID NO: 4973 - protein, 9 aa, Artificial Sequence
  Multifunctional protein ADE2 (69-77)
QEAGIKTAF

SEQ ID NO: 4974 - protein, 11 aa, Artificial Sequence
  Guanine nucleotide-binding protein G(s) subunit alpha isoforms short (257-267)
QEALNLFKSIW

SEQ ID NO: 4975 - protein, 11 aa, Artificial Sequence
  Spectrin beta chain, non-erythrocytic 1 (1864-1874)
QEDAARLQAAY

SEQ ID NO: 4976 - protein, 10 aa, Artificial Sequence
  Annexin A2 (138-147)
QELQEINRVY

SEQ ID NO: 4977 - protein, 10 aa, Artificial Sequence
  TPT1-like protein (84-93)
QETSFTKEAY

SEQ ID NO: 4978 - protein, 11 aa, Artificial Sequence
  AP-5 complex subunit zeta-1 (14-24)
REIQDEELKKF

SEQ ID NO: 4979 - protein, 11 aa, Artificial Sequence
  Eukaryotic translation initiation factor 3 subunit C-like protein (201-211)
SEAPSGESRKF

SEQ ID NO: 4980 - protein, 9 aa, Artificial Sequence
  Histone H2B type 1-A (77-85)
SEASRLAHY

SEQ ID NO: 4981 - protein, 12 aa, Artificial Sequence
  Protein transport protein Sec31A (233-244)
SEDDRLPVIQMW

SEQ ID NO: 4982 - protein, 9 aa, Artificial Sequence
  DnaJ homolog subfamily C member 7 (393-401)
SEDEIKKAY

SEQ ID NO: 4983 - protein, 9 aa, Artificial Sequence
  WD repeat-containing protein 82 (86-94)
SEDGKIHVW

SEQ ID NO: 4984 - protein, 10 aa, Artificial Sequence
  Poly (ADP-ribose) polymerase 1 (808-817)
SEEAEIIRKY

SEQ ID NO: 4985 - protein, 9 aa, Artificial Sequence
  Polypyrimidine tract-binding protein 1 (485-493)
SEEDLKVLF

SEQ ID NO: 4986 - protein, 12 aa, Artificial Sequence
  Eukaryotic translation initiation factor 3 subunit M (10-21)
SEEDQAAELRAY

SEQ ID NO: 4987 - protein, 9 aa, Artificial Sequence
  General transcription factor 3C polypeptide 1 (415-423)
SEEGLLRLY

SEQ ID NO: 4988 - protein, 10 aa, Artificial Sequence
  Disco-interacting protein 2 homolog A (29-38)
SEGDITQKGY

SEQ ID NO: 4989 - protein, 9 aa, Artificial Sequence
  DNA replication licensing factor MCM5 (690-698)
SEHSIIKDF

SEQ ID NO: 4990 - protein, 9 aa, Artificial Sequence
  Disks large homolog 1 (143-151)
SEIENVHGF

SEQ ID NO: 4991 - protein, 11 aa, Artificial Sequence
  Protein SET (61-71)
SELIAKIPNFW

SEQ ID NO: 4992 - protein, 9 aa, Artificial Sequence
  Uncharacterized protein C14orf119 (121-129)
SEPDFVAKF

SEQ ID NO: 4993 - protein, 9 aa, Artificial Sequence
  Ubiquitin-conjugating enzyme E2 J1 (204-212)
SESDLNHSF

SEQ ID NO: 4994 - protein, 9 aa, Artificial Sequence
  Nucleolar transcription factor 1 (275-283)
SESELTRLL

SEQ ID NO: 4995 - protein, 9 aa, Artificial Sequence
  Citrate synthase, mitochondrial (120-128)
SESNFARAY

SEQ ID NO: 4996 - protein, 9 aa, Artificial Sequence
  GMP reductase 2 (46-54)
SEVDLTRSF

SEQ ID NO: 4997 - protein, 13 aa, Artificial Sequence
  Single Ig IL-1-related receptor (383-395)
SEVDVSDLGSRNY

SEQ ID NO: 4998 - protein, 9 aa, Artificial Sequence
  Sulfhydryl oxidase 1 (223-231)
TEANVVRKF

SEQ ID NO: 4999 - protein, 10 aa, Artificial Sequence
  Cyclin-D1-binding protein 1 (44-53)
TEEFNREMFW

SEQ ID NO: 5000 - protein, 10 aa, Artificial Sequence
  Staphylococcal nuclease domain-containing protein 1 (663-672)
TEITDDLHFY

SEQ ID NO: 5001 - protein, 9 aa, Artificial Sequence
  Eukaryotic translation initiation factor 3 subunit M (142-150)
TELDQVRKW

SEQ ID NO: 5002 - protein, 10 aa, Artificial Sequence
  Serine/arginine-rich splicing factor 3 (24-33)
TELERAFGYY

SEQ ID NO: 5003 - protein, 11 aa, Artificial Sequence
  HLA class II histocompatibility antigen, DRB1-15 beta chain (46-56)
TELGRPDAEYW

SEQ ID NO: 5004 - protein, 9 aa, Artificial Sequence
  Pre-mRNA-splicing factor ISY1 homolog (37-45)
TELPKAEKW

SEQ ID NO: 5005 - protein, 11 aa, Artificial Sequence
  Coatomer subunit delta (46-56)
TEMDSHEEKVF

SEQ ID NO: 5006 - protein, 9 aa, Artificial Sequence
  CUGBP Elav-like family member 1 (120-128)
TENDIRVMF

SEQ ID NO: 5007 - protein, 9 aa, Artificial Sequence
  Gamma-secretase subunit PEN-2 (48-56)
TEQSQIKGY

SEQ ID NO: 5008 - protein, 11 aa, Artificial Sequence
  Gamma-secretase subunit PEN-2 (48-58)
TEQSQIKGYVW

SEQ ID NO: 5009 - protein, 9 aa, Artificial Sequence
  Tyrosine-protein kinase BAZ1B (274-282)
VEDELVKKY

SEQ ID NO: 5010 - protein, 9 aa, Artificial Sequence
  Vigilin (405-413)
VEINIDHKF

SEQ ID NO: 5011 - protein, 11 aa, Artificial Sequence
  Influenza virus NS1A-binding protein (576-586)
VEMYDPTRNEW

SEQ ID NO: 5012 - protein, 10 aa, Artificial Sequence
  Target of rapamycin complex subunit LST8 (298-307)
VETGEIKREY

SEQ ID NO: 5013 - protein, 10 aa, Artificial Sequence
  Methionine aminopeptidase 2 (311-320)
YEVEIDGKTY

SEQ ID NO: 5014 - protein, 14 aa, Artificial Sequence
  Gamma-secretase C-terminal fragment 59 (565-578)
FRHDSGYEVHHQKL

SEQ ID NO: 5015 - protein, 9 aa, Artificial Sequence
  Disintegrin and metalloproteinase domain-containing protein 10 (19-27)
GQYGNPLNK

SEQ ID NO: 5016 - protein, 8 aa, Artificial Sequence
  Beta-2-microglobulin (21-28)
IQRTPKIQ

SEQ ID NO: 5017 - protein, 10 aa, Artificial Sequence
  Beta-2-microglobulin (21-30)
IQRTPKIQVY

SEQ ID NO: 5018 - protein, 9 aa, Artificial Sequence
  Splicing factor 3B subunit 2 (36-44)
RQTGIVLNR

SEQ ID NO: 5019 - protein, 9 aa, Artificial Sequence
  Importin subunit alpha-1 (377-385)
GLVPFLVSV

SEQ ID NO: 5020 - protein, 9 aa, Artificial Sequence
  Neutral alpha-glucosidase AB (3-11)
AVAAVAARR

SEQ ID NO: 5021 - protein, 10 aa, Artificial Sequence
  60S ribosomal protein L15 (131-140)
EVILIDPFHK

SEQ ID NO: 5022 - protein, 10 aa, Artificial Sequence
  Cullin-4A (5-14)
APRKGSFSAL

SEQ ID NO: 5023 - protein, 10 aa, Artificial Sequence
  Fatty acid synthase (1169-1178)
IPRDPSQQEL

SEQ ID NO: 5024 - protein, 10 aa, Artificial Sequence
  Carbonic anhydrase 9 (397-406)
SPRAAEPVQL

SEQ ID NO: 5025 - protein, 9 aa, Artificial Sequence
  BTB/POZ domain-containing adapter for CUL3-mediated RhoA degradation protein 3 (28-36)
SPSSKYVKL

SEQ ID NO: 5026 - protein, 9 aa, Artificial Sequence
  Melanoma-associated antigen 10 (254-262)
GLYDGMEHL

SEQ ID NO: 5027 - protein, 9 aa, Artificial Sequence
  26S proteasome non-ATPase regulatory subunit 6 (103-111)
AMMAKAEYL

SEQ ID NO: 5028 - protein, 9 aa, Artificial Sequence
  40S ribosomal protein S26 (107-115)
APRPPPKPM

SEQ ID NO: 5029 - protein, 9 aa, Artificial Sequence
  Elongation factor 2 (286-294)
AYLPVNESF

SEQ ID NO: 5030 - protein, 9 aa, Artificial Sequence
  Long-chain-fatty-acid-CoA ligase 3 (326-334)
GYLPLAHVL

SEQ ID NO: 5031 - protein, 9 aa, Artificial Sequence
  m7GpppX diphosphatase (268-276)
HYLPSYYHL

SEQ ID NO: 5032 - protein, 9 aa, Artificial Sequence
  N6-adenosine-methyltransferase subunit METTL14 (99-107)
IYKDSSTFL

SEQ ID NO: 5033 - protein, 9 aa, Artificial Sequence
  Ubiquitin-conjugating enzyme E2 H (17-25)
KLIESKHEV

SEQ ID NO: 5034 - protein, 9 aa, Artificial Sequence
  Adenylosuccinate synthetase isozyme 2 (347-355)
KYAHMINGF

SEQ ID NO: 5035 - protein, 9 aa, Artificial Sequence
  Serine/threonine-protein phosphatase 2A 56 kDa regulatory subunit epsilon isoform (174-182)
KYIDQKFVL

SEQ ID NO: 5036 - protein, 9 aa, Artificial Sequence
  Actin-binding protein IPP (238-246)
KYIEGVSDF

SEQ ID NO: 5037 - protein, 9 aa, Artificial Sequence
  Mitogen-activated protein kinase 4 (138-146)
KYIHSANVL

SEQ ID NO: 5038 - protein, 9 aa, Artificial Sequence
  Tyrosine-protein phosphatase non-receptor type 23 (70-78)
KYLGQLHYL

SEQ ID NO: 5039 - protein, 10 aa, Artificial Sequence
  Mitochondrial carrier homolog 1 (280-289)
KYLSVQGQLF

SEQ ID NO: 5040 - protein, 9 aa, Artificial Sequence
  Caprin-1 (98-106)
KYQEVTNNL

SEQ ID NO: 5041 - protein, 9 aa, Artificial Sequence
  Mitochondrial carrier homolog 1 (168-176)
KYSGVLSSI

SEQ ID NO: 5042 - protein, 9 aa, Artificial Sequence
  Microspherule protein 1 (251-259)
LYDPVISKL

SEQ ID NO: 5043 - protein, 9 aa, Artificial Sequence
  Splicing factor 3B subunit 3 (988-996)
NYISGIQTI

SEQ ID NO: 5044 - protein, 9 aa, Artificial Sequence
  Vimentin (357-365)
NYQDTIGRL

SEQ ID NO: 5045 - protein, 9 aa, Artificial Sequence
  Stomatin-like protein 2, mitochondrial (236-244)
QYVSAFSKL

SEQ ID NO: 5046 - protein, 10 aa, Artificial Sequence
  Actin, cytoplasmic 2 (85-94)
RVAPEEHPVL

SEQ ID NO: 5047 - protein, 9 aa, Artificial Sequence
  Casein kinase I isoform delta (178-186)
RYASINTHL

SEQ ID NO: 5048 - protein, 9 aa, Artificial Sequence
  Dolichyl-diphosphooligosaccharide-proteinosyltransferase subunit 2 (218-226)
RYIANTVEL

SEQ ID NO: 5049 - protein, 9 aa, Artificial Sequence
  Signal transducer and activator of transcription 3 (13-21)
RYLEQLHQL

SEQ ID NO: 5050 - protein, 9 aa, Artificial Sequence
  Protein kish-A (2-10)
SAIFNFQSL

SEQ ID NO: 5051 - protein, 9 aa, Artificial Sequence
  Seipin (55-63)
SYMPTVSHL

SEQ ID NO: 5052 - protein, 9 aa, Artificial Sequence
  CMP-N-acetylneuraminate-beta-galactosamide-alpha-2,3-sialyltransf erase 2 (239-247)
TYAPVKSFL

SEQ ID NO: 5053 - protein, 9 aa, Artificial Sequence
  Cleft lip and palate transmembrane protein 1 (545-553)
TYKALNTFI

SEQ ID NO: 5054 - protein, 9 aa, Artificial Sequence
  Proteasome subunit beta type-6 (94-102)
TYQLGFHSI

SEQ ID NO: 5055 - protein, 9 aa, Artificial Sequence
  RNA-binding protein 42 (91-99)
TYQQVQQTL

SEQ ID NO: 5056 - protein, 9 aa, Artificial Sequence
  DNA replication licensing factor MCM7 (231-239)
TYTSARTLL

SEQ ID NO: 5057 - protein, 9 aa, Artificial Sequence
  Alpha-enolase (18-26)
VYHNLKNVI

SEQ ID NO: 5058 - protein, 9 aa, Artificial Sequence
  Unconventional myosin-Ic (350-358)
VYSRTFTWL

SEQ ID NO: 5059 - protein, 11 aa, Artificial Sequence
  THO complex subunit 5 homolog (420-430)
YQFDKVGILTL

SEQ ID NO: 5060 - protein, 9 aa, Artificial Sequence
  Splicing factor 3B subunit 3 (1166-1174)
YYFPVKNVI

SEQ ID NO: 5061 - protein, 9 aa, Artificial Sequence
  Solute carrier family 35 member B1 (27-35)
YYGILQEKI

SEQ ID NO: 5062 - protein, 8 aa, Artificial Sequence
  Transformation/transcription domain-associated protein (1974-1981)
YYPVRHHL

SEQ ID NO: 5063 - protein, 16 aa, Artificial Sequence
  Gamma-secretase C-terminal fragment 59 (563-578)
AEFRHDSGYEVHHQKL

SEQ ID NO: 5064 - protein, 10 aa, Artificial Sequence
  Ribosome-binding protein 1 (168-177)
AILETAPKEV

SEQ ID NO: 5065 - protein, 9 aa, Artificial Sequence
  Sarcoplasmic/endoplasmic reticulum calcium ATPase 1 (206-214)
AIVRSLPSV

SEQ ID NO: 5066 - protein, 9 aa, Artificial Sequence
  ATP-dependent RNA helicase DDX50 (247-255)
ALAAALAHI

SEQ ID NO: 5067 - protein, 10 aa, Artificial Sequence
  Splicing factor, proline- and glutamine-rich (343-352)
ALAEIAKAEL

SEQ ID NO: 5068 - protein, 12 aa, Artificial Sequence
  DDB1- and CUL4-associated factor 11 (187-198)
ALAGHQDGITFI

SEQ ID NO: 5069 - protein, 9 aa, Artificial Sequence
  EH domain-containing protein 1 (502-510)
ALANHLIKV

SEQ ID NO: 5070 - protein, 9 aa, Artificial Sequence
  COP9 signalosome complex subunit 7a (30-38)
ALATLIHQV

SEQ ID NO: 5071 - protein, 9 aa, Artificial Sequence
  Cullin-2 (304-312)
ALDKALTSV

SEQ ID NO: 5072 - protein, 9 aa, Artificial Sequence
  Glutathione S-transferase A4 (73-81)
ALEEKIPNI

SEQ ID NO: 5073 - protein, 9 aa, Artificial Sequence
  WD repeat-containing protein 19 (108-116)
ALFEGKVQL

SEQ ID NO: 5074 - protein, 9 aa, Artificial Sequence
  H/ACA ribonucleoprotein complex subunit 4 (179-187)
ALFQRPPLI

SEQ ID NO: 5075 - protein, 9 aa, Artificial Sequence
  Serine palmitoyltransferase 2 (292-300)
ALGPTGRGV

SEQ ID NO: 5076 - protein, 11 aa, Artificial Sequence
  Syntaxin-binding protein 3 (373-383)
ALGTDAEGQKV

SEQ ID NO: 5077 - protein, 9 aa, Artificial Sequence
  Apoptosis-associated speck-like protein containing a CARD (118-126)
ALIARVTNV

SEQ ID NO: 5078 - protein, 9 aa, Artificial Sequence
  DNA damage-inducible transcript 3 protein (158-166)
ALIDRMVNL

SEQ ID NO: 5079 - protein, 11 aa, Artificial Sequence
  Erlin-2 (214-224)
ALIEAEKVAQV

SEQ ID NO: 5080 - protein, 9 aa, Artificial Sequence
  DNA polymerase alpha subunit B (22-30)
ALIEKLVEL

SEQ ID NO: 5081 - protein, 9 aa, Artificial Sequence
  Thyroid adenoma-associated protein (142-150)
ALITRIFGV

SEQ ID NO: 5082 - protein, 9 aa, Artificial Sequence
  Proliferating cell nuclear antigen (18-26)
ALKDLINEA

SEQ ID NO: 5083 - protein, 11 aa, Artificial Sequence
  Eukaryotic translation initiation factor 3 subunit D (439-449)
ALLAGSEYLKL

SEQ ID NO: 5084 - protein, 9 aa, Artificial Sequence
  AP-3 complex subunit delta-1 (461-469)
ALLDSAHLL

SEQ ID NO: 5085 - protein, 12 aa, Artificial Sequence
  Extended synaptotagmin-2 (137-148)
ALLEDEERVVRL

SEQ ID NO: 5086 - protein, 9 aa, Artificial Sequence
  Transportin-1 (689-697)
ALLGDLTKA

SEQ ID NO: 5087 - protein, 9 aa, Artificial Sequence
  NudC domain-containing protein 3 (12-20)
ALLGILQHV

SEQ ID NO: 5088 - protein, 9 aa, Artificial Sequence
  ATP synthase subunit beta, mitochondrial (320-328)
ALLGRIPSA

SEQ ID NO: 5089 - protein, 9 aa, Artificial Sequence
  Ubiquitin carboxyl-terminal hydrolase 35 (288-296)
ALLKGLAAV

SEQ ID NO: 5090 - protein, 9 aa, Artificial Sequence
  Proline and serine-rich protein 1 (900-908)
ALLQQVHSA

SEQ ID NO: 5091 - protein, 9 aa, Artificial Sequence
  Lysine-specific histone demethylase 1A (418-426)
ALLSGLREA

SEQ ID NO: 5092 - protein, 11 aa, Artificial Sequence
  Hsp90 co-chaperone Cdc37 (204-214)
ALMEQVAHQTI

SEQ ID NO: 5093 - protein, 11 aa, Artificial Sequence
  Ubiquitin-conjugating enzyme E2 S (128-138)
ALNEEAGRLLL

SEQ ID NO: 5094 - protein, 9 aa, Artificial Sequence
  Talin-1 (777-785)
ALNELLQHV

SEQ ID NO: 5095 - protein, 9 aa, Artificial Sequence
  Kinetochore protein NDC80 homolog (274-282)
ALNEQIARL

SEQ ID NO: 5096 - protein, 9 aa, Artificial Sequence
  Influenza virus NS1A-binding protein (460-468)
ALNGKLYIV

SEQ ID NO: 5097 - protein, 9 aa, Artificial Sequence
  Integrator complex subunit 4 (235-243)
ALQEKLWNV

SEQ ID NO: 5098 - protein, 9 aa, Artificial Sequence
  BRISC complex subunit Abro1 (215-223)
ALQEKVQAV

SEQ ID NO: 5099 - protein, 9 aa, Artificial Sequence
  Enhancer of filamentation 1 (806-814)
ALQEMVHQV

SEQ ID NO: 5100 - protein, 9 aa, Artificial Sequence
  Alpha-taxilin (67-75)
ALRDVSEEL

SEQ ID NO: 5101 - protein, 9 aa, Artificial Sequence
  SET and MYND domain-containing protein 4 (220-228)
ALREENEQL

SEQ ID NO: 5102 - protein, 9 aa, Artificial Sequence
  Leucine-rich PPR motif-containing protein, mitochondrial (676-684)
ALRGEIETV

SEQ ID NO: 5103 - protein, 9 aa, Artificial Sequence
  HAUS augmin-like complex subunit 1 (219-227)
ALSEKLARL

SEQ ID NO: 5104 - protein, 10 aa, Artificial Sequence
  T-complex protein 1 subunit zeta (162-171)
ALSKEGIVAL

SEQ ID NO: 5105 - protein, 9 aa, Artificial Sequence
  Coatomer subunit gamma-1 (159-167)
ALVSSLHLL

SEQ ID NO: 5106 - protein, 10 aa, Artificial Sequence
  Guanine nucleotide-binding protein G(s) subunit alpha isoforms short (142-151)
ALWEDEGVRA

SEQ ID NO: 5107 - protein, 9 aa, Artificial Sequence
  FERM, RhoGEF and pleckstrin domain-containing protein 2 (602-610)
ALWEGPSKA

SEQ ID NO: 5108 - protein, 9 aa, Artificial Sequence
  Mannose-1-phosphate guanyltransferase alpha (254-262)
ALYASRLYL

SEQ ID NO: 5109 - protein, 9 aa, Artificial Sequence
  Structural maintenance of chromosomes flexible hinge domain-containing protein 1 (656-664)
ALYDEVRTV

SEQ ID NO: 5110 - protein, 9 aa, Artificial Sequence
  Asparagine synthetase (glutamine-hydrolyzing) (131-139)
ALYDNVEKL

SEQ ID NO: 5111 - protein, 9 aa, Artificial Sequence
  A-kinase anchor protein 11 (579-587)
ALYHLAIKL

SEQ ID NO: 5112 - protein, 10 aa, Artificial Sequence
  tRNA-splicing ligase RtcB homolog (146-155)
AMFDHIPVGV

SEQ ID NO: 5113 - protein, 9 aa, Artificial Sequence
  Sister chromatid cohesion protein PDS5 homolog A (534-542)
AMFGKLMTI

SEQ ID NO: 5114 - protein, 9 aa, Artificial Sequence
  Autophagy-related protein 101 (20-28)
AMLAVLHTV

SEQ ID NO: 5115 - protein, 11 aa, Artificial Sequence
  ATP-binding cassette sub-family F member 1 (296-306)
AMLENASDIKL

SEQ ID NO: 5116 - protein, 9 aa, Artificial Sequence
  Ankyrin repeat and KH domain-containing protein 1 (1231-1239)
AMNGHVPAV

SEQ ID NO: 5117 - protein, 9 aa, Artificial Sequence
  Phosphopantothenoylcysteine decarboxylase (65-73)
AMWEHPITA

SEQ ID NO: 5118 - protein, 10 aa, Artificial Sequence
  Bifunctional methylenetetrahydrofolate dehydrogenase/cyclohydrolase, mitochondrial (270-279)
AVIDVGINRV

SEQ ID NO: 5119 - protein, 9 aa, Artificial Sequence
  Leucine-rich repeat flightless-interacting protein 2 (349-357)
DLKDQIQDV

SEQ ID NO: 5120 - protein, 9 aa, Artificial Sequence
  ADP-ribosylation factor GTPase-activating protein 3 (152-160)
FASHVSPEV

SEQ ID NO: 5121 - protein, 10 aa, Artificial Sequence
  Plexin-B2 (141-150)
FIFDVHVHEV

SEQ ID NO: 5122 - protein, 10 aa, Artificial Sequence
  Ankyrin repeat and LEM domain-containing protein 2 (100-109)
FIFEKKLAQA

SEQ ID NO: 5123 - protein, 10 aa, Artificial Sequence
  Signal transducer and activator of transcription 5B (332-341)
FIIEKQPPQV

SEQ ID NO: 5124 - protein, 9 aa, Artificial Sequence
  DNA-directed RNA polymerase I subunit RPA2 (31-39)
FIINGIEKV

SEQ ID NO: 5125 - protein, 10 aa, Artificial Sequence
  Son of sevenless homolog 1 (444-453)
FIMEGTLTRV

SEQ ID NO: 5126 - protein, 9 aa, Artificial Sequence
  Formin-like protein 1 (47-55)
FINIVVHSV

SEQ ID NO: 5127 - protein, 9 aa, Artificial Sequence
  Exocyst complex component 4 (169-177)
FIQEIEHAL

SEQ ID NO: 5128 - protein, 9 aa, Artificial Sequence
  26S proteasome non-ATPase regulatory subunit 13 (63-71)
FISEFEHRV

SEQ ID NO: 5129 - protein, 9 aa, Artificial Sequence
  Dystonin (4051-4059)
FIWENIHTL

SEQ ID NO: 5130 - protein, 10 aa, Artificial Sequence
  Cytoskeleton-associated protein 5 (478-487)
FLADVDKLKL

SEQ ID NO: 5131 - protein, 10 aa, Artificial Sequence
  DNA dC-dU-editing enzyme APOBEC-3F (106-115)
FLAEHPNVTL

SEQ ID NO: 5132 - protein, 11 aa, Artificial Sequence
  General transcription factor 3C polypeptide 2 (609-619)
FLAHDQAVRTL

SEQ ID NO: 5133 - protein, 9 aa, Artificial Sequence
  DCC-interacting protein 13-alpha (225-233)
FLANIGTSV

SEQ ID NO: 5134 - protein, 9 aa, Artificial Sequence
  Nucleoside diphosphate kinase 3 (25-33)
FLAVKPDGV

SEQ ID NO: 5135 - protein, 9 aa, Artificial Sequence
  Basic leucine zipper and W2 domain-containing protein 1 (57-65)
FLDASGAKL

SEQ ID NO: 5136 - protein, 9 aa, Artificial Sequence
  Probable JmjC domain-containing histone demethylation protein 2C (60-68)
FLDDVVHSL

SEQ ID NO: 5137 - protein, 9 aa, Artificial Sequence
  Dipeptidyl peptidase 8 (72-80)
FLDENVHFA

SEQ ID NO: 5138 - protein, 9 aa, Artificial Sequence
  Myotubularin (308-316)
FLDIHNIHV

SEQ ID NO: 5139 - protein, 9 aa, Artificial Sequence
  Ubiquitin fusion degradation protein 1 homolog (168-176)
FLDITNPKA

SEQ ID NO: 5140 - protein, 9 aa, Artificial Sequence
  RHO/RAC effector protein (1023-1031)
FLDKNDHSL

SEQ ID NO: 5141 - protein, 9 aa, Artificial Sequence
  Epidermal growth factor receptor substrate 15-like 1 (67-75)
FLDKQGFYV

SEQ ID NO: 5142 - protein, 9 aa, Artificial Sequence
  Serine/threonine-protein kinase N1 (458-466)
FLDNERHEV

SEQ ID NO: 5143 - protein, 11 aa, Artificial Sequence
  Sphingomyelin phosphodiesterase 4 (86-96)
FLDPGGPMMKL

SEQ ID NO: 5144 - protein, 10 aa, Artificial Sequence
  Probable dolichyl pyrophosphate Glc1Man9GlcNAc2 alpha-1,3-glucosyltransferase (305-314)
FLDPNNIPKA

SEQ ID NO: 5145 - protein, 9 aa, Artificial Sequence
  trabeculin-alpha (1734-1742)
FLDQHGHNL

SEQ ID NO: 5146 - protein, 9 aa, Artificial Sequence
  Gamma-tubulin complex component 5 (53-61)
FLDVNSHKI

SEQ ID NO: 5147 - protein, 9 aa, Artificial Sequence
  Bromodomain adjacent to zinc finger domain protein 2A (750-758)
FLEPVNPRL

SEQ ID NO: 5148 - protein, 9 aa, Artificial Sequence
  Serine/threonine-protein phosphatase 4 regulatory subunit 3A (581-589)
FLFEPVVKA

SEQ ID NO: 5149 - protein, 9 aa, Artificial Sequence
  Protein yippee-like 5 (43-51)
FLFNKVVNL

SEQ ID NO: 5150 - protein, 9 aa, Artificial Sequence
  Protein TASOR (98-106)
FLFQEPRSI

SEQ ID NO: 5151 - protein, 9 aa, Artificial Sequence
  Protein FAM177A1 (116-124)
FLGEKIASV

SEQ ID NO: 5152 - protein, 9 aa, Artificial Sequence
  Meckelin (880-888)
FLGSFIDHV

SEQ ID NO: 5153 - protein, 10 aa, Artificial Sequence
  60S ribosomal protein L34 (95-104)
FLIEEQKIVV

SEQ ID NO: 5154 - protein, 10 aa, Artificial Sequence
  TBCC domain-containing protein 1 (214-223)
FLIEGTISRA

SEQ ID NO: 5155 - protein, 9 aa, Artificial Sequence
  T-complex protein 1 subunit beta (218-226)
FLLDKKIGV

SEQ ID NO: 5156 - protein, 11 aa, Artificial Sequence
  Plectin (3718-3728)
FLLDPVKGERL

SEQ ID NO: 5157 - protein, 9 aa, Artificial Sequence
  GDP-mannose 4,6 dehydratase (9-17)
FLLEKGYEV

SEQ ID NO: 5158 - protein, 9 aa, Artificial Sequence
  Protein arginine N-methyltransferase 3 (423-431)
FLLEKPFSV

SEQ ID NO: 5159 - protein, 9 aa, Artificial Sequence
  Unconventional myosin-If (148-156)
FLLEKSRVV

SEQ ID NO: 5160 - protein, 9 aa, Artificial Sequence
  TBC1 domain family member 9B (187-195)
FLLGKEVSL

SEQ ID NO: 5161 - protein, 11 aa, Artificial Sequence
  Poly (ADP-ribose) polymerase 10 (535-545)
FLLGPEGQHLL

SEQ ID NO: 5162 - protein, 10 aa, Artificial Sequence
  Transport and Golgi organization protein 6 homolog (990-999)
FLLGSVVHEV

SEQ ID NO: 5163 - protein, 9 aa, Artificial Sequence
  Protein transport protein Sec24A (394-402)
FLLHIQQQV

SEQ ID NO: 5164 - protein, 10 aa, Artificial Sequence
  GMP synthase (glutamine-hydrolyzing) (510-519)
FLLPIKTVGV

SEQ ID NO: 5165 - protein, 9 aa, Artificial Sequence
  Nuclear pore complex protein Nup133 (610-618)
FLMDFIHQV

SEQ ID NO: 5166 - protein, 11 aa, Artificial Sequence
  SHC SH2 domain-binding protein 1 (439-449)
FLMKNSDLYGA

SEQ ID NO: 5167 - protein, 9 aa, Artificial Sequence
  3-hydroxyacyl-CoA dehydrogenase type-2 (245-253)
FLNGEVIRL

SEQ ID NO: 5168 - protein, 9 aa, Artificial Sequence
  Translation initiation factor eIF-2B subunit delta (300-308)
FLNKEITSV

SEQ ID NO: 5169 - protein, 9 aa, Artificial Sequence
  Ubiquitin-associated protein 2-like (434-442)
FLQEKSPAV

SEQ ID NO: 5170 - protein, 10 aa, Artificial Sequence
  DNA dC-dU-editing enzyme APOBEC-3B (104-113)
FLQENTHVRL

SEQ ID NO: 5171 - protein, 9 aa, Artificial Sequence
  Glutathione S-transferase A4 (87-95)
FLQEYTVKL

SEQ ID NO: 5172 - protein, 9 aa, Artificial Sequence
  Proteasome activator complex subunit 4 (673-681)
FLQPELVKL

SEQ ID NO: 5173 - protein, 9 aa, Artificial Sequence
  cAMP-dependent protein kinase type I-alpha regulatory subunit (49-57)
FLREYFERL

SEQ ID NO: 5174 - protein, 11 aa, Artificial Sequence
  6-phosphofructo-2-kinase/fructose-2,6-bisphosphatase 4 (83-93)
FLSEEGGHVAV

SEQ ID NO: 5175 - protein, 10 aa, Artificial Sequence
  DNA dC-dU-editing enzyme APOBEC-3B (107-116)
FLSEHPNVTL

SEQ ID NO: 5176 - protein, 11 aa, Artificial Sequence
  Lysine-tRNA ligase (585-595)
FLTDSNNIKEV

SEQ ID NO: 5177 - protein, 9 aa, Artificial Sequence
  Calcium and integrin-binding protein 1 (21-29)
FLTKQEILL

SEQ ID NO: 5178 - protein, 9 aa, Artificial Sequence
  Zinc transporter ZIP6 (435-443)
FLVEHVLTL

SEQ ID NO: 5179 - protein, 9 aa, Artificial Sequence
  DDB1- and CUL4-associated factor 15 (73-81)
FLYAGHIFL

SEQ ID NO: 5180 - protein, 9 aa, Artificial Sequence
  DNA topoisomerase 2-beta (701-709)
FLYDDNQRV

SEQ ID NO: 5181 - protein, 10 aa, Artificial Sequence
  Alpha-ketoglutarate-dependent dioxygenase FTO (206-215)
FMDPQKMPYL

SEQ ID NO: 5182 - protein, 10 aa, Artificial Sequence
  Serine/threonine-protein phosphatase 6 catalytic subunit (244-253)
FMFDEKLVTV

SEQ ID NO: 5183 - protein, 9 aa, Artificial Sequence
  U4/U6 small nuclear ribonucleoprotein Prp3 (195-203)
FMNDAIEKA

SEQ ID NO: 5184 - protein, 9 aa, Artificial Sequence
  Putative helicase MOV-10 (35-43)
FVDGLTFKV

SEQ ID NO: 5185 - protein, 10 aa, Artificial Sequence
  Ubiquitin carboxyl-terminal hydrolase 10 (604-613)
GIFGGHIRSV

SEQ ID NO: 5186 - protein, 11 aa, Artificial Sequence
  D13S824E locus (103-113)
GILTKELLHSV

SEQ ID NO: 5187 - protein, 9 aa, Artificial Sequence
  CAD protein (445-453)
GLADKVYFL

SEQ ID NO: 5188 - protein, 11 aa, Artificial Sequence
  Threonine-tRNA ligase, cytoplasmic (145-155)
GLADNTVIAKV

SEQ ID NO: 5189 - protein, 9 aa, Artificial Sequence
  Importin-4 (306-314)
GLAPHLEQI

SEQ ID NO: 5190 - protein, 9 aa, Artificial Sequence
  Filamin-B (1451-1459)
GLAPLEVRV

SEQ ID NO: 5191 - protein, 10 aa, Artificial Sequence
  Putative helicase MOV-10 (451-460)
GLDDIKDLKV

SEQ ID NO: 5192 - protein, 9 aa, Artificial Sequence
  Probable helicase with zinc finger domain (341-349)
GLDHYVYKV

SEQ ID NO: 5193 - protein, 10 aa, Artificial Sequence
  Rho GTPase-activating protein 12 (126-135)
GLDIDGIYRV

SEQ ID NO: 5194 - protein, 10 aa, Artificial Sequence
  Proline-rich protein 12 (188-197)
GLDPNKPPEL

SEQ ID NO: 5195 - protein, 10 aa, Artificial Sequence
  WD repeat-containing protein 70 (189-198)
GLDPSGARLV

SEQ ID NO: 5196 - protein, 9 aa, Artificial Sequence
  Hexokinase-1 (818-826)
GLDRLNVTV

SEQ ID NO: 5197 - protein, 9 aa, Artificial Sequence
  Cleavage stimulation factor subunit 3 (220-228)
GLDRNAPSV

SEQ ID NO: 5198 - protein, 9 aa, Artificial Sequence
  Nischarin (1238-1246)
GLFDQHFRL

SEQ ID NO: 5199 - protein, 9 aa, Artificial Sequence
  Targeting protein for Xklp2 (12-20)
GLFQGKTPL

SEQ ID NO: 5200 - protein, 9 aa, Artificial Sequence
  Protein SPT2 homolog (93-101)
GLGPPGRSV

SEQ ID NO: 5201 - protein, 8 aa, Artificial Sequence
  Bardet-Biedl syndrome 1 protein (382-389)
GLGPTFKL

SEQ ID NO: 5202 - protein, 9 aa, Artificial Sequence
  Microtubule-actin cross-linking factor 1, isoforms 1/2/3/5 (195-203)
GLIDRQVTV

SEQ ID NO: 5203 - protein, 10 aa, Artificial Sequence
  Ubiquitin-like domain-containing CTD phosphatase 1 (225-234)
GLIDVKPLGV

SEQ ID NO: 5204 - protein, 9 aa, Artificial Sequence
  Programmed cell death protein 5 (91-99)
GLIEILKKV

SEQ ID NO: 5205 - protein, 11 aa, Artificial Sequence
  Na(+)/H(+) exchange regulatory cofactor NHE-RF1 (122-132)
GLLAGDRLVEV

SEQ ID NO: 5206 - protein, 9 aa, Artificial Sequence
  Trifunctional purine biosynthetic protein adenosine-3 (685-693)
GLLENIPRV

SEQ ID NO: 5207 - protein, 10 aa, Artificial Sequence
  Hom s 1 (11-20)
GLLETTVQKV

SEQ ID NO: 5208 - protein, 9 aa, Artificial Sequence
  Tumor necrosis factor receptor superfamily member 10B (362-370)
GLMDNEIKV

SEQ ID NO: 5209 - protein, 9 aa, Artificial Sequence
  Glucocorticoid modulatory element-binding protein 1 (312-320)
GLMDTVKKV

SEQ ID NO: 5210 - protein, 10 aa, Artificial Sequence
  Hydroxyacyl-coenzyme A dehydrogenase, mitochondrial (36-45)
GLMGAGIAQV

SEQ ID NO: 5211 - protein, 9 aa, Artificial Sequence
  Myocyte-specific enhancer factor 2A (27-35)
GLMKKAYEL

SEQ ID NO: 5212 - protein, 9 aa, Artificial Sequence
  Kinetochore protein NDC80 homolog (330-338)
GLNEEIARV

SEQ ID NO: 5213 - protein, 10 aa, Artificial Sequence
  Zinc finger protein 106 (808-817)
GLPRFGIEMV

SEQ ID NO: 5214 - protein, 9 aa, Artificial Sequence
  Signal recognition particle subunit SRP72 (170-178)
GLQEGTHEL

SEQ ID NO: 5215 - protein, 10 aa, Artificial Sequence
  Rho GTPase-activating protein 35 (1277-1286)
GLSTEGIYRV

SEQ ID NO: 5216 - protein, 10 aa, Artificial Sequence
  Probable RNA-binding protein 23 (209-218)
GLTGQRLLGV

SEQ ID NO: 5217 - protein, 9 aa, Artificial Sequence
  Anamorsin (27-35)
GLVDKLQAL

SEQ ID NO: 5218 - protein, 9 aa, Artificial Sequence
  Anaphase-promoting complex subunit 1 (56-64)
GLVGSLQEV

SEQ ID NO: 5219 - protein, 9 aa, Artificial Sequence
  Intraflagellar transport protein 172 homolog (410-418)
GLWEEAYRV

SEQ ID NO: 5220 - protein, 11 aa, Artificial Sequence
  Protein PRRC2B (1324-1334)
GLWGPEEEPHL

SEQ ID NO: 5221 - protein, 9 aa, Artificial Sequence
  TRPM8 channel-associated factor 1 (327-335)
GLWGPVHEL

SEQ ID NO: 5222 - protein, 10 aa, Artificial Sequence
  tRNA (adenine(58)-N(1))-methyltransferase non-catalytic subunit TRM6 (83-92)
GLYEFPLNKV

SEQ ID NO: 5223 - protein, 9 aa, Artificial Sequence
  Long-chain-fatty-acid-CoA ligase 3 (310-318)
GMAERIPEL

SEQ ID NO: 5224 - protein, 11 aa, Artificial Sequence
  DNA damage-binding protein 1 (56-66)
GMYGKIAVMEL

SEQ ID NO: 5225 - protein, 9 aa, Artificial Sequence
  ORM1-like protein 3 (59-67)
GMYIFLHTV

SEQ ID NO: 5226 - protein, 11 aa, Artificial Sequence
  WD repeat-containing protein 18 (99-109)
GVAESIHLWEV

SEQ ID NO: 5227 - protein, 11 aa, Artificial Sequence
  Putative eukaryotic translation initiation factor 2 subunit 3-like protein (277-287)
GVAGGSILKGV

SEQ ID NO: 5228 - protein, 9 aa, Artificial Sequence
  Chitinase domain-containing protein 1 (236-244)
HLAEALHQA

SEQ ID NO: 5229 - protein, 9 aa, Artificial Sequence
  E3 ubiquitin-protein ligase BRE1A (291-299)
HLAEVLERV

SEQ ID NO: 5230 - protein, 9 aa, Artificial Sequence
  Protein VPRBP (425-433)
HLAIKLEQV

SEQ ID NO: 5231 - protein, 9 aa, Artificial Sequence
  E3 ubiquitin-protein ligase TRIM22 (73-81)
HLANIVERV

SEQ ID NO: 5232 - protein, 9 aa, Artificial Sequence
  Tetratricopeptide repeat protein 17 (671-679)
HLDATKLLL

SEQ ID NO: 5233 - protein, 9 aa, Artificial Sequence
  Ninein (404-412)
HLLERVDQV

SEQ ID NO: 5234 - protein, 9 aa, Artificial Sequence
  Golgin subfamily A member 4 (1695-1703)
HLSELNTKL

SEQ ID NO: 5235 - protein, 9 aa, Artificial Sequence
  Lysine-tRNA ligase (148-156)
HLTDITLKV

SEQ ID NO: 5236 - protein, 9 aa, Artificial Sequence
  Multiple C2 and transmembrane domain-containing protein 1 (245-253)
HLWRGIVSI

SEQ ID NO: 5237 - protein, 9 aa, Artificial Sequence
  Nucleoside diphosphate-linked moiety X motif 19 (348-356)
HLYDIHVTV

SEQ ID NO: 5238 - protein, 9 aa, Artificial Sequence
  Probable helicase senataxin (435-443)
HLYSEVKEV

SEQ ID NO: 5239 - protein, 10 aa, Artificial Sequence
  Folliculin-interacting protein 1 (827-836)
IIADMDKWTV

SEQ ID NO: 5240 - protein, 11 aa, Artificial Sequence
  Cofilin-1 (47-57)
IILEEGKEILV

SEQ ID NO: 5241 - protein, 9 aa, Artificial Sequence
  Ras GTPase-activating-like protein IQGAP1 (1071-1079)
ILAPVVKEI

SEQ ID NO: 5242 - protein, 9 aa, Artificial Sequence
  26S proteasome non-ATPase regulatory subunit 1 (736-744)
ILDAGGHNV

SEQ ID NO: 5243 - protein, 11 aa, Artificial Sequence
  26S proteasome non-ATPase regulatory subunit 1 (736-746)
ILDAGGHNVTI

SEQ ID NO: 5244 - protein, 9 aa, Artificial Sequence
  F-box only protein 8 (162-170)
ILDDSPKEI

SEQ ID NO: 5245 - protein, 11 aa, Artificial Sequence
  Melanoma inhibitory activity protein 3 (156-166)
ILDDTAKNLRV

SEQ ID NO: 5246 - protein, 9 aa, Artificial Sequence
  IQ domain-containing protein D (55-63)
ILDEAIYKV

SEQ ID NO: 5247 - protein, 9 aa, Artificial Sequence
  Axin-1 (508-516)
ILDEHVQRV

SEQ ID NO: 5248 - protein, 11 aa, Artificial Sequence
  Dihydroxyacetone phosphate acyltransferase (106-116)
ILDEMSHKLRL

SEQ ID NO: 5249 - protein, 9 aa, Artificial Sequence
  Protein DBF4 homolog A (461-469)
ILDISEHTL

SEQ ID NO: 5250 - protein, 9 aa, Artificial Sequence
  F-box only protein 25 (65-73)
ILDKIVQKV

SEQ ID NO: 5251 - protein, 9 aa, Artificial Sequence
  Hermansky-Pudlak syndrome 5 protein (446-454)
ILDSGIYRI

SEQ ID NO: 5252 - protein, 10 aa, Artificial Sequence
  Cofilin-1 (48-57)
ILEEGKEILV

SEQ ID NO: 5253 - protein, 9 aa, Artificial Sequence
  Heat shock protein HSP 90-alpha (394-402)
ILEKKVEKV

SEQ ID NO: 5254 - protein, 9 aa, Artificial Sequence
  Guanine nucleotide-binding protein subunit beta-5 (320-328)
ILFGHENRV

SEQ ID NO: 5255 - protein, 9 aa, Artificial Sequence
  Cytosolic phospholipase A2 (399-407)
ILFNRVLGV

SEQ ID NO: 5256 - protein, 9 aa, Artificial Sequence
  60S acidic ribosomal protein P1 (15-23)
ILHDDEVTV

SEQ ID NO: 5257 - protein, 9 aa, Artificial Sequence
  ATP-binding cassette sub-family B member 7, mitochondrial (22-30)
ILIRPLVSV

SEQ ID NO: 5258 - protein, 11 aa, Artificial Sequence
  Dual specificity mitogen-activated protein kinase kinase 7 (249-259)
ILLDERGQIKL

SEQ ID NO: 5259 - protein, 10 aa, Artificial Sequence
  Lon protease homolog 2, peroxisomal (293-302)
ILLDNDHYAM

SEQ ID NO: 5260 - protein, 9 aa, Artificial Sequence
  Protein virilizer homolog (532-540)
ILLDQTVRV

SEQ ID NO: 5261 - protein, 9 aa, Artificial Sequence
  Histone-lysine N-methyltransferase SETD1A (58-66)
ILLEHNYAL

SEQ ID NO: 5262 - protein, 11 aa, Artificial Sequence
  Beta-adrenergic receptor kinase 1 (32-42)
ILLPEPSIRSV

SEQ ID NO: 5263 - protein, 9 aa, Artificial Sequence
  Endosomal/lysomomal potassium channel TMEM175 (218-226)
ILLPYVSKV

SEQ ID NO: 5264 - protein, 11 aa, Artificial Sequence
  Serine/threonine-protein kinase TAO2 (157-167)
ILLSEPGLVKL

SEQ ID NO: 5265 - protein, 11 aa, Artificial Sequence
  60S ribosomal protein L19 (118-128)
ILMEHIHKLKA

SEQ ID NO: 5266 - protein, 9 aa, Artificial Sequence
  Pre-mRNA-splicing factor ATP-dependent RNA helicase DHX15 (271-279)
ILMGVLKEV

SEQ ID NO: 5267 - protein, 9 aa, Artificial Sequence
  Cohesin subunit SA-2 (794-802)
ILMIFSHQI

SEQ ID NO: 5268 - protein, 9 aa, Artificial Sequence
  Epidermal growth factor receptor substrate 15 (67-75)
ILNKQEFFV

SEQ ID NO: 5269 - protein, 9 aa, Artificial Sequence
  Cell division control protein 6 homolog (354-362)
ILQDRLNQV

SEQ ID NO: 5270 - protein, 9 aa, Artificial Sequence
  AT-rich interactive domain-containing protein 4B (796-804)
ILQEKLQEI

SEQ ID NO: 5271 - protein, 9 aa, Artificial Sequence
  Transcription activator BRG1 (366-374)
ILQEREYRL

SEQ ID NO: 5272 - protein, 9 aa, Artificial Sequence
  Putative eukaryotic translation initiation factor 2 subunit 3-like protein (187-195)
ILQNKIDLV

SEQ ID NO: 5273 - protein, 9 aa, Artificial Sequence
  Ankyrin repeat and SOCS box protein 3 (486-494)
ILQQHIATV

SEQ ID NO: 5274 - protein, 9 aa, Artificial Sequence
  Poly (ADP-ribose) polymerase 1 (712-720)
ILSEVQQAV

SEQ ID NO: 5275 - protein, 9 aa, Artificial Sequence
  Ribonucleases P/MRP protein subunit POP1 (442-450)
ILTEAIKAA

SEQ ID NO: 5276 - protein, 9 aa, Artificial Sequence
  Translin-associated protein X (86-94)
ILTESEIKL

SEQ ID NO: 5277 - protein, 9 aa, Artificial Sequence
  Phosphotriesterase-related protein (316-324)
ILTNVVPKM

SEQ ID NO: 5278 - protein, 9 aa, Artificial Sequence
  T-complex protein 1 subunit eta (186-194)
ILYDKLEKI

SEQ ID NO: 5279 - protein, 9 aa, Artificial Sequence
  Methionine adenosyltransferase 2 subunit beta (184-192)
ILYGEVEKL

SEQ ID NO: 5280 - protein, 9 aa, Artificial Sequence
  Chromosome transmission fidelity protein 8 homolog (58-66)
ILYGKIIHL

SEQ ID NO: 5281 - protein, 11 aa, Artificial Sequence
  Catenin alpha-1 (549-559)
IMAQLPQEQKA

SEQ ID NO: 5282 - protein, 9 aa, Artificial Sequence
  Ras GTPase-activating-like protein IQGAP1 (1079-1087)
IMDDKSLNI

SEQ ID NO: 5283 - protein, 9 aa, Artificial Sequence
  Staphylococcal nuclease domain-containing protein 1 (665-673)
ITDDLHFYV

SEQ ID NO: 5284 - protein, 9 aa, Artificial Sequence
  Splicing factor 3A subunit 1 (52-60)
IVDKTASFV

SEQ ID NO: 5285 - protein, 11 aa, Artificial Sequence
  Probable JmjC domain-containing histone demethylation protein 2C (2276-2286)
IVLPAGALHQV

SEQ ID NO: 5286 - protein, 9 aa, Artificial Sequence
  Aurora kinase B (242-250)
KIADFGWSV

SEQ ID NO: 5287 - protein, 10 aa, Artificial Sequence
  DNA topoisomerase 2-alpha (83-92)
KIFDEILVNA

SEQ ID NO: 5288 - protein, 10 aa, Artificial Sequence
  Vam6/Vps39-like protein (471-480)
KIFTEDLPEV

SEQ ID NO: 5289 - protein, 10 aa, Artificial Sequence
  B-Raf serine/threonine-protein (638-647)
KIGDFGLATV

SEQ ID NO: 5290 - protein, 9 aa, Artificial Sequence
  Kelch-like protein 13 (131-139)
KIIDFIYTA

SEQ ID NO: 5291 - protein, 9 aa, Artificial Sequence
  Interleukin-6 receptor subunit beta (362-370)
KILDYEVTL

SEQ ID NO: 5292 - protein, 9 aa, Artificial Sequence
  Ankyrin repeat domain-containing protein 17 (748-756)
KILEELQKV

SEQ ID NO: 5293 - protein, 9 aa, Artificial Sequence
  Protein IWS1 homolog (639-647)
KILQELPSV

SEQ ID NO: 5294 - protein, 9 aa, Artificial Sequence
  G2/M phase-specific E3 ubiquitin-protein ligase (105-113)
KILSELFTV

SEQ ID NO: 5295 - protein, 9 aa, Artificial Sequence
  Adenomatous polyposis coli protein (1645-1653)
KIMDQVQQA

SEQ ID NO: 5296 - protein, 11 aa, Artificial Sequence
  Flotillin-2 (57-67)
KIMTEKELLAV

SEQ ID NO: 5297 - protein, 9 aa, Artificial Sequence
  Calpastatin (416-424)
KLAAAISEV

SEQ ID NO: 5298 - protein, 11 aa, Artificial Sequence
  Transitional endoplasmic reticulum ATPase (17-27)
KLADDVDLEQV

SEQ ID NO: 5299 - protein, 10 aa, Artificial Sequence
  Cyclin-dependent kinase 9 (164-173)
KLADFGLARA

SEQ ID NO: 5300 - protein, 10 aa, Artificial Sequence
  E3 ubiquitin-protein ligase listerin (404-413)
KLADISINYV

SEQ ID NO: 5301 - protein, 9 aa, Artificial Sequence
  Guanosine-3',5'-bis(diphosphate) 3'-pyrophosphohydrolase MESH1 (119-127)
KLADKLYNL

SEQ ID NO: 5302 - protein, 9 aa, Artificial Sequence
  Protein PRR14L (1063-1071)
KLAEGVLDV

SEQ ID NO: 5303 - protein, 9 aa, Artificial Sequence
  MAP kinase-activated protein kinase 5 (452-460)
KLAEIVKQV

SEQ ID NO: 5304 - protein, 9 aa, Artificial Sequence
  Nck-associated protein 1 (12-20)
KLAEKLTIL

SEQ ID NO: 5305 - protein, 10 aa, Artificial Sequence
  Nuclear poreoprotein p62 (435-444)
KLAENIDAQL

SEQ ID NO: 5306 - protein, 9 aa, Artificial Sequence
  FACT complex subunit SPT16 (216-224)
KLAESVEKA

SEQ ID NO: 5307 - protein, 9 aa, Artificial Sequence
  Transcription factor BTF3 (54-62)
KLAKLQAQV

SEQ ID NO: 5308 - protein, 9 aa, Artificial Sequence
  DNA excision repair protein ERCC-6-like (655-663)
KLDEHIAYL

SEQ ID NO: 5309 - protein, 11 aa, Artificial Sequence
  DNA topoisomerase 2-alpha (278-288)
KLDETGNSLKV

SEQ ID NO: 5310 - protein, 11 aa, Artificial Sequence
  Kelch repeat and BTB domain-containing protein 4 (508-518)
KLDPATSAVTV

SEQ ID NO: 5311 - protein, 9 aa, Artificial Sequence
  N-acetylneuraminate lyase (77-85)
KLDQVIIHV

SEQ ID NO: 5312 - protein, 9 aa, Artificial Sequence
  DENN domain-containing protein 4C (705-713)
KLFDRPQEL

SEQ ID NO: 5313 - protein, 11 aa, Artificial Sequence
  DENN domain-containing protein 4C (705-715)
KLFDRPQELKL

SEQ ID NO: 5314 - protein, 9 aa, Artificial Sequence
  Fatty acyl-CoA reductase 2 (63-71)
KLFEKVKEV

SEQ ID NO: 5315 - protein, 9 aa, Artificial Sequence
  Putative homeodomain transcription factor 2 (586-594)
KLFGHLTSA

SEQ ID NO: 5316 - protein, 9 aa, Artificial Sequence
  28S ribosomal protein S33, mitochondrial (35-43)
KLFSELPLA

SEQ ID NO: 5317 - protein, 9 aa, Artificial Sequence
  Hom s 1 (129-137)
KLGLKPLEV

SEQ ID NO: 5318 - protein, 9 aa, Artificial Sequence
  AP-1 complex subunit beta-1 (147-155)
KLHDINAQL

SEQ ID NO: 5319 - protein, 10 aa, Artificial Sequence
  Guanine nucleotide-binding protein subunit beta-5 (32-41)
KLHDVELHQV

SEQ ID NO: 5320 - protein, 9 aa, Artificial Sequence
  RNA-binding protein 4B (59-67)
KLHGVNINV

SEQ ID NO: 5321 - protein, 10 aa, Artificial Sequence
  Zinc finger protein 143 (59-68)
KLIDGQVIQL

SEQ ID NO: 5322 - protein, 9 aa, Artificial Sequence
  cAMP-responsive element modulator (103-111)
KLIEELETL

SEQ ID NO: 5323 - protein, 10 aa, Artificial Sequence
  Elongation factor 2 (314-323)
KLIEKLDIKL

SEQ ID NO: 5324 - protein, 9 aa, Artificial Sequence
  WD repeat-containing protein 43 (416-424)
KLILLITQV

SEQ ID NO: 5325 - protein, 9 aa, Artificial Sequence
  CTD small phosphatase-like protein 2 (434-442)
KLIPFLEKL

SEQ ID NO: 5326 - protein, 9 aa, Artificial Sequence
  Ras-related GTP-binding protein C (235-243)
KLIPQLPTL

SEQ ID NO: 5327 - protein, 9 aa, Artificial Sequence
  DNA repair and recombination protein RAD54B (649-657)
KLLAVIHEL

SEQ ID NO: 5328 - protein, 13 aa, Artificial Sequence
  HIV Tat-specific factor 1 (199-211)
KLLDEDEIRGYKL

SEQ ID NO: 5329 - protein, 11 aa, Artificial Sequence
  Negative elongation factor A (255-265)
KLLDISELDMV

SEQ ID NO: 5330 - protein, 9 aa, Artificial Sequence
  Integrator complex subunit 4 (341-349)
KLLDLMPRL

SEQ ID NO: 5331 - protein, 11 aa, Artificial Sequence
  Rho-associated protein kinase 1 (1093-1103)
KLLDLSDSTSV

SEQ ID NO: 5332 - protein, 9 aa, Artificial Sequence
  E3 ISG15-protein ligase HERC5 (795-803)
KLLDQMPSL

SEQ ID NO: 5333 - protein, 9 aa, Artificial Sequence
  T-complex protein 1 subunit eta (55-63)
KLLDVVHPA

SEQ ID NO: 5334 - protein, 9 aa, Artificial Sequence
  Renal cancer differentiation gene 1 protein (69-77)
KLLEATSAV

SEQ ID NO: 5335 - protein, 10 aa, Artificial Sequence
  E3 ubiquitin-protein ligase UBR4 (335-344)
KLLEEQGIFL

SEQ ID NO: 5336 - protein, 12 aa, Artificial Sequence
  Prolyl 4-hydroxylase subunit alpha-1 (230-241)
KLLELDPEHQRA

SEQ ID NO: 5337 - protein, 10 aa, Artificial Sequence
  Archaemetzincin-2 (125-134)
KLLEPVPVSV

SEQ ID NO: 5338 - protein, 9 aa, Artificial Sequence
  EH domain-binding protein 1 (684-692)
KLLEVQPQV

SEQ ID NO: 5339 - protein, 9 aa, Artificial Sequence
  Hyaluronan mediated motility receptor (233-241)
KLLEYIEEI

SEQ ID NO: 5340 - protein, 9 aa, Artificial Sequence
  Conserved oligomeric Golgi complex subunit 5 (336-344)
KLMDHIYAV

SEQ ID NO: 5341 - protein, 10 aa, Artificial Sequence
  Proliferating cell nuclear antigen (117-126)
KLMDLDVEQL

SEQ ID NO: 5342 - protein, 9 aa, Artificial Sequence
  Dolichyl-diphosphooligosaccharide-proteinosyltransferase subunit STT3A (289-297)
KLNPQQFEV

SEQ ID NO: 5343 - protein, 9 aa, Artificial Sequence
  Ribosomal L1 domain-containing protein 1 (242-250)
KLPEKWESV

SEQ ID NO: 5344 - protein, 9 aa, Artificial Sequence
  Regulator of G-protein signaling 10 (129-137)
KLQDQIFNL

SEQ ID NO: 5345 - protein, 9 aa, Artificial Sequence
  Nesprin-2 (2292-2300)
KLQELENRL

SEQ ID NO: 5346 - protein, 9 aa, Artificial Sequence
  Signal transducer and activator of transcription 1-alpha/beta (350-358)
KLQELNYNL

SEQ ID NO: 5347 - protein, 9 aa, Artificial Sequence
  Protein Jade-2 (282-290)
KLQEQIFHL

SEQ ID NO: 5348 - protein, 9 aa, Artificial Sequence
  DNA-directed RNA polymerase II subunit RPB3 (255-263)
KLSDLQTQL

SEQ ID NO: 5349 - protein, 9 aa, Artificial Sequence
  Probable tRNA N6-adenosine threonylcarbamoyltransferase (189-197)
KLVELPYTV

SEQ ID NO: 5350 - protein, 9 aa, Artificial Sequence
  Electron transfer flavoprotein subunit beta (147-155)
KLVKEVIAV

SEQ ID NO: 5351 - protein, 9 aa, Artificial Sequence
  Protein Mis18-alpha (218-226)
KLWEAESKL

SEQ ID NO: 5352 - protein, 9 aa, Artificial Sequence
  Phosphatidylinositol 4-kinase beta (788-796)
KLYDGFQYL

SEQ ID NO: 5353 - protein, 9 aa, Artificial Sequence
  Cytochrome P450 20A1 (274-282)
KLYEEINQV

SEQ ID NO: 5354 - protein, 9 aa, Artificial Sequence
  Delta(24)-sterol reductase (287-295)
KLYEQHHVV

SEQ ID NO: 5355 - protein, 10 aa, Artificial Sequence
  Ectopic P granules protein 5 homolog (225-234)
KLYPQLPAEI

SEQ ID NO: 5356 - protein, 9 aa, Artificial Sequence
  CCAAT/enhancer-binding protein zeta (211-219)
KLYQHEINL

SEQ ID NO: 5357 - protein, 13 aa, Artificial Sequence
  Stathmin (95-107)
KMAEEKLTHKMEA

SEQ ID NO: 5358 - protein, 9 aa, Artificial Sequence
  MORF4 family-associated protein 1-like 1 (109-117)
KMAEMLVEL

SEQ ID NO: 5359 - protein, 9 aa, Artificial Sequence
  ATP-binding cassette sub-family F member 3 (459-467)
KMLEKLPEL

SEQ ID NO: 5360 - protein, 9 aa, Artificial Sequence
  Nodal modulator 3 (261-269)
KMMDVTVTI

SEQ ID NO: 5361 - protein, 9 aa, Artificial Sequence
  Proteasome subunit beta type-2 (37-45)
KMSEKILLL

SEQ ID NO: 5362 - protein, 10 aa, Artificial Sequence
  cAMP-dependent protein kinase type I-beta regulatory subunit (244-253)
KMYEEFLSKV

SEQ ID NO: 5363 - protein, 9 aa, Artificial Sequence
  Rap1 GTPase-GDP dissociation stimulator 1 (67-75)
KVANIIAEV

SEQ ID NO: 5364 - protein, 9 aa, Artificial Sequence
  Myosin light polypeptide 6 (69-77)
KVLDFEHFL

SEQ ID NO: 5365 - protein, 9 aa, Artificial Sequence
  Probable E3 ubiquitin-protein ligase HERC4 (595-603)
KVLEILHRV

SEQ ID NO: 5366 - protein, 11 aa, Artificial Sequence
  Protein SON (298-308)
KVLEPSETLVV

SEQ ID NO: 5367 - protein, 9 aa, Artificial Sequence
  Proteasome activator complex subunit 2 (145-153)
KVLERVNAV

SEQ ID NO: 5368 - protein, 9 aa, Artificial Sequence
  CCR4-NOT transcription complex subunit 1 (128-136)
KVLGIVVGV

SEQ ID NO: 5369 - protein, 9 aa, Artificial Sequence
  Amyloid beta A4 protein (9-17)
LLAAWTARA

SEQ ID NO: 5370 - protein, 9 aa, Artificial Sequence
  DNA fragmentation factor subunit beta (69-77)
LLADLLHNV

SEQ ID NO: 5371 - protein, 9 aa, Artificial Sequence
  CREB-binding protein (653-661)
LLAEKIYKI

SEQ ID NO: 5372 - protein, 9 aa, Artificial Sequence
  Nuclear autoantigenic sperm protein (243-251)
LLAETHYQL

SEQ ID NO: 5373 - protein, 11 aa, Artificial Sequence
  SCAN domain-containing protein 1 (194-204)
LLAILPEAARA

SEQ ID NO: 5374 - protein, 9 aa, Artificial Sequence
  Cyclin-dependent kinase inhibitor 1C (103-111)
LLAPRPVAV

SEQ ID NO: 5375 - protein, 9 aa, Artificial Sequence
  Protein quaking (40-48)
LLDEEISRV

SEQ ID NO: 5376 - protein, 8 aa, Artificial Sequence
  T-complex protein 1 subunit beta (219-226)
LLDKKIGV

SEQ ID NO: 5377 - protein, 11 aa, Artificial Sequence
  ERI1 exoribonuclease 3 (155-165)
LLDPNVKSIFV

SEQ ID NO: 5378 - protein, 9 aa, Artificial Sequence
  Talin-1 (1761-1769)
LLDQTKTLA

SEQ ID NO: 5379 - protein, 9 aa, Artificial Sequence
  Cyclin-I (72-80)
LLDRFLATV

SEQ ID NO: 5380 - protein, 9 aa, Artificial Sequence
  Tight junction protein ZO-2 (821-829)
LLDVTPKAV

SEQ ID NO: 5381 - protein, 9 aa, Artificial Sequence
  Exocyst complex component 4 (7-15)
LLFDKFNAV

SEQ ID NO: 5382 - protein, 9 aa, Artificial Sequence
  Heterogeneous nuclear ribonucleoprotein M (229-237)
LLFDRPMHV

SEQ ID NO: 5383 - protein, 10 aa, Artificial Sequence
  DNA-directed RNA polymerase II subunit RPB11-b1 (11-20)
LLFEGEKITI

SEQ ID NO: 5384 - protein, 9 aa, Artificial Sequence
  Conserved oligomeric Golgi complex subunit 4 (51-59)
LLFEGIARI

SEQ ID NO: 5385 - protein, 9 aa, Artificial Sequence
  Cip1-interacting zinc finger protein (83-91)
LLGPPPVGV

SEQ ID NO: 5386 - protein, 8 aa, Artificial Sequence
  Neuferricin (59-66)
LLGRVYDV

SEQ ID NO: 5387 - protein, 11 aa, Artificial Sequence
  Cyclin-dependent kinase 1 (134-144)
LLIDDKGTIKL

SEQ ID NO: 5388 - protein, 9 aa, Artificial Sequence
  Nuclear pore complex protein Nup205 (248-256)
LLIGHLERV

SEQ ID NO: 5389 - protein, 9 aa, Artificial Sequence
  RCC1 and BTB domain-containing protein 1 (125-133)
LLIKQVVEV

SEQ ID NO: 5390 - protein, 12 aa, Artificial Sequence
  Histone H2B type 2-F (101-112)
LLLPGELAKHAV

SEQ ID NO: 5391 - protein, 9 aa, Artificial Sequence
  Eukaryotic translation initiation factor 3 subunit H (242-250)
LLMDRVDEM

SEQ ID NO: 5392 - protein, 9 aa, Artificial Sequence
  CDK5 regulatory subunit-associated protein 2 (1394-1402)
LLMEHIQEI

SEQ ID NO: 5393 - protein, 9 aa, Artificial Sequence
  Zinc finger SWIM domain-containing protein 1 (234-242)
LLNDRIWLA

SEQ ID NO: 5394 - protein, 9 aa, Artificial Sequence
  DNA-directed RNA polymerase II subunit RPB4 (32-40)
LLNSEVHML

SEQ ID NO: 5395 - protein, 9 aa, Artificial Sequence
  Rho guanine nucleotide exchange factor 2 (627-635)
LLQDAIREV

SEQ ID NO: 5396 - protein, 9 aa, Artificial Sequence
  Vam6/Vps39-like protein (218-226)
LLQDKQFEL

SEQ ID NO: 5397 - protein, 9 aa, Artificial Sequence
  E3 ubiquitin-protein ligase TRIM37 (221-229)
LLQEVEHQL

SEQ ID NO: 5398 - protein, 9 aa, Artificial Sequence
  DEP domain-containing protein 1A (20-28)
LLQPHLERV

SEQ ID NO: 5399 - protein, 9 aa, Artificial Sequence
  Small nuclear ribonucleoprotein Sm D1 (38-46)
LLVDVEPKV

SEQ ID NO: 5400 - protein, 10 aa, Artificial Sequence
  Lipopolysaccharide-responsive and beige-like anchor protein (407-416)
LLYDGKLSSA

SEQ ID NO: 5401 - protein, 11 aa, Artificial Sequence
  Electron transfer flavoprotein subunit alpha, mitochondrial (184-194)
LLYDLADQLHA

SEQ ID NO: 5402 - protein, 9 aa, Artificial Sequence
  Solute carrier family 43 member 3 (191-199)
LLYEKGISL

SEQ ID NO: 5403 - protein, 10 aa, Artificial Sequence
  Integrin alpha-4 (42-51)
LLYQGPHNTL

SEQ ID NO: 5404 - protein, 10 aa, Artificial Sequence
  Uridine-cytidine kinase-like 1 (470-479)
LMAEMGVHSV

SEQ ID NO: 5405 - protein, 9 aa, Artificial Sequence
  KH domain-containing, RNA-binding, signal transduction-associated protein 1 (243-251)
LMAHAMEEV

SEQ ID NO: 5406 - protein, 9 aa, Artificial Sequence
  Rho guanine nucleotide exchange factor 18 (267-275)
LMQTEVHHV

SEQ ID NO: 5407 - protein, 9 aa, Artificial Sequence
  Steroid receptor RNA activator 1 (183-191)
LMVDHVTEV

SEQ ID NO: 5408 - protein, 10 aa, Artificial Sequence
  Cytochrome c oxidase subunit 7C, mitochondrial (54-63)
LVVRHQLLKT

SEQ ID NO: 5409 - protein, 9 aa, Artificial Sequence
  EH domain-containing protein 1 (385-393)
MLANDIARL

SEQ ID NO: 5410 - protein, 9 aa, Artificial Sequence
  Ubiquitin carboxyl-terminal hydrolase 11 (568-576)
MLFGHPLLV

SEQ ID NO: 5411 - protein, 9 aa, Artificial Sequence
  Flotillin-1 (356-364)
MLLEKLPQV

SEQ ID NO: 5412 - protein, 9 aa, Artificial Sequence
  Breast cancer type 1 susceptibility protein (1657-1665)
MLNEHDFEV

SEQ ID NO: 5413 - protein, 9 aa, Artificial Sequence
  trim5alpha (75-83)
NIVEKLREV

SEQ ID NO: 5414 - protein, 9 aa, Artificial Sequence
  E3 ubiquitin-protein ligase TRIM22 (76-84)
NIVERVKEV

SEQ ID NO: 5415 - protein, 9 aa, Artificial Sequence
  Ral GTPase-activating protein subunit beta (190-198)
NLAEKLIGV

SEQ ID NO: 5416 - protein, 9 aa, Artificial Sequence
  F-box only protein 22 (24-32)
NLAEVVERV

SEQ ID NO: 5417 - protein, 9 aa, Artificial Sequence
  Glycerol-3-phosphate dehydrogenase, mitochondrial (146-154)
NLLEIAPHL

SEQ ID NO: 5418 - protein, 9 aa, Artificial Sequence
  Propionyl-CoA carboxylase beta chain, mitochondrial (27-35)
NMVDIIHSV

SEQ ID NO: 5419 - protein, 9 aa, Artificial Sequence
  Transcription elongation factor SPT5 (558-566)
NMYGKVVTV

SEQ ID NO: 5420 - protein, 10 aa, Artificial Sequence
  Utrophin (2315-2324)
NQWDGTQHGV

SEQ ID NO: 5421 - protein, 13 aa, Artificial Sequence
  Melanocyte protein PMEL (45-57)
NRQLYPEWTEAQR

SEQ ID NO: 5422 - protein, 9 aa, Artificial Sequence
  60S ribosomal protein L35 (20-28)
QLDDLKVEL

SEQ ID NO: 5423 - protein, 9 aa, Artificial Sequence
  SNARE-associated protein Snapin (39-47)
QLDSHVHAV

SEQ ID NO: 5424 - protein, 9 aa, Artificial Sequence
  Testis-expressed sequence 10 protein (575-583)
QLIDIIHTA

SEQ ID NO: 5425 - protein, 9 aa, Artificial Sequence
  SEC14-like protein 1 (559-567)
QLIDKVWQL

SEQ ID NO: 5426 - protein, 9 aa, Artificial Sequence
  Ethylmalonyl-CoA decarboxylase (79-87)
QLLEKVIEL

SEQ ID NO: 5427 - protein, 9 aa, Artificial Sequence
  HEAT repeat-containing protein 2 (843-851)
QLLQHVQAV

SEQ ID NO: 5428 - protein, 9 aa, Artificial Sequence
  60S ribosomal protein L6 (267-275)
QLQGYLRSV

SEQ ID NO: 5429 - protein, 9 aa, Artificial Sequence
  Mitochondrial dynamics protein MID51 (384-392)
QLTNVILHL

SEQ ID NO: 5430 - protein, 9 aa, Artificial Sequence
  Casein kinase I isoform delta (111-119)
QMISRIEYI

SEQ ID NO: 5431 - protein, 11 aa, Artificial Sequence
  Zinc finger protein 131 (113-123)
QMLEAIKALEV

SEQ ID NO: 5432 - protein, 9 aa, Artificial Sequence
  40S ribosomal protein S8 (77-85)
RIIDVVYNA

SEQ ID NO: 5433 - protein, 11 aa, Artificial Sequence
  CCR4-NOT transcription complex subunit 1 (459-469)
RLAEVGQYEQV

SEQ ID NO: 5434 - protein, 9 aa, Artificial Sequence
  DNA replication licensing factor MCM7 (164-172)
RLAQHITYV

SEQ ID NO: 5435 - protein, 9 aa, Artificial Sequence
  Vacuolar protein sorting-associated protein 53 homolog (74-82)
RLDDNIRTV

SEQ ID NO: 5436 - protein, 11 aa, Artificial Sequence
  Putative sodium-coupled neutral amino acid transporter 10 (413-423)
RLGEAEGLMKV

SEQ ID NO: 5437 - protein, 10 aa, Artificial Sequence
  Protein quaking (39-48)
RLLDEEISRV

SEQ ID NO: 5438 - protein, 9 aa, Artificial Sequence
  CLIP-associating protein 1 (367-375)
RLLDGAFKL

SEQ ID NO: 5439 - protein, 9 aa, Artificial Sequence
  KN motif and ankyrin repeat domain-containing protein 2 (654-662)
RLLDYVVNI

SEQ ID NO: 5440 - protein, 11 aa, Artificial Sequence
  Pyridoxal-dependent decarboxylase domain-containing protein 1 (630-640)
RLLEEGVLRQI

SEQ ID NO: 5441 - protein, 9 aa, Artificial Sequence
  Pinin (207-215)
RLLEQKVEL

SEQ ID NO: 5442 - protein, 9 aa, Artificial Sequence
  E3 ubiquitin-protein ligase RNF213 (4648-4656)
RLLQEQHQL

SEQ ID NO: 5443 - protein, 9 aa, Artificial Sequence
  V-type proton ATPase subunit H (382-390)
RLNEKNYEL

SEQ ID NO: 5444 - protein, 9 aa, Artificial Sequence
  Cytospin-A (639-647)
RLQDAIAKV

SEQ ID NO: 5445 - protein, 10 aa, Artificial Sequence
  Ubiquitin-conjugating enzyme E2 A (15-24)
RLQEDPPAGV

SEQ ID NO: 5446 - protein, 10 aa, Artificial Sequence
  Ubiquitin-conjugating enzyme E2 B (15-24)
RLQEDPPVGV

SEQ ID NO: 5447 - protein, 9 aa, Artificial Sequence
  Inhibitor of nuclear factor kappa-B kinase-interacting protein (38-46)
RLQEEINEV

SEQ ID NO: 5448 - protein, 9 aa, Artificial Sequence
  Double-strand-break repair protein rad21 homolog (450-458)
RLQESVMEA

SEQ ID NO: 5449 - protein, 10 aa, Artificial Sequence
  SHC SH2 domain-binding protein 1 (594-603)
RLSELGITQA

SEQ ID NO: 5450 - protein, 9 aa, Artificial Sequence
  PRA1 family protein 3 (178-186)
RLTDYISKV

SEQ ID NO: 5451 - protein, 9 aa, Artificial Sequence
  Eukaryotic translation initiation factor 3 subunit H (165-173)
RLTPKLMEV

SEQ ID NO: 5452 - protein, 11 aa, Artificial Sequence
  Proliferating cell nuclear antigen (5-15)
RLVQGSILKKV

SEQ ID NO: 5453 - protein, 9 aa, Artificial Sequence
  DEP domain-containing protein 1B (15-23)
RLWNETVEL

SEQ ID NO: 5454 - protein, 9 aa, Artificial Sequence
  DNA damage-binding protein 1 (134-142)
RLYDGLFKV

SEQ ID NO: 5455 - protein, 12 aa, Artificial Sequence
  ATP-binding cassette sub-family B member 10, mitochondrial (542-553)
RLYDPASGTISL

SEQ ID NO: 5456 - protein, 9 aa, Artificial Sequence
  Serine/threonine-protein kinase Kist (287-295)
RMFDGKFVV

SEQ ID NO: 5457 - protein, 10 aa, Artificial Sequence
  Serine/threonine-protein kinase Kist (287-296)
RMFDGKFVVA

SEQ ID NO: 5458 - protein, 12 aa, Artificial Sequence
  Melanocyte protein PMEL (46-57)
RQLYPEWTEAQR

SEQ ID NO: 5459 - protein, 14 aa, Artificial Sequence
  Melanocyte protein PMEL (46-59)
RQLYPEWTEAQRLD

SEQ ID NO: 5460 - protein, 18 aa, Artificial Sequence
  Melanocyte protein PMEL (40-57)
RTKAWNRQLYPEWTEAQR

SEQ ID NO: 5461 - protein, 11 aa, Artificial Sequence
  Aurora kinase B (360-370)
RVLPPSALQSV

SEQ ID NO: 5462 - protein, 9 aa, Artificial Sequence
  SHC-transforming protein 1 (255-263)
RVPPPPQSV

SEQ ID NO: 5463 - protein, 9 aa, Artificial Sequence
  Serine/threonine-protein phosphatase PP1-gamma catalytic subunit (7-15)
SIIQRLLEV

SEQ ID NO: 5464 - protein, 9 aa, Artificial Sequence
  Eukaryotic translation initiation factor 2 subunit 1 (110-118)
SILRHVAEV

SEQ ID NO: 5465 - protein, 9 aa, Artificial Sequence
  Anaphase-promoting complex subunit 7 (276-284)
SLADLYFRA

SEQ ID NO: 5466 - protein, 9 aa, Artificial Sequence
  TATA-binding protein-associated factor 172 (784-792)
SLADVHIEV

SEQ ID NO: 5467 - protein, 9 aa, Artificial Sequence
  2'-5'-oligoadenylate synthase 3 (247-255)
SLAEGLRTV

SEQ ID NO: 5468 - protein, 9 aa, Artificial Sequence
  LisH domain-containing protein ARMC9 (400-408)
SLAEGRLYL

SEQ ID NO: 5469 - protein, 9 aa, Artificial Sequence
  Ankyrin repeat and SOCS box protein 6 (353-361)
SLAEKIQAL

SEQ ID NO: 5470 - protein, 10 aa, Artificial Sequence
  DNA polymerase epsilon catalytic subunit A (943-952)
SLAELKGFEV

SEQ ID NO: 5471 - protein, 9 aa, Artificial Sequence
  Sestrin-1 (129-137)
SLAELVHAV

SEQ ID NO: 5472 - protein, 10 aa, Artificial Sequence
  V-type proton ATPase catalytic subunit A (500-509)
SLAETDKITL

SEQ ID NO: 5473 - protein, 9 aa, Artificial Sequence
  Trinucleotide repeat-containing gene 6A protein (198-206)
SLAHELWKV

SEQ ID NO: 5474 - protein, 9 aa, Artificial Sequence
  TNFAIP3-interacting protein 2 (146-154)
SLANETHQL

SEQ ID NO: 5475 - protein, 9 aa, Artificial Sequence
  Phosphatidylinositol 3-kinase regulatory subunit gamma (63-71)
SLAQYNPKL

SEQ ID NO: 5476 - protein, 9 aa, Artificial Sequence
  Baculoviral IAP repeat-containing protein 6 (1230-1238)
SLASLLAKV

SEQ ID NO: 5477 - protein, 9 aa, Artificial Sequence
  TELO2-interacting protein 1 homolog (380-388)
SLATSLPRL

SEQ ID NO: 5478 - protein, 9 aa, Artificial Sequence
  Leucine-rich repeat and coiled-coil domain-containing protein 1 (37-45)
SLDSTLHAV

SEQ ID NO: 5479 - protein, 10 aa, Artificial Sequence
  Transmembrane emp24 domain-containing protein 9 (130-139)
SLFAGGMLRV

SEQ ID NO: 5480 - protein, 10 aa, Artificial Sequence
  F-box/LRR-repeat protein 5 (73-82)
SLFEKGLKNV

SEQ ID NO: 5481 - protein, 9 aa, Artificial Sequence
  Programmed cell death 6-interacting protein (103-111)
SLFGGSVKL

SEQ ID NO: 5482 - protein, 10 aa, Artificial Sequence
  Ribosome production factor 1 (265-274)
SLFPHNPQFI

SEQ ID NO: 5483 - protein, 9 aa, Artificial Sequence
  Exostosin-2 (478-486)
SLFRVITEV

SEQ ID NO: 5484 - protein, 8 aa, Artificial Sequence
  Bloom syndrome protein (853-860)
SLGKVFGV

SEQ ID NO: 5485 - protein, 9 aa, Artificial Sequence
  U1 small nuclear ribonucleoprotein C (24-32)
SLIDKTTAA

SEQ ID NO: 5486 - protein, 9 aa, Artificial Sequence
  AAC41999.1 (170-178)
SLIEKIPTA

SEQ ID NO: 5487 - protein, 9 aa, Artificial Sequence
  Transcription factor RFX3 (374-382)
SLIEKLWQT

SEQ ID NO: 5488 - protein, 9 aa, Artificial Sequence
  Importin subunit alpha-1 (490-498)
SLIEKYFSV

SEQ ID NO: 5489 - protein, 9 aa, Artificial Sequence
  Ubiquitin carboxyl-terminal hydrolase 34 (1442-1450)
SLIQRLMSV

SEQ ID NO: 5490 - protein, 9 aa, Artificial Sequence
  Polymerase I and transcript release factor (56-64)
SLLDKIIGA

SEQ ID NO: 5491 - protein, 10 aa, Artificial Sequence
  Rho guanine nucleotide exchange factor 18 (642-651)
SLLEKQQIYL

SEQ ID NO: 5492 - protein, 9 aa, Artificial Sequence
  Mediator of RNA polymerase II transcription subunit 12 (1224-1232)
SLLENIAKA

SEQ ID NO: 5493 - protein, 9 aa, Artificial Sequence
  Heterogeneous nuclear ribonucleoprotein C-like 1 (196-204)
SLLENLEKI

SEQ ID NO: 5494 - protein, 9 aa, Artificial Sequence
  Serine/threonine-protein kinase ATR (549-557)
SLLESVQKL

SEQ ID NO: 5495 - protein, 11 aa, Artificial Sequence
  Neurochondrin (337-347)
SLLKEPQKVQL

SEQ ID NO: 5496 - protein, 10 aa, Artificial Sequence
  Adrenocortical dysplasia protein homolog (124-133)
SLLPTEQPRL

SEQ ID NO: 5497 - protein, 9 aa, Artificial Sequence
  Ran GTPase-activating protein 1 (579-587)
SLLQTLYKV

SEQ ID NO: 5498 - protein, 9 aa, Artificial Sequence
  Arfaptin-2 (71-79)
SLLQTQHAL

SEQ ID NO: 5499 - protein, 10 aa, Artificial Sequence
  Pericentrin (1754-1763)
SLMGPVVHEV

SEQ ID NO: 5500 - protein, 9 aa, Artificial Sequence
  Hermansky-Pudlak syndrome 4 protein (573-581)
SLNGLEVHL

SEQ ID NO: 5501 - protein, 9 aa, Artificial Sequence
  Choline/ethanolamine kinase (86-94)
SLPDHLPSV

SEQ ID NO: 5502 - protein, 9 aa, Artificial Sequence
  WD repeat-containing protein 3 (348-356)
SLQDEIQRV

SEQ ID NO: 5503 - protein, 9 aa, Artificial Sequence
  Peroxisomal membrane protein 4 (59-67)
SLQEKLWAI

SEQ ID NO: 5504 - protein, 9 aa, Artificial Sequence
  Dynactin subunit 1 (1169-1177)
SLSDTVEKL

SEQ ID NO: 5505 - protein, 9 aa, Artificial Sequence
  AP-3 complex subunit mu-1 (219-227)
SLSFMNPRL

SEQ ID NO: 5506 - protein, 9 aa, Artificial Sequence
  Alsin (755-763)
SLSSFLHGV

SEQ ID NO: 5507 - protein, 9 aa, Artificial Sequence
  Eukaryotic translation initiation factor 3 subunit F (301-309)
SLVNQVPKI

SEQ ID NO: 5508 - protein, 9 aa, Artificial Sequence
  FACT complex subunit SSRP1 (309-317)
SLYEMVSRV

SEQ ID NO: 5509 - protein, 9 aa, Artificial Sequence
  Mediator of RNA polymerase II transcription subunit 12 (1349-1357)
SLYSQVHQI

SEQ ID NO: 5510 - protein, 9 aa, Artificial Sequence
  RNA-binding protein 28 (53-61)
SMLEDVQRA

SEQ ID NO: 5511 - protein, 9 aa, Artificial Sequence
  Zinc finger MYM-type protein 3 (1346-1354)
SMLNRILAV

SEQ ID NO: 5512 - protein, 9 aa, Artificial Sequence
  RNA polymerase II-associated protein 1 (1333-1341)
SMLQKTWLL

SEQ ID NO: 5513 - protein, 9 aa, Artificial Sequence
  General transcription factor 3C polypeptide 5 (74-82)
SMYDKVLML

SEQ ID NO: 5514 - protein, 9 aa, Artificial Sequence
  EH domain-containing protein 4 (482-490)
SVLGKIWKL

SEQ ID NO: 5515 - protein, 9 aa, Artificial Sequence
  Huntingtin (111-119)
TLAAAVPKI

SEQ ID NO: 5516 - protein, 9 aa, Artificial Sequence
  Set1/Ash2 histone methyltransferase complex subunit ASH2 (512-520)
TLADVLYHV

SEQ ID NO: 5517 - protein, 10 aa, Artificial Sequence
  Non-POU domain-containing octamer-binding protein (31-40)
TLAEIAKVEL

SEQ ID NO: 5518 - protein, 9 aa, Artificial Sequence
  Ancient ubiquitous protein 1 (365-373)
TLAQRVKEV

SEQ ID NO: 5519 - protein, 9 aa, Artificial Sequence
  Pre-mRNA-processing factor 40 homolog A (170-178)
TLDAGNIKL

SEQ ID NO: 5520 - protein, 9 aa, Artificial Sequence
  Coiled-coil domain-containing protein 93 (524-532)
TLDDKKVYL

SEQ ID NO: 5521 - protein, 9 aa, Artificial Sequence
  Probable ATP-dependent RNA helicase DDX27 (87-95)
TLDEKIEKV

SEQ ID NO: 5522 - protein, 9 aa, Artificial Sequence
  Nuclear respiratory factor 1 (118-126)
TLDEYTTRV

SEQ ID NO: 5523 - protein, 9 aa, Artificial Sequence
  Fanconi anemia group D2 protein (847-855)
TLDITPHTV

SEQ ID NO: 5524 - protein, 9 aa, Artificial Sequence
  E3 ubiquitin-protein ligase UHRF1 (57-65)
TLFDYEVRL

SEQ ID NO: 5525 - protein, 9 aa, Artificial Sequence
  Staphylococcal nuclease domain-containing protein 1 (582-590)
TLFTKELVL

SEQ ID NO: 5526 - protein, 11 aa, Artificial Sequence
  Dynamin-2 (133-143)
TLIDLPGITKV

SEQ ID NO: 5527 - protein, 9 aa, Artificial Sequence
  Cyclic AMP-dependent transcription factor ATF-1 (254-262)
TLIEELKTL

SEQ ID NO: 5528 - protein, 10 aa, Artificial Sequence
  Cleavage and polyadenylation specificity factor subunit 1 (348-357)
TLITDGMRSV

SEQ ID NO: 5529 - protein, 9 aa, Artificial Sequence
  Negative elongation factor C/D (294-302)
TLLDRMVHL

SEQ ID NO: 5530 - protein, 10 aa, Artificial Sequence
  HEAT repeat-containing protein 5B (1620-1629)
TLLDSPYARV

SEQ ID NO: 5531 - protein, 10 aa, Artificial Sequence
  NmrA-like family domain-containing protein 1 (23-32)
TLLEDGTFKV

SEQ ID NO: 5532 - protein, 9 aa, Artificial Sequence
  Tetratricopeptide repeat protein 21B (311-319)
TLLERAFSL

SEQ ID NO: 5533 - protein, 9 aa, Artificial Sequence
  Cell division cycle protein 27 homolog (544-552)
TLLGHEFVL

SEQ ID NO: 5534 - protein, 9 aa, Artificial Sequence
  Coatomer subunit alpha (88-96)
TLLGHLDYI

SEQ ID NO: 5535 - protein, 9 aa, Artificial Sequence
  Inositol 1,4,5-trisphosphate receptor type 1 (2386-2394)
TLLNVIKSV

SEQ ID NO: 5536 - protein, 9 aa, Artificial Sequence
  Perilipin-2 (327-335)
TLLSNIQGV

SEQ ID NO: 5537 - protein, 9 aa, Artificial Sequence
  V-type proton ATPase subunit C 1 (184-192)
TLLVVVPKL

SEQ ID NO: 5538 - protein, 9 aa, Artificial Sequence
  Protein NOXP20 (254-262)
TLMERTVSL

SEQ ID NO: 5539 - protein, 9 aa, Artificial Sequence
  CAD protein (639-647)
TLNDREYQL

SEQ ID NO: 5540 - protein, 9 aa, Artificial Sequence
  Short transient receptor potential channel 1 (45-53)
TLNEKLFLL

SEQ ID NO: 5541 - protein, 9 aa, Artificial Sequence
  Pinin (7-15)
TLQEQLEKA

SEQ ID NO: 5542 - protein, 9 aa, Artificial Sequence
  Mitochondrial import receptor subunit TOM22 homolog (35-43)
TLSERLWGL

SEQ ID NO: 5543 - protein, 9 aa, Artificial Sequence
  AP-3 complex subunit mu-2 (219-227)
TLSFMNPRL

SEQ ID NO: 5544 - protein, 9 aa, Artificial Sequence
  Splicing factor 3B subunit 3 (165-173)
TLVYHVVGV

SEQ ID NO: 5545 - protein, 11 aa, Artificial Sequence
  Malate dehydrogenase, mitochondrial (54-64)
TLYDIAHTPGV

SEQ ID NO: 5546 - protein, 9 aa, Artificial Sequence
  60S ribosomal protein L10a (9-17)
TLYEAVREV

SEQ ID NO: 5547 - protein, 11 aa, Artificial Sequence
  Quinone oxidoreductase (225-235)
TMAKESSIIGV

SEQ ID NO: 5548 - protein, 9 aa, Artificial Sequence
  Dual specificity protein phosphatase 14 (92-100)
TVADKIHSV

SEQ ID NO: 5549 - protein, 9 aa, Artificial Sequence
  EH domain-containing protein 1 (479-487)
TVLGKIWKL

SEQ ID NO: 5550 - protein, 9 aa, Artificial Sequence
  Cell division cycle and apoptosis regulator protein 1 (1120-1128)
TVMDEIHTV

SEQ ID NO: 5551 - protein, 9 aa, Artificial Sequence
  Protein PAT1 homolog 1 (459-467)
VIIEKTYSL

SEQ ID NO: 5552 - protein, 10 aa, Artificial Sequence
  Tropomyosin alpha-4 chain (134-143)
VILEGELERA

SEQ ID NO: 5553 - protein, 9 aa, Artificial Sequence
  40S ribosomal protein S15a (6-14)
VLADALKSI

SEQ ID NO: 5554 - protein, 9 aa, Artificial Sequence
  Prefoldin subunit 4 (107-115)
VLADLKVQL

SEQ ID NO: 5555 - protein, 9 aa, Artificial Sequence
  Neurobeachin-like protein 2 (65-73)
VLAEQLHQA

SEQ ID NO: 5556 - protein, 10 aa, Artificial Sequence
  E3 ubiquitin-protein ligase RNF130 (74-83)
VLAPLPLHGV

SEQ ID NO: 5557 - protein, 9 aa, Artificial Sequence
  Calmodulin-regulated spectrin-associated protein 1 (1065-1073)
VLDASVKEV

SEQ ID NO: 5558 - protein, 9 aa, Artificial Sequence
  HEAT repeat-containing protein 3 (702-710)
VLDNVKMNL

SEQ ID NO: 5559 - protein, 9 aa, Artificial Sequence
  Carbohydrate sulfotransferase 14 (134-142)
VLDSVDVRL

SEQ ID NO: 5560 - protein, 10 aa, Artificial Sequence
  Cytosolic carboxypeptidase 1 (592-601)
VLFEGRTVQL

SEQ ID NO: 5561 - protein, 9 aa, Artificial Sequence
  Isochorismatase domain-containing protein 1 (143-151)
VLFGVETHV

SEQ ID NO: 5562 - protein, 9 aa, Artificial Sequence
  Rab GTPase-activating protein 1-like (129-137)
VLFNKLTYL

SEQ ID NO: 5563 - protein, 9 aa, Artificial Sequence
  Sorting nexin-5 (197-205)
VLFTGVKEV

SEQ ID NO: 5564 - protein, 11 aa, Artificial Sequence
  Centrosomal protein of 76 kDa (112-122)
VLGGKAFLEHL

SEQ ID NO: 5565 - protein, 9 aa, Artificial Sequence
  Exportin-1 (784-792)
VLIDYQRNV

SEQ ID NO: 5566 - protein, 9 aa, Artificial Sequence
  ORM1-like protein 3 (134-142)
VLIPKLPQL

SEQ ID NO: 5567 - protein, 9 aa, Artificial Sequence
  von Willebrand factor A domain-containing protein 8 (511-519)
VLLDGIHRV

SEQ ID NO: 5568 - protein, 12 aa, Artificial Sequence
  Asparagine synthetase (glutamine-hydrolyzing) (41-52)
VLLDTANKKVFL

SEQ ID NO: 5569 - protein, 13 aa, Artificial Sequence
  Ras-related protein Rab-5A (24-36)
VLLGESAVGKSSL

SEQ ID NO: 5570 - protein, 9 aa, Artificial Sequence
  MAU2 chromatid cohesion factor homolog (356-364)
VLLGHIFYV

SEQ ID NO: 5571 - protein, 9 aa, Artificial Sequence
  Kelch-like protein 24 (404-412)
VLLGKVYVV

SEQ ID NO: 5572 - protein, 10 aa, Artificial Sequence
  Protein FAM171B (19-28)
VLLKARLVPA

SEQ ID NO: 5573 - protein, 11 aa, Artificial Sequence
  Anamorsin (98-108)
VLLSDSNLHDA

SEQ ID NO: 5574 - protein, 9 aa, Artificial Sequence
  Protein yippee-like 1 (66-74)
VLLTGLHAV

SEQ ID NO: 5575 - protein, 9 aa, Artificial Sequence
  Inhibitor of nuclear factor kappa-B kinase subunit alpha (271-279)
VLMDHILNL

SEQ ID NO: 5576 - protein, 9 aa, Artificial Sequence
  Probable ATP-dependent RNA helicase DDX56 (130-138)
VLMEKPDVV

SEQ ID NO: 5577 - protein, 9 aa, Artificial Sequence
  Uncharacterized protein C18orf8 (434-442)
VLMEYIRSL

SEQ ID NO: 5578 - protein, 9 aa, Artificial Sequence
  Protein LLP homolog (39-47)
VLMKDVQEI

SEQ ID NO: 5579 - protein, 10 aa, Artificial Sequence
  Cyclin-dependent kinase 1 (69-78)
VLMQDSRLYL

SEQ ID NO: 5580 - protein, 9 aa, Artificial Sequence
  AP-2 complex subunit sigma (90-98)
VLNEYFHNV

SEQ ID NO: 5581 - protein, 9 aa, Artificial Sequence
  Maestro heat-like repeat-containing protein family member 1 (1078-1086)
VLQEKVPEI

SEQ ID NO: 5582 - protein, 10 aa, Artificial Sequence
  Nucleolar protein 9 (544-553)
VLQNLKGQYV

SEQ ID NO: 5583 - protein, 9 aa, Artificial Sequence
  High mobility group protein 20A (167-175)
VLQQHLETL

SEQ ID NO: 5584 - protein, 9 aa, Artificial Sequence
  HLA class II histocompatibility antigen, DR beta 3 chain (2-10)
VLSSRLAFA

SEQ ID NO: 5585 - protein, 9 aa, Artificial Sequence
  Importin-9 (169-177)
VLTEFTREV

SEQ ID NO: 5586 - protein, 9 aa, Artificial Sequence
  Protein asunder homolog (229-237)
VLTSEVHSV

SEQ ID NO: 5587 - protein, 9 aa, Artificial Sequence
  ELAV-like protein 1 (137-145)
VLVDQTTGL

SEQ ID NO: 5588 - protein, 9 aa, Artificial Sequence
  Ribonuclease UK114 (25-33)
VLVDRTIYI

SEQ ID NO: 5589 - protein, 11 aa, Artificial Sequence
  Zinc finger BED domain-containing protein 1 (374-384)
VLVEDSNNHHL

SEQ ID NO: 5590 - protein, 9 aa, Artificial Sequence
  Tyrosine-protein kinase JAK1 (997-1005)
VLVESEHQV

SEQ ID NO: 5591 - protein, 9 aa, Artificial Sequence
  Signal transducer and activator of transcription 1-alpha/beta (300-308)
VLWDRTFSL

SEQ ID NO: 5592 - protein, 9 aa, Artificial Sequence
  Mediator of RNA polymerase II transcription subunit 12 (571-579)
VLYDQPRHV

SEQ ID NO: 5593 - protein, 9 aa, Artificial Sequence
  Putative RNA-binding protein 15 (219-227)
VLYDRPLKI

SEQ ID NO: 5594 - protein, 9 aa, Artificial Sequence
  AKT-interacting protein (200-208)
VLYEKDIQL

SEQ ID NO: 5595 - protein, 9 aa, Artificial Sequence
  Werner syndrome ATP-dependent helicase (1155-1163)
VLYGKLVEA

SEQ ID NO: 5596 - protein, 9 aa, Artificial Sequence
  Set1/Ash2 histone methyltransferase complex subunit ASH2 (516-524)
VLYHVETEV

SEQ ID NO: 5597 - protein, 10 aa, Artificial Sequence
  Protein downstream neighbor of Son (395-404)
VLYPHEPTAV

SEQ ID NO: 5598 - protein, 9 aa, Artificial Sequence
  Protein artemis (131-139)
VLYTGDFRL

SEQ ID NO: 5599 - protein, 9 aa, Artificial Sequence
  Anaphase-promoting complex subunit 1 (498-506)
VLYTGVVRV

SEQ ID NO: 5600 - protein, 10 aa, Artificial Sequence
  Adenosylhomocysteinase 2 (277-286)
VMFGGKQVVV

SEQ ID NO: 5601 - protein, 9 aa, Artificial Sequence
  Ligand-dependent nuclear receptor-interacting factor 1 (358-366)
VMFNGKVYL

SEQ ID NO: 5602 - protein, 8 aa, Artificial Sequence
  Kelch-like protein 8 (201-208)
VMGKIFAV

SEQ ID NO: 5603 - protein, 10 aa, Artificial Sequence
  Adenosylhomocysteinase (209-218)
VMIAGKVAVV

SEQ ID NO: 5604 - protein, 9 aa, Artificial Sequence
  Cullin-2 (25-33)
VMLEYVERA

SEQ ID NO: 5605 - protein, 9 aa, Artificial Sequence
  DNA-directed RNA polymerases I, II, and III subunit RPABC3 (55-63)
VMYGKVYRI

SEQ ID NO: 5606 - protein, 9 aa, Artificial Sequence
  Cytoskeleton-associated protein 5 (1001-1009)
WLAEKLPTL

SEQ ID NO: 5607 - protein, 9 aa, Artificial Sequence
  Transcription factor 25 (392-400)
WLEENVHEV

SEQ ID NO: 5608 - protein, 11 aa, Artificial Sequence
  Nuclear migration protein nudC (184-194)
WLIEDGKVVTV

SEQ ID NO: 5609 - protein, 9 aa, Artificial Sequence
  Serine/threonine-protein phosphatase 2A 65 kDa regulatory subunit A alpha isoform isoform X1 (271-279)
WLVDHVYAI

SEQ ID NO: 5610 - protein, 14 aa, Artificial Sequence
  Melanocyte protein PMEL (44-57)
WNRQLYPEWTEAQR

SEQ ID NO: 5611 - protein, 10 aa, Artificial Sequence
  Helicase-like transcription factor (121-130)
YIMDNKLAQI

SEQ ID NO: 5612 - protein, 9 aa, Artificial Sequence
  Unconventional myosin-If (18-26)
YIMSYISRV

SEQ ID NO: 5613 - protein, 9 aa, Artificial Sequence
  CCR4-NOT transcription complex subunit 1 (237-245)
YLAPFLRNV

SEQ ID NO: 5614 - protein, 9 aa, Artificial Sequence
  COP9 signalosome complex subunit 1 (357-365)
YLAPHVRTL

SEQ ID NO: 5615 - protein, 9 aa, Artificial Sequence
  Nucleoprotein TPR (422-430)
YLDEIVKEV

SEQ ID NO: 5616 - protein, 9 aa, Artificial Sequence
  Tuberin (190-198)
YLDEYIARM

SEQ ID NO: 5617 - protein, 9 aa, Artificial Sequence
  Neutral alpha-glucosidase C (478-486)
YLDFTNPKV

SEQ ID NO: 5618 - protein, 9 aa, Artificial Sequence
  Protein flightless-1 homolog (154-162)
YLDLSENRL

SEQ ID NO: 5619 - protein, 9 aa, Artificial Sequence
  UPF0585 protein C16orf13 (21-29)
YLDPAQRGV

SEQ ID NO: 5620 - protein, 9 aa, Artificial Sequence
  BTB/POZ domain-containing protein KCTD3 (224-232)
YLDWTIERV

SEQ ID NO: 5621 - protein, 9 aa, Artificial Sequence
  DBF4-type zinc finger-containing protein 2 (1397-1405)
YLEDKSYKL

SEQ ID NO: 5622 - protein, 9 aa, Artificial Sequence
  NADH dehydrogenase (ubiquinone) iron-sulfur protein 8, mitochondrial (74-82)
YLFREPATI

SEQ ID NO: 5623 - protein, 9 aa, Artificial Sequence
  Protein unc-50 homolog (55-63)
YLFTSPQRV

SEQ ID NO: 5624 - protein, 9 aa, Artificial Sequence
  Vacuole membrane protein 1 (137-145)
YLGPHIASV

SEQ ID NO: 5625 - protein, 8 aa, Artificial Sequence
  SUMO-activating enzyme subunit 2 (164-171)
YLGQVTTI

SEQ ID NO: 5626 - protein, 9 aa, Artificial Sequence
  Mitotic checkpoint serine/threonine-protein kinase BUB1 beta (141-149)
YLHNQGIGV

SEQ ID NO: 5627 - protein, 11 aa, Artificial Sequence
  EKC/KEOPS complex subunit TPRKB (121-131)
YLISQVEGHQV

SEQ ID NO: 5628 - protein, 9 aa, Artificial Sequence
  Myosin-10 (264-272)
YLLEKSRAV

SEQ ID NO: 5629 - protein, 11 aa, Artificial Sequence
  Cyclin-D1-binding protein 1 (104-114)
YLLPKDQGITL

SEQ ID NO: 5630 - protein, 10 aa, Artificial Sequence
  PRKC apoptosis WT1 regulator protein (215-224)
YLLQEPPRTV

SEQ ID NO: 5631 - protein, 9 aa, Artificial Sequence
  Probable methyltransferase TARBP1 (286-294)
YLLQRAVEV

SEQ ID NO: 5632 - protein, 10 aa, Artificial Sequence
  E3 ubiquitin-protein ligase HUWE1 (1351-1360)
YLLTHPPPIM

SEQ ID NO: 5633 - protein, 10 aa, Artificial Sequence
  26S proteasome non-ATPase regulatory subunit 8 (142-151)
YLMEGSYNKV

SEQ ID NO: 5634 - protein, 9 aa, Artificial Sequence
  Leucine-tRNA ligase, cytoplasmic (901-909)
YLMEVTHDL

SEQ ID NO: 5635 - protein, 9 aa, Artificial Sequence
  Striatin-interacting protein 2 (207-215)
YLMVENIRL

SEQ ID NO: 5636 - protein, 9 aa, Artificial Sequence
  Zinc finger protein Pegasus (211-219)
YLNDFTHEI

SEQ ID NO: 5637 - protein, 9 aa, Artificial Sequence
  A-kinase anchor protein 10, mitochondrial (504-512)
YLNDLIHSV

SEQ ID NO: 5638 - protein, 9 aa, Artificial Sequence
  RNA polymerase II subunit A C-terminal domain phosphatase (611-619)
YLNKEIEEA

SEQ ID NO: 5639 - protein, 9 aa, Artificial Sequence
  DNA repair protein complementing XP-G cells (242-250)
YLNQHIEHV

SEQ ID NO: 5640 - protein, 11 aa, Artificial Sequence
  Protein phosphatase 1G (74-84)
YLPDIIKDQKA

SEQ ID NO: 5641 - protein, 9 aa, Artificial Sequence
  Interleukin-1 receptor-associated kinase-like 2 (381-389)
YLPEDFIRV

SEQ ID NO: 5642 - protein, 9 aa, Artificial Sequence
  Dual specificity protein kinase CLK2 (259-267)
YLPYPIHQV

SEQ ID NO: 5643 - protein, 9 aa, Artificial Sequence
  Sterol regulatory element-binding protein 2 (379-387)
YLQQVNHKL

SEQ ID NO: 5644 - protein, 9 aa, Artificial Sequence
  Actin-related protein 2/3 complex subunit 4 (8-16)
YLSAVRATL

SEQ ID NO: 5645 - protein, 9 aa, Artificial Sequence
  Hsp90 co-chaperone Cdc37 (174-182)
YLSDNVHLV

SEQ ID NO: 5646 - protein, 9 aa, Artificial Sequence
  Replication factor C subunit 5 (157-165)
YLSKIIPAL

SEQ ID NO: 5647 - protein, 9 aa, Artificial Sequence
  SLC45A3-BRAF fusion protein (236-244)
YLSPDLSKV

SEQ ID NO: 5648 - protein, 9 aa, Artificial Sequence
  THO complex subunit 5 homolog (225-233)
YLSSLQPRL

SEQ ID NO: 5649 - protein, 9 aa, Artificial Sequence
  Histone deacetylase 3 (183-191)
YLTDRVMTV

SEQ ID NO: 5650 - protein, 10 aa, Artificial Sequence
  40S ribosomal protein S10 (70-79)
YLTNEGIQYL

SEQ ID NO: 5651 - protein, 9 aa, Artificial Sequence
  Heat shock protein HSP 90-alpha (142-150)
YLVAEKVTV

SEQ ID NO: 5652 - protein, 9 aa, Artificial Sequence
  Protein unc-93 homolog B1 (246-254)
YLYDLNHTL

SEQ ID NO: 5653 - protein, 9 aa, Artificial Sequence
  Sodium- and chloride-dependent taurine transporter (277-285)
YLYPDITRL

SEQ ID NO: 5654 - protein, 9 aa, Artificial Sequence
  Cullin-7 (1355-1363)
YMADRLLGV

SEQ ID NO: 5655 - protein, 9 aa, Artificial Sequence
  Kinetochore-associated protein 1 (1575-1583)
YMLEHVITL

SEQ ID NO: 5656 - protein, 9 aa, Artificial Sequence
  Elongation of very long chain fatty acids protein 1 (200-208)
YQYPVIIHL

SEQ ID NO: 5657 - protein, 9 aa, Artificial Sequence
  Histone deacetylase 1 (188-196)
YTTDRVMTV

SEQ ID NO: 5658 - protein, 10 aa, Artificial Sequence
  Syntaxin-binding protein 5 (234-243)
YTYDEAIHSV

SEQ ID NO: 5659 - protein, 9 aa, Artificial Sequence
  Speriolin-like protein (56-64)
YVFPGVTRL

SEQ ID NO: 5660 - protein, 11 aa, Artificial Sequence
  Plectin (3961-3971)
YVIDPIKGLKL

SEQ ID NO: 5661 - protein, 9 aa, Artificial Sequence
  Erythroid differentiation-related factor 1 (607-615)
YVLEGLKSV

SEQ ID NO: 5662 - protein, 9 aa, Artificial Sequence
  Translation initiation factor eIF-2B subunit delta (413-421)
YVLPEVSKV

SEQ ID NO: 5663 - protein, 15 aa, Artificial Sequence
  Vimentin (452-466)
GQVINETSQHHDDLE

SEQ ID NO: 5664 - protein, 9 aa, Artificial Sequence
  Ubiquitin-conjugating enzyme E2 J2 (121-129)
FMVEKGPTL

SEQ ID NO: 5665 - protein, 9 aa, Artificial Sequence
  26S proteasome non-ATPase regulatory subunit 3 (216-224)
RVYEFLDKL

SEQ ID NO: 5666 - protein, 9 aa, Artificial Sequence
  E3 ubiquitin-protein ligase Hakai (341-349)
APPPPPPPP

SEQ ID NO: 5667 - protein, 9 aa, Artificial Sequence
  Farnesyl pyrophosphate synthase (36-44)
ARLKEVLEY

SEQ ID NO: 5668 - protein, 9 aa, Artificial Sequence
  Annexin A5 (92-100)
DAYELKHAL

SEQ ID NO: 5669 - protein, 9 aa, Artificial Sequence
  cAMP-dependent protein kinase catalytic subunit alpha (34-42)
DQFERIKTL

SEQ ID NO: 5670 - protein, 9 aa, Artificial Sequence
  Cytochrome c (90-98)
EERADLIAY

SEQ ID NO: 5671 - protein, 9 aa, Artificial Sequence
  T-complex protein 1 subunit theta (418-426)
ELAKQITSY

SEQ ID NO: 5672 - protein, 9 aa, Artificial Sequence
  COMM domain-containing protein 2 (116-124)
ELAPSLPSY

SEQ ID NO: 5673 - protein, 9 aa, Artificial Sequence
  Akirin-1 (166-174)
EQYESFVKF

SEQ ID NO: 5674 - protein, 8 aa, Artificial Sequence
  U5 small nuclear ribonucleoprotein 200 kDa helicase (1231-1238)
EVILHHEY

SEQ ID NO: 5675 - protein, 9 aa, Artificial Sequence
  ORM1-like protein 1 (9-17)
EVNPNTRVM

SEQ ID NO: 5676 - protein, 9 aa, Artificial Sequence
  Proteasome subunit alpha type-5 (125-133)
EVYHKSMTL

SEQ ID NO: 5677 - protein, 9 aa, Artificial Sequence
  Transcription factor 25 (248-256)
FAFEHSEEY

SEQ ID NO: 5678 - protein, 9 aa, Artificial Sequence
  Septin-6 (154-162)
FIAPTGHSL

SEQ ID NO: 5679 - protein, 9 aa, Artificial Sequence
  Sodium channel and clathrin linker 1 (55-63)
FLAPLVTEY

SEQ ID NO: 5680 - protein, 9 aa, Artificial Sequence
  Tetratricopeptide repeat protein 14 (257-265)
FVNPGVVEF

SEQ ID NO: 5681 - protein, 9 aa, Artificial Sequence
  Structural maintenance of chromosomes protein 4 (524-532)
GRIPGIYGR

SEQ ID NO: 5682 - protein, 10 aa, Artificial Sequence
  BCL-6 corepressor (860-869)
GRISDFHETY

SEQ ID NO: 5683 - protein, 9 aa, Artificial Sequence
  NEDD8-activating enzyme E1 regulatory subunit (434-442)
GRYPGVSNY

SEQ ID NO: 5684 - protein, 9 aa, Artificial Sequence
  RANBP2-like and GRIP domain-containing protein 2 (188-196)
HEAERNIAL

SEQ ID NO: 5685 - protein, 9 aa, Artificial Sequence
  Heterogeneous nuclear ribonucleoprotein L (348-356)
HPPPPPPPP

SEQ ID NO: 5686 - protein, 10 aa, Artificial Sequence
  Nodal modulator 3 (227-236)
HRFEQAFYTY

SEQ ID NO: 5687 - protein, 9 aa, Artificial Sequence
  Mediator of RNA polymerase II transcription subunit 19 (27-35)
KPPPPPPPP

SEQ ID NO: 5688 - protein, 9 aa, Artificial Sequence
  Afadin (1323-1331)
LPPPPPPPP

SEQ ID NO: 5689 - protein, 9 aa, Artificial Sequence
  Tubulin beta-2A chain (233-241)
LRFPGQLNA

SEQ ID NO: 5690 - protein, 9 aa, Artificial Sequence
  Keratinocyte-associated protein 2 (1-9)
MVVGTGTSL

SEQ ID NO: 5691 - protein, 9 aa, Artificial Sequence
  Heat shock protein HSP 90-beta (28-36)
NPQERTLTL

SEQ ID NO: 5692 - protein, 9 aa, Artificial Sequence
  N-alpha-acetyltransferase 50 (23-31)
NQVIFPVSY

SEQ ID NO: 5693 - protein, 9 aa, Artificial Sequence
  Origin recognition complex subunit 1 (665-673)
NRVSSRLGL

SEQ ID NO: 5694 - protein, 9 aa, Artificial Sequence
  Alanine-tRNA ligase, cytoplasmic (55-63)
NTIDPSHPM

SEQ ID NO: 5695 - protein, 9 aa, Artificial Sequence
  Histone H4 (34-42)
NVIRDAVTY

SEQ ID NO: 5696 - protein, 9 aa, Artificial Sequence
  Anaphase-promoting complex subunit 7 (184-192)
QERPSVTSY

SEQ ID NO: 5697 - protein, 9 aa, Artificial Sequence
  Syntaxin-binding protein 2 (143-151)
SLDAPHSTY

SEQ ID NO: 5698 - protein, 9 aa, Artificial Sequence
  Fructose-bisphosphate aldolase A (356-364)
SLFVSNHAY

SEQ ID NO: 5699 - protein, 9 aa, Artificial Sequence
  Abl interactor 1 (398-406)
SPPPPPPPP

SEQ ID NO: 5700 - protein, 9 aa, Artificial Sequence
  T-complex protein 1 subunit eta (208-216)
SQLVAGVAF

SEQ ID NO: 5701 - protein, 9 aa, Artificial Sequence
  FERM domain-containing protein 4A (824-832)
SQSQPSSQY

SEQ ID NO: 5702 - protein, 9 aa, Artificial Sequence
  60S ribosome subunit biogenesis protein NIP7 homolog (126-134)
SQYQGVVVY

SEQ ID NO: 5703 - protein, 8 aa, Artificial Sequence
  Dolichol-phosphate mannosyltransferase subunit 3 (78-85)
VGYRVATF

SEQ ID NO: 5704 - protein, 9 aa, Artificial Sequence
  Protein enabled homolog (379-387)
VPPPPPPPP

SEQ ID NO: 5705 - protein, 9 aa, Artificial Sequence
  Endoplasmin (727-735)
YLLPDTKAY

SEQ ID NO: 5706 - protein, 9 aa, Artificial Sequence
  Elongation factor 2 (489-497)
EHAHNMRVM

SEQ ID NO: 5707 - protein, 9 aa, Artificial Sequence
  T-complex protein 1 subunit eta (282-290)
HHSGAKVVL

SEQ ID NO: 5708 - protein, 10 aa, Artificial Sequence
  60S ribosomal protein L8 (49-58)
IHDPGRGAPL

SEQ ID NO: 5709 - protein, 11 aa, Artificial Sequence
  Heat shock protein HSP 90-beta (441-451)
IHEDSTNRRRL

SEQ ID NO: 5710 - protein, 9 aa, Artificial Sequence
  F-actin-capping protein subunit beta (235-243)
KTKDIVNGL

SEQ ID NO: 5711 - protein, 9 aa, Artificial Sequence
  Transcription activator BRG1 (899-907)
THYVAPRRL

SEQ ID NO: 5712 - protein, 9 aa, Artificial Sequence
  Actin-related protein 2 (378-386)
YQEKGVRVL

SEQ ID NO: 5713 - protein, 9 aa, Artificial Sequence
  Centromere protein W (77-85)
AAAKVILKK

SEQ ID NO: 5714 - protein, 9 aa, Artificial Sequence
  Histone H1.1 (63-71)
AALKKALAA

SEQ ID NO: 5715 - protein, 9 aa, Artificial Sequence
  MICOS complex subunit MIC60 (93-101)
AAYNVPLPK

SEQ ID NO: 5716 - protein, 10 aa, Artificial Sequence
  Crooked neck-like protein 1 (493-502)
AEAEAVREVY

SEQ ID NO: 5717 - protein, 9 aa, Artificial Sequence
  Dystonin (6939-6947)
AEAEQTLRF

SEQ ID NO: 5718 - protein, 9 aa, Artificial Sequence
  Exportin-T (39-47)
AEALAQRTY

SEQ ID NO: 5719 - protein, 9 aa, Artificial Sequence
  DNA replication licensing factor MCM5 (620-628)
AEALSKMKL

SEQ ID NO: 5720 - protein, 9 aa, Artificial Sequence
  Chondroitin sulfate glucuronyltransferase (568-576)
AEAPSQVRL

SEQ ID NO: 5721 - protein, 9 aa, Artificial Sequence
  78 kDa glucose-regulated protein (157-165)
AEAYLGKKV

SEQ ID NO: 5722 - protein, 10 aa, Artificial Sequence
  X-ray repair cross-complementing protein 6 (224-233)
AEDEDLRVHF

SEQ ID NO: 5723 - protein, 9 aa, Artificial Sequence
  WD and tetratricopeptide repeats protein 1 (45-53)
AEDGLIRQY

SEQ ID NO: 5724 - protein, 10 aa, Artificial Sequence
  DNA replication licensing factor MCM3 (278-287)
AEDIAKIKKF

SEQ ID NO: 5725 - protein, 10 aa, Artificial Sequence
  Transmembrane emp24 domain-containing protein 3 (50-59)
AEDLNSRVSY

SEQ ID NO: 5726 - protein, 10 aa, Artificial Sequence
  Transmembrane emp24 domain-containing protein 7 (179-188)
AEDLNTRVAY

SEQ ID NO: 5727 - protein, 11 aa, Artificial Sequence
  Retinoblastoma-like protein 1 (193-203)
AEEEIGTPRKF

SEQ ID NO: 5728 - protein, 9 aa, Artificial Sequence
  Clathrin heavy chain 1 (360-368)
AEELFARKF

SEQ ID NO: 5729 - protein, 9 aa, Artificial Sequence
  Alpha-2-macroglobulin receptor-associated protein (250-258)
AEFEEPRVI

SEQ ID NO: 5730 - protein, 9 aa, Artificial Sequence
  Immunoglobulin-binding protein 1 (122-130)
AEFELPKTM

SEQ ID NO: 5731 - protein, 9 aa, Artificial Sequence
  Myeloid leukemia factor 2 (224-232)
AEGPPRLAI

SEQ ID NO: 5732 - protein, 11 aa, Artificial Sequence
  Histone-lysine N-methyltransferase NSD3 (1027-1037)
AEGQTSINKTF

SEQ ID NO: 5733 - protein, 9 aa, Artificial Sequence
  Plectin (1687-1695)
AEGTAQQRL

SEQ ID NO: 5734 - protein, 9 aa, Artificial Sequence
  RNA-binding protein 34 (222-230)
AEGTLSKKL

SEQ ID NO: 5735 - protein, 9 aa, Artificial Sequence
  Perilipin-2 (303-311)
AEHIESRTL

SEQ ID NO: 5736 - protein, 9 aa, Artificial Sequence
  Secernin-1 (219-227)
AEHPELRSY

SEQ ID NO: 5737 - protein, 10 aa, Artificial Sequence
  DNA dC-dU-editing enzyme APOBEC-3D (121-130)
AEHPNVTLTI

SEQ ID NO: 5738 - protein, 9 aa, Artificial Sequence
  Vacuolar protein sorting-associated protein 13A (547-555)
AEHSTVITF

SEQ ID NO: 5739 - protein, 9 aa, Artificial Sequence
  Syntaxin-18 (279-287)
AEIDSIHQL

SEQ ID NO: 5740 - protein, 10 aa, Artificial Sequence
  Nesprin-2 (1575-1584)
AEIEIVKEEF

SEQ ID NO: 5741 - protein, 11 aa, Artificial Sequence
  WD repeat-containing protein 91 (30-40)
AEIKADKEKGF

SEQ ID NO: 5742 - protein, 9 aa, Artificial Sequence
  Tubulin-specific chaperone A (54-62)
AEILQESRM

SEQ ID NO: 5743 - protein, 11 aa, Artificial Sequence
  MAP3K12-binding inhibitory protein 1 (172-182)
AEINENNVREF

SEQ ID NO: 5744 - protein, 10 aa, Artificial Sequence
  Myosin light polypeptide 6 (107-116)
AEIRHVLVTL

SEQ ID NO: 5745 - protein, 9 aa, Artificial Sequence
  BAG64702.1 (1-9)
AEITDKLGL

SEQ ID NO: 5746 - protein, 9 aa, Artificial Sequence
  Nuclear migration protein nudC (2-10)
AEKLITQTF

SEQ ID NO: 5747 - protein, 10 aa, Artificial Sequence
  Spectrin alpha chain, non-erythrocytic 1 (381-390)
AELDRQIKSF

SEQ ID NO: 5748 - protein, 10 aa, Artificial Sequence
  Transcriptional regulator ATRX (1293-1302)
AELEENQRSY

SEQ ID NO: 5749 - protein, 9 aa, Artificial Sequence
  Dolichyl-diphosphooligosaccharide-proteinosyltransferase subunit 2 (288-296)
AELTPHQTF

SEQ ID NO: 5750 - protein, 9 aa, Artificial Sequence
  Nuclear receptor corepressor 1 (522-530)
AENDPTRQY

SEQ ID NO: 5751 - protein, 9 aa, Artificial Sequence
  General transcription factor 3C polypeptide 1 (42-50)
AENGLTVRL

SEQ ID NO: 5752 - protein, 11 aa, Artificial Sequence
  Eukaryotic translation initiation factor 4 gamma 1 (544-554)
AENIQPGEQKY

SEQ ID NO: 5753 - protein, 9 aa, Artificial Sequence
  Glycogen phosphorylase, muscle form (273-281)
AENISRVLY

SEQ ID NO: 5754 - protein, 9 aa, Artificial Sequence
  X-ray repair cross-complementing protein 5 (48-56)
AENKDEIAL

SEQ ID NO: 5755 - protein, 9 aa, Artificial Sequence
  Protein kinase C delta type (405-413)
AENPFLTHL

SEQ ID NO: 5756 - protein, 10 aa, Artificial Sequence
  ATP-dependent RNA helicase DDX42 (93-102)
AENSPTRQQF

SEQ ID NO: 5757 - protein, 9 aa, Artificial Sequence
  E3 ubiquitin-protein ligase TTC3 (1392-1400)
AENVAGHQI

SEQ ID NO: 5758 - protein, 9 aa, Artificial Sequence
  RAB6A-GEF complex partner protein 1 (906-914)
AENVPASKF

SEQ ID NO: 5759 - protein, 11 aa, Artificial Sequence
  Vigilin (1010-1020)
AEQEDRALRSF

SEQ ID NO: 5760 - protein, 9 aa, Artificial Sequence
  Plectin (2014-2022)
AEQESARQL

SEQ ID NO: 5761 - protein, 11 aa, Artificial Sequence
  B-cell receptor-associated protein 31 (21-31)
AESASEAAKKY

SEQ ID NO: 5762 - protein, 9 aa, Artificial Sequence
  T-complex protein 1 subunit beta (113-121)
AESLIAKKI

SEQ ID NO: 5763 - protein, 9 aa, Artificial Sequence
  Sphingomyelin phosphodiesterase 4 (513-521)
AESPAGHSF

SEQ ID NO: 5764 - protein, 9 aa, Artificial Sequence
  Protein THEMIS2 (120-128)
AESPERVLL

SEQ ID NO: 5765 - protein, 11 aa, Artificial Sequence
  Chitinase domain-containing protein 1 (57-67)
AESVVLEHRSY

SEQ ID NO: 5766 - protein, 9 aa, Artificial Sequence
  Poly(A)-specific ribonuclease PARN (455-463)
AESYRIQTY

SEQ ID NO: 5767 - protein, 10 aa, Artificial Sequence
  Translation initiation factor eIF-2B subunit epsilon (406-415)
AEVGAAGKGY

SEQ ID NO: 5768 - protein, 11 aa, Artificial Sequence
  RNA-binding protein 8A (78-88)
AEYGEIKNIHL

SEQ ID NO: 5769 - protein, 9 aa, Artificial Sequence
  Histone deacetylase 1 (239-247)
AIFKPVMSK

SEQ ID NO: 5770 - protein, 9 aa, Artificial Sequence
  Pre-mRNA-processing factor 6 (764-772)
AILEKSRLK

SEQ ID NO: 5771 - protein, 11 aa, Artificial Sequence
  Serine/threonine-protein phosphatase 2A 65 kDa regulatory subunit A alpha isoform (457-467)
AIREAATSNLK

SEQ ID NO: 5772 - protein, 9 aa, Artificial Sequence
  Cleavage and polyadenylation specificity factor subunit 7 (346-354)
AISSSAISK

SEQ ID NO: 5773 - protein, 9 aa, Artificial Sequence
  39S ribosomal protein L20, mitochondrial (106-114)
AIYEPKTFK

SEQ ID NO: 5774 - protein, 9 aa, Artificial Sequence
  Melanoma-associated antigen F1 (61-69)
ALAAKALAR

SEQ ID NO: 5775 - protein, 9 aa, Artificial Sequence
  Proteasome subunit alpha type-4 (120-128)
ALAIKVLNK

SEQ ID NO: 5776 - protein, 9 aa, Artificial Sequence
  Lysine-specific demethylase 2B (171-179)
ALANKPLRR

SEQ ID NO: 5777 - protein, 9 aa, Artificial Sequence
  Eukaryotic translation initiation factor 3 subunit C-like protein (251-259)
ALASRFLKK

SEQ ID NO: 5778 - protein, 9 aa, Artificial Sequence
  Translation factor GUF1, mitochondrial (274-282)
ALFDGVVSK

SEQ ID NO: 5779 - protein, 9 aa, Artificial Sequence
  V-type proton ATPase subunit E 1 (214-222)
ALFGANANR

SEQ ID NO: 5780 - protein, 10 aa, Artificial Sequence
  Sorting nexin-5 (315-324)
ALIDYENSNK

SEQ ID NO: 5781 - protein, 10 aa, Artificial Sequence
  T-complex protein 1 subunit zeta (279-288)
ALIKHKPSVK

SEQ ID NO: 5782 - protein, 10 aa, Artificial Sequence
  60S ribosomal protein L9 (159-168)
ALIQQATTVK

SEQ ID NO: 5783 - protein, 10 aa, Artificial Sequence
  Actin-related protein 2/3 complex subunit 5 (58-67)
ALKNPPINTK

SEQ ID NO: 5784 - protein, 10 aa, Artificial Sequence
  40S ribosomal protein S15a (10-19)
ALKSINNAEK

SEQ ID NO: 5785 - protein, 9 aa, Artificial Sequence
  Eukaryotic translation initiation factor 4 gamma 1 (785-793)
ALKVPTTEK

SEQ ID NO: 5786 - protein, 11 aa, Artificial Sequence
  Prefoldin subunit 6 (48-58)
ALLDGSNVVFK

SEQ ID NO: 5787 - protein, 9 aa, Artificial Sequence
  Serine hydroxymethyltransferase, mitochondrial (340-348)
ALLERGYSL

SEQ ID NO: 5788 - protein, 9 aa, Artificial Sequence
  Interferon alpha-inducible protein 6 (113-121)
ALMGYATHK

SEQ ID NO: 5789 - protein, 9 aa, Artificial Sequence
  Engulfment and cell motility protein 2 (573-581)
ALNHKVLHY

SEQ ID NO: 5790 - protein, 9 aa, Artificial Sequence
  60S ribosomal protein L4 (132-140)
ALPALVMSK

SEQ ID NO: 5791 - protein, 9 aa, Artificial Sequence
  AT-rich interactive domain-containing protein 4B (407-415)
ALPEKVVNK

SEQ ID NO: 5792 - protein, 10 aa, Artificial Sequence
  m7GpppX diphosphatase (320-329)
ALRADDPLLK

SEQ ID NO: 5793 - protein, 9 aa, Artificial Sequence
  Probable helicase senataxin (1619-1627)
ALSPSLKNK

SEQ ID NO: 5794 - protein, 9 aa, Artificial Sequence
  Transcription initiation factor IIE subunit beta (16-24)
ALSTPVVEK

SEQ ID NO: 5795 - protein, 10 aa, Artificial Sequence
  Nuclear receptor corepressor 1 (607-616)
ALVSTPVRTK

SEQ ID NO: 5796 - protein, 9 aa, Artificial Sequence
  F-box only protein 21 (373-381)
ALYGVVNVK

SEQ ID NO: 5797 - protein, 11 aa, Artificial Sequence
  Cytochrome c oxidase subunit 7A-related protein, mitochondrial (104-114)
ALYMASQPKNK

SEQ ID NO: 5798 - protein, 9 aa, Artificial Sequence
  Anaphase-promoting complex subunit 1 (1587-1595)
ALYPHFPAH

SEQ ID NO: 5799 - protein, 9 aa, Artificial Sequence
  Nucleosome assembly protein 1-like 4 (97-105)
ALYQPLFDK

SEQ ID NO: 5800 - protein, 9 aa, Artificial Sequence
  Mitochondrial ubiquitin ligase activator of NFKB 1 (24-32)
ALYSVYRQK

SEQ ID NO: 5801 - protein, 9 aa, Artificial Sequence
  Pyruvate kinase PKM (21-29)
AMADTFLEH

SEQ ID NO: 5802 - protein, 9 aa, Artificial Sequence
  Baculoviral IAP repeat-containing protein 6 (2448-2456)
AMKPKPLSV

SEQ ID NO: 5803 - protein, 11 aa, Artificial Sequence
  NAD(P)H dehydrogenase (quinone) 1 (128-138)
AMYDKGPFRSK

SEQ ID NO: 5804 - protein, 8 aa, Artificial Sequence
  Lysine-specific demethylase 5D (795-802)
ANKVRVAL

SEQ ID NO: 5805 - protein, 9 aa, Artificial Sequence
  Major facilitator superfamily domain-containing protein 12 (11-19)
APSPRPLSL

SEQ ID NO: 5806 - protein, 9 aa, Artificial Sequence
  THO complex subunit 4 (51-59)
APYSRPKQL

SEQ ID NO: 5807 - protein, 9 aa, Artificial Sequence
  40S ribosomal protein S3 (44-52)
AQAESLRYK

SEQ ID NO: 5808 - protein, 11 aa, Artificial Sequence
  Hydroxymethylglutaryl-CoA synthase, cytoplasmic (393-403)
AQYSPQQLAGK

SEQ ID NO: 5809 - protein, 10 aa, Artificial Sequence
  Nucleolar protein 58 (344-353)
ASLVGQTSPK

SEQ ID NO: 5810 - protein, 9 aa, Artificial Sequence
  Casein kinase II subunit beta (204-212)
ASNFKSPVK

SEQ ID NO: 5811 - protein, 9 aa, Artificial Sequence
  Sec1 family domain-containing protein 1 (482-490)
ASYGSTTTK

SEQ ID NO: 5812 - protein, 11 aa, Artificial Sequence
  Actin, cytoplasmic 2 (19-29)
ATAASSSSLEK

SEQ ID NO: 5813 - protein, 10 aa, Artificial Sequence
  Receptor expression-enhancing protein 3 (130-139)
ATAAVTAAVK

SEQ ID NO: 5814 - protein, 9 aa, Artificial Sequence
  Mediator of RNA polymerase II transcription subunit 12 (294-302)
ATAGFTIGR

SEQ ID NO: 5815 - protein, 9 aa, Artificial Sequence
  Kinetochore protein Nuf2 (353-361)
ATAQFKINK

SEQ ID NO: 5816 - protein, 9 aa, Artificial Sequence
  E3 ubiquitin-protein ligase makorin-1 (117-125)
ATATELTTK

SEQ ID NO: 5817 - protein, 9 aa, Artificial Sequence
  Adenomatous polyposis coli protein (1083-1091)
ATDIPSSQK

SEQ ID NO: 5818 - protein, 9 aa, Artificial Sequence
  Myosin-9 (540-548)
ATDKSFVEK

SEQ ID NO: 5819 - protein, 9 aa, Artificial Sequence
  Probable ATP-dependent RNA helicase DHX37 (603-611)
ATFPVAPRY

SEQ ID NO: 5820 - protein, 11 aa, Artificial Sequence
  Protein transport protein Sec31A (61-71)
ATFSSSHRYHK

SEQ ID NO: 5821 - protein, 9 aa, Artificial Sequence
  Exosome complex component RRP41 (79-87)
ATFSTGERK

SEQ ID NO: 5822 - protein, 10 aa, Artificial Sequence
  Angio-associated migratory cell protein (18-27)
ATGDMSGLLK

SEQ ID NO: 5823 - protein, 9 aa, Artificial Sequence
  Trans-3-hydroxy-L-proline dehydratase (302-310)
ATGSVFTGK

SEQ ID NO: 5824 - protein, 9 aa, Artificial Sequence
  Lamina-associated polypeptide 2, isoform alpha (583-591)
ATHTAFVAK

SEQ ID NO: 5825 - protein, 9 aa, Artificial Sequence
  Helicase with zinc finger domain 2 (1314-1322)
ATITKVLQK

SEQ ID NO: 5826 - protein, 9 aa, Artificial Sequence
  Hexokinase-2 (388-396)
ATLAAVLQR

SEQ ID NO: 5827 - protein, 10 aa, Artificial Sequence
  Fanconi anemia group I protein (1123-1132)
ATLPNQPVEK

SEQ ID NO: 5828 - protein, 9 aa, Artificial Sequence
  Pescadillo homolog (14-22)
ATNYITRNK

SEQ ID NO: 5829 - protein, 9 aa, Artificial Sequence
  Nucleolar and spindle-associated protein 1 (346-354)
ATQTPVSNK

SEQ ID NO: 5830 - protein, 9 aa, Artificial Sequence
  Retinoblastoma-associated protein (27-35)
ATSAFQTQK

SEQ ID NO: 5831 - protein, 9 aa, Artificial Sequence
  DNA repair protein XRCC2 (193-201)
ATTQTIMQK

SEQ ID NO: 5832 - protein, 10 aa, Artificial Sequence
  Derlin-1 (21-30)
ATVAVPLVGK

SEQ ID NO: 5833 - protein, 9 aa, Artificial Sequence
  Pre-mRNA-processing-splicing factor 8 (765-773)
ATVDKTVCK

SEQ ID NO: 5834 - protein, 10 aa, Artificial Sequence
  Importin subunit beta-1 (862-871)
ATWATKELRK

SEQ ID NO: 5835 - protein, 10 aa, Artificial Sequence
  60S ribosomal protein L13 (23-32)
ATWFNQPARK

SEQ ID NO: 5836 - protein, 10 aa, Artificial Sequence
  DNA (cytosine-5)-methyltransferase 3A (168-177)
ATYNKQPMYR

SEQ ID NO: 5837 - protein, 9 aa, Artificial Sequence
  Putative rhophilin-2-like protein RHPN2P1 (502-510)
ATYSVGMQK

SEQ ID NO: 5838 - protein, 10 aa, Artificial Sequence
  TRAF2 and NCK-interacting protein kinase (83-92)
ATYYGAFIKK

SEQ ID NO: 5839 - protein, 9 aa, Artificial Sequence
  T-complex protein 1 subunit gamma (73-81)
AVAHALTEK

SEQ ID NO: 5840 - protein, 10 aa, Artificial Sequence
  WD repeat-containing protein 3 (14-23)
AVFGVIGSQK

SEQ ID NO: 5841 - protein, 11 aa, Artificial Sequence
  Importin subunit alpha-1 (338-348)
AVFPSLLTNPK

SEQ ID NO: 5842 - protein, 10 aa, Artificial Sequence
  Nucleoside diphosphate kinase 6 (39-48)
AVHQQILSNK

SEQ ID NO: 5843 - protein, 9 aa, Artificial Sequence
  Methylsterol monooxygenase 1 (15-23)
AVIEDTWHY

SEQ ID NO: 5844 - protein, 11 aa, Artificial Sequence
  Protein HIRA (394-404)
AVIENPEMLKY

SEQ ID NO: 5845 - protein, 9 aa, Artificial Sequence
  Probable phospholipid-transporting ATPase IF (301-309)
AVISTILKY

SEQ ID NO: 5846 - protein, 9 aa, Artificial Sequence
  Integrator complex subunit 12 (240-248)
AVKDPLVKK

SEQ ID NO: 5847 - protein, 9 aa, Artificial Sequence
  Nuclear pore complex protein Nup160 (1177-1185)
AVLGKGHQY

SEQ ID NO: 5848 - protein, 9 aa, Artificial Sequence
  Cyclin-I (179-187)
AVLTKQLLH

SEQ ID NO: 5849 - protein, 10 aa, Artificial Sequence
  Signal peptidase complex catalytic subunit SEC11C (180-189)
AVMGAYVLLK

SEQ ID NO: 5850 - protein, 10 aa, Artificial Sequence
  Structural maintenance of chromosomes protein 4 (1190-1199)
AVNPKEIASK

SEQ ID NO: 5851 - protein, 9 aa, Artificial Sequence
  Sororin (53-61)
AVRKPIVLK

SEQ ID NO: 5852 - protein, 9 aa, Artificial Sequence
  Histone H2B type 1-K (118-126)
AVTKYTSAK

SEQ ID NO: 5853 - protein, 11 aa, Artificial Sequence
  Nuclear pore complex protein Nup160 (1113-1123)
AVYDRPGASPK

SEQ ID NO: 5854 - protein, 9 aa, Artificial Sequence
  Integrator complex subunit 8 (269-277)
AVYENAREK

SEQ ID NO: 5855 - protein, 9 aa, Artificial Sequence
  Toll-interacting protein (84-92)
AVYETPTAH

SEQ ID NO: 5856 - protein, 11 aa, Artificial Sequence
  Ras GTPase-activating protein-binding protein 1 (54-64)
AVYGQKEIHRK

SEQ ID NO: 5857 - protein, 9 aa, Artificial Sequence
  Amyloid protein-binding protein 2 (337-345)
AYSSYVHQY

SEQ ID NO: 5858 - protein, 9 aa, Artificial Sequence
  182 kDa tankyrase-1-binding protein (415-423)
DAHLRPTSL

SEQ ID NO: 5859 - protein, 8 aa, Artificial Sequence
  Cytoplasmic FMR1-interacting protein 2 (285-292)
DAKKRINL

SEQ ID NO: 5860 - protein, 9 aa, Artificial Sequence
  Heat shock protein 105 kDa (255-263)
DAKSKIRAL

SEQ ID NO: 5861 - protein, 9 aa, Artificial Sequence
  Chromodomain-helicase-DNA-binding protein 2 (106-114)
DEALIGKKF

SEQ ID NO: 5862 - protein, 10 aa, Artificial Sequence
  Pre-mRNA-processing-splicing factor 8 (1104-1113)
DEARDLIQRY

SEQ ID NO: 5863 - protein, 10 aa, Artificial Sequence
  EH domain-containing protein 4 (201-210)
DEFSEAIKAF

SEQ ID NO: 5864 - protein, 11 aa, Artificial Sequence
  26S protease regulatory subunit 10B (247-257)
DEIDAIGGRRF

SEQ ID NO: 5865 - protein, 10 aa, Artificial Sequence
  U4/U6 small nuclear ribonucleoprotein Prp31 (322-331)
DEIERKFDKW

SEQ ID NO: 5866 - protein, 9 aa, Artificial Sequence
  Zinc finger MYND domain-containing protein 11 (348-356)
DELELHQRF

SEQ ID NO: 5867 - protein, 10 aa, Artificial Sequence
  General transcription factor IIH subunit 5 (24-33)
DESNALGKKF

SEQ ID NO: 5868 - protein, 9 aa, Artificial Sequence
  Ubiquitin carboxyl-terminal hydrolase 19 (1197-1205)
DESQVVTRY

SEQ ID NO: 5869 - protein, 9 aa, Artificial Sequence
  Serrate RNA effector molecule homolog (164-172)
DETEAVKRY

SEQ ID NO: 5870 - protein, 10 aa, Artificial Sequence
  60S ribosomal protein L26 (53-62)
DEVQVVRGHY

SEQ ID NO: 5871 - protein, 9 aa, Artificial Sequence
  Ras GTPase-activating protein-binding protein 2 (60-68)
DIHHKVLSL

SEQ ID NO: 5872 - protein, 9 aa, Artificial Sequence
  Heat shock 70 kDa protein 4 (255-263)
DIKSKIRAL

SEQ ID NO: 5873 - protein, 9 aa, Artificial Sequence
  Heterogeneous nuclear ribonucleoprotein F (196-204)
DPPLKFMSV

SEQ ID NO: 5874 - protein, 9 aa, Artificial Sequence
  Cullin-1 (348-356)
DVHKKYNAL

SEQ ID NO: 5875 - protein, 9 aa, Artificial Sequence
  Spectrin alpha chain, non-erythrocytic 1 (50-58)
DVKAKLHEL

SEQ ID NO: 5876 - protein, 9 aa, Artificial Sequence
  Coatomer subunit beta (34-42)
DVKSKTEAL

SEQ ID NO: 5877 - protein, 8 aa, Artificial Sequence
  Pumilio homolog 3 (320-327)
EAVIKHSL

SEQ ID NO: 5878 - protein, 10 aa, Artificial Sequence
  NADH dehydrogenase (ubiquinone) 1 alpha subcomplex subunit 13 (122-131)
EEALHASHGF

SEQ ID NO: 5879 - protein, 9 aa, Artificial Sequence
  DDB1- and CUL4-associated factor 10 (132-140)
EEANVGRGY

SEQ ID NO: 5880 - protein, 11 aa, Artificial Sequence
  15 kDa selenoprotein (76-86)
EEAQFETKKLY

SEQ ID NO: 5881 - protein, 10 aa, Artificial Sequence
  Negative elongation factor E (10-19)
EEEEALQKKF

SEQ ID NO: 5882 - protein, 9 aa, Artificial Sequence
  60S ribosomal protein L13 (171-179)
EEEKNFKAF

SEQ ID NO: 5883 - protein, 10 aa, Artificial Sequence
  Coiled-coil domain-containing protein 66 (780-789)
EEEPLNIHSF

SEQ ID NO: 5884 - protein, 9 aa, Artificial Sequence
  HLA class II histocompatibility antigen, DR alpha chain (41-49)
EEFGRFASF

SEQ ID NO: 5885 - protein, 10 aa, Artificial Sequence
  E3 ubiquitin-protein ligase MGRN1 (140-149)
EEFLNGRAVY

SEQ ID NO: 5886 - protein, 9 aa, Artificial Sequence
  Cullin-4A (269-277)
EEGDRVITY

SEQ ID NO: 5887 - protein, 9 aa, Artificial Sequence
  WD repeat-containing protein 36 (776-784)
EEGLVNNKY

SEQ ID NO: 5888 - protein, 10 aa, Artificial Sequence
  A-kinase anchor protein 2 (256-265)
EEHLESHKKY

SEQ ID NO: 5889 - protein, 9 aa, Artificial Sequence
  Unconventional myosin-Ie (749-757)
EEHPELQQF

SEQ ID NO: 5890 - protein, 9 aa, Artificial Sequence
  Vimentin (229-237)
EEIAFLKKL

SEQ ID NO: 5891 - protein, 10 aa, Artificial Sequence
  PH domain leucine-rich repeat-containing protein phosphatase 1 (287-296)
EEIDLSGNKL

SEQ ID NO: 5892 - protein, 8 aa, Artificial Sequence
  Probable ATP-dependent RNA helicase DDX56 (421-428)
EEIEGFRY

SEQ ID NO: 5893 - protein, 9 aa, Artificial Sequence
  Paxillin (389-397)
EEIGSRNFF

SEQ ID NO: 5894 - protein, 9 aa, Artificial Sequence
  Retinoblastoma-like protein 1 (195-203)
EEIGTPRKF

SEQ ID NO: 5895 - protein, 10 aa, Artificial Sequence
  Bloom syndrome protein (942-951)
EEIPVSSHYF

SEQ ID NO: 5896 - protein, 10 aa, Artificial Sequence
  Kinesin-like protein KIF21A (473-482)
EEISNMIHSY

SEQ ID NO: 5897 - protein, 11 aa, Artificial Sequence
  Thioredoxin-related transmembrane protein 2 (148-158)
EELERDKRVTW

SEQ ID NO: 5898 - protein, 8 aa, Artificial Sequence
  Clathrin heavy chain 1 (361-368)
EELFARKF

SEQ ID NO: 5899 - protein, 9 aa, Artificial Sequence
  2',3'-cyclic-nucleotide 3'-phosphodiesterase (191-199)
EELGNHKAF

SEQ ID NO: 5900 - protein, 9 aa, Artificial Sequence
  Protein FAM192A (107-115)
EELKELKEY

SEQ ID NO: 5901 - protein, 10 aa, Artificial Sequence
  Proteasome subunit beta type-4 (119-128)
EELLGDGHSY

SEQ ID NO: 5902 - protein, 10 aa, Artificial Sequence
  Sorting nexin-14 (340-349)
EELQKIYKTY

SEQ ID NO: 5903 - protein, 9 aa, Artificial Sequence
  Krueppel-like factor 6 (124-132)
EELSPTAKF

SEQ ID NO: 5904 - protein, 11 aa, Artificial Sequence
  Eukaryotic initiation factor 4A-I (239-249)
EELTLEGIRQF

SEQ ID NO: 5905 - protein, 10 aa, Artificial Sequence
  Coiled-coil domain-containing protein 93 (132-141)
EEMGDYIRSY

SEQ ID NO: 5906 - protein, 10 aa, Artificial Sequence
  Nuclear pore complex protein Nup153 (1104-1113)
EEMPATKGGF

SEQ ID NO: 5907 - protein, 10 aa, Artificial Sequence
  Folliculin-interacting protein 1 (434-443)
EENAVDVKQY

SEQ ID NO: 5908 - protein, 9 aa, Artificial Sequence
  Tropomodulin-3 (310-318)
EENTNILKF

SEQ ID NO: 5909 - protein, 9 aa, Artificial Sequence
  G2/mitotic-specific cyclin-B1 (183-191)
EEQAVRPKY

SEQ ID NO: 5910 - protein, 9 aa, Artificial Sequence
  Targeting protein for Xklp2 (170-178)
EEQELEKSM

SEQ ID NO: 5911 - protein, 9 aa, Artificial Sequence
  Nuclear receptor-binding protein (235-243)
EEQKNLHFF

SEQ ID NO: 5912 - protein, 10 aa, Artificial Sequence
  Cyclin-G-associated kinase (740-749)
EEQQDILSKF

SEQ ID NO: 5913 - protein, 10 aa, Artificial Sequence
  Nitrogen permease regulator 2-like protein (336-345)
EEQSHPARLY

SEQ ID NO: 5914 - protein, 9 aa, Artificial Sequence
  OTU domain-containing protein 5 (177-185)
EEQVARESY

SEQ ID NO: 5915 - protein, 9 aa, Artificial Sequence
  Histone-binding protein RBBP4 (13-21)
EERVINEEY

SEQ ID NO: 5916 - protein, 9 aa, Artificial Sequence
  Sorting nexin-24 (11-19)
EESDLERGY

SEQ ID NO: 5917 - protein, 9 aa, Artificial Sequence
  Poly(rC)-binding protein 2 (41-49)
EESGARINI

SEQ ID NO: 5918 - protein, 9 aa, Artificial Sequence
  Vacuolar fusion protein CCZ1 homolog (215-223)
EESLNIVKY

SEQ ID NO: 5919 - protein, 10 aa, Artificial Sequence
  ATP-dependent RNA helicase DDX19B (301-310)
EETLDTIKQY

SEQ ID NO: 5920 - protein, 10 aa, Artificial Sequence
  Elongation factor 1-gamma (325-334)
EETQTLVREY

SEQ ID NO: 5921 - protein, 10 aa, Artificial Sequence
  Adenylate cyclase type 3 (1088-1097)
EETQVILREY

SEQ ID NO: 5922 - protein, 10 aa, Artificial Sequence
  Cleavage and polyadenylation specificity factor subunit 1 (1111-1120)
EETVSGLKGY

SEQ ID NO: 5923 - protein, 10 aa, Artificial Sequence
  MICOS complex subunit MIC19 (168-177)
EEVEAKFKRY

SEQ ID NO: 5924 - protein, 8 aa, Artificial Sequence
  G patch domain-containing protein 4 (211-218)
EEVESRAY

SEQ ID NO: 5925 - protein, 10 aa, Artificial Sequence
  Chromodomain-helicase-DNA-binding protein 1-like (214-223)
EEVGDFIQRY

SEQ ID NO: 5926 - protein, 9 aa, Artificial Sequence
  Ferritin light chain (137-145)
EEVKLIKKM

SEQ ID NO: 5927 - protein, 9 aa, Artificial Sequence
  Alanine-tRNA ligase, cytoplasmic (378-386)
EEVQFLKTL

SEQ ID NO: 5928 - protein, 10 aa, Artificial Sequence
  Glutaredoxin-3 (139-148)
EEVRQGLKAY

SEQ ID NO: 5929 - protein, 8 aa, Artificial Sequence
  Pre-B-cell leukemia transcription factor 3 (11-18)
EIKEKTGL

SEQ ID NO: 5930 - protein, 9 aa, Artificial Sequence
  AP-2 complex subunit alpha-1 (29-37)
EIKRINKEL

SEQ ID NO: 5931 - protein, 9 aa, Artificial Sequence
  40S ribosomal protein S24 (39-47)
EIREKLAKM

SEQ ID NO: 5932 - protein, 9 aa, Artificial Sequence
  Crooked neck-like protein 1 (571-579)
EIRQKNLSL

SEQ ID NO: 5933 - protein, 9 aa, Artificial Sequence
  Enhancer of mRNA-decapping protein 3 (285-293)
ELHKKLLSV

SEQ ID NO: 5934 - protein, 9 aa, Artificial Sequence
  Alpha-2-macroglobulin receptor-associated protein (20-28)
ELKEKLRSI

SEQ ID NO: 5935 - protein, 8 aa, Artificial Sequence
  Neuroblastoma-amplified sequence (1048-1055)
ELLEKHGL

SEQ ID NO: 5936 - protein, 9 aa, Artificial Sequence
  Heat shock protein HSP 90-beta (529-537)
ERIMKAQAL

SEQ ID NO: 5937 - protein, 9 aa, Artificial Sequence
  Protein phosphatase 1 regulatory subunit 7 (95-103)
EVLKKVKTL

SEQ ID NO: 5938 - protein, 8 aa, Artificial Sequence
  Heterogeneous nuclear ribonucleoprotein M (130-137)
EVLNKHSL

SEQ ID NO: 5939 - protein, 9 aa, Artificial Sequence
  Exosome component 10 (254-262)
FAHPYQYEL

SEQ ID NO: 5940 - protein, 9 aa, Artificial Sequence
  Long-chain-fatty-acid-CoA ligase 3 (551-559)
FEDENGQRW

SEQ ID NO: 5941 - protein, 10 aa, Artificial Sequence
  X-ray repair cross-complementing protein 6 (478-487)
FENPVLQQHF

SEQ ID NO: 5942 - protein, 9 aa, Artificial Sequence
  Cyclin-dependent kinase 14 (275-283)
FGLARAKSV

SEQ ID NO: 5943 - protein, 9 aa, Artificial Sequence
  Translocation protein SEC62 (278-286)
FRPLYTHEY

SEQ ID NO: 5944 - protein, 8 aa, Artificial Sequence
  Myosin-9 (831-838)
FTKVKPLL

SEQ ID NO: 5945 - protein, 9 aa, Artificial Sequence
  Gamma-interferon-inducible protein 16 (533-541)
FVYEPKEQK

SEQ ID NO: 5946 - protein, 10 aa, Artificial Sequence
  Constitutive coactivator of peroxisome proliferator-activated receptor gamma (663-672)
FVYPGNPLRH

SEQ ID NO: 5947 - protein, 9 aa, Artificial Sequence
  Serine/threonine-protein phosphatase 2A 65 kDa regulatory subunit A alpha isoform (190-198)
GEFAKVLEL

SEQ ID NO: 5948 - protein, 11 aa, Artificial Sequence
  DNA replication licensing factor MCM5 (552-562)
GEIDLAKLKKF

SEQ ID NO: 5949 - protein, 9 aa, Artificial Sequence
  Serine/threonine-protein phosphatase PP1-beta catalytic subunit (216-224)
GENDRGVSF

SEQ ID NO: 5950 - protein, 10 aa, Artificial Sequence
  HLA class I histocompatibility antigen, B-7 alpha chain (42-51)
GEPRFISVGY

SEQ ID NO: 5951 - protein, 10 aa, Artificial Sequence
  Protein SCAF11 (201-210)
GESSFTYRAY

SEQ ID NO: 5952 - protein, 9 aa, Artificial Sequence
  Rho GTPase-activating protein 21 (129-137)
GESVIGKTY

SEQ ID NO: 5953 - protein, 11 aa, Artificial Sequence
  Arfaptin-1 (19-29)
GEVDDSREHSF

SEQ ID NO: 5954 - protein, 9 aa, Artificial Sequence
  AP-2 complex subunit mu (12-20)
GEVLISRVY

SEQ ID NO: 5955 - protein, 9 aa, Artificial Sequence
  Endoplasmic reticulum-Golgi intermediate compartment protein 3 (255-263)
GEVLRTNQF

SEQ ID NO: 5956 - protein, 10 aa, Artificial Sequence
  Proline and serine-rich protein 1 (157-166)
GIFPGTPLKK

SEQ ID NO: 5957 - protein, 10 aa, Artificial Sequence
  Ubiquitin carboxyl-terminal hydrolase 36 (460-469)
GIISSPLTGK

SEQ ID NO: 5958 - protein, 9 aa, Artificial Sequence
  Alpha-2-macroglobulin receptor-associated protein (145-153)
GLDDPRLEK

SEQ ID NO: 5959 - protein, 11 aa, Artificial Sequence
  Targeting protein for Xklp2 (12-22)
GLFQGKTPLRK

SEQ ID NO: 5960 - protein, 10 aa, Artificial Sequence
  Glutathione S-transferase kappa 1 (142-151)
GLLEKIATPK

SEQ ID NO: 5961 - protein, 9 aa, Artificial Sequence
  Kelch repeat and BTB domain-containing protein 7 (280-288)
GLLTKPIVK

SEQ ID NO: 5962 - protein, 9 aa, Artificial Sequence
  Microtubule-associated protein 4 (735-743)
GLNKKPMSL

SEQ ID NO: 5963 - protein, 9 aa, Artificial Sequence
  Epidermal growth factor receptor substrate 15-like 1 (46-54)
GLSDIILGK

SEQ ID NO: 5964 - protein, 9 aa, Artificial Sequence
  Calcium homeostasis endoplasmic reticulum protein (680-688)
GLYEFFRAK

SEQ ID NO: 5965 - protein, 9 aa, Artificial Sequence
  Cyclin-dependent kinase 9 (136-144)
GLYYIHRNK

SEQ ID NO: 5966 - protein, 10 aa, Artificial Sequence
  26S proteasome non-ATPase regulatory subunit 8 (146-155)
GSYNKVFLAK

SEQ ID NO: 5967 - protein, 9 aa, Artificial Sequence
  RNA polymerase II-associated protein 3 (188-196)
GSYSKAFAR

SEQ ID NO: 5968 - protein, 10 aa, Artificial Sequence
  Zinc finger E-box-binding homeobox 1 (190-199)
GSYSSHISSK

SEQ ID NO: 5969 - protein, 9 aa, Artificial Sequence
  Dynein light chain 1, cytoplasmic (63-71)
GSYVTHETK

SEQ ID NO: 5970 - protein, 10 aa, Artificial Sequence
  39S ribosomal protein L2, mitochondrial (222-231)
GTAIIQLPSK

SEQ ID NO: 5971 - protein, 9 aa, Artificial Sequence
  Fidgetin-like protein 1 (444-452)
GTGKTLIGK

SEQ ID NO: 5972 - protein, 9 aa, Artificial Sequence
  ATP-binding cassette sub-family F member 3 (103-111)
GTKLPGLLK

SEQ ID NO: 5973 - protein, 9 aa, Artificial Sequence
  WD repeat-containing protein 46 (390-398)
GTYQPLSTR

SEQ ID NO: 5974 - protein, 9 aa, Artificial Sequence
  Protein quaking (198-206)
GTYRDANIK

SEQ ID NO: 5975 - protein, 9 aa, Artificial Sequence
  Rho-associated protein kinase 1 (285-293)
GTYSKIMNH

SEQ ID NO: 5976 - protein, 9 aa, Artificial Sequence
  Protein phosphatase 1 regulatory subunit 7 (159-167)
GVDKLTRLK

SEQ ID NO: 5977 - protein, 9 aa, Artificial Sequence
  Profilin-1 (118-126)
GVHGGLINK

SEQ ID NO: 5978 - protein, 11 aa, Artificial Sequence
  Exosome complex component RRP40 (136-146)
GVIGQDGLLFK

SEQ ID NO: 5979 - protein, 9 aa, Artificial Sequence
  Ubiquinol-cytochrome-c reductase complex assembly factor 1 (118-126)
GVNPYILKK

SEQ ID NO: 5980 - protein, 9 aa, Artificial Sequence
  Eukaryotic translation initiation factor 3 subunit C-like protein (190-198)
GVSAATFLK

SEQ ID NO: 5981 - protein, 9 aa, Artificial Sequence
  Antizyme inhibitor 1 (319-327)
GVYGSFASK

SEQ ID NO: 5982 - protein, 10 aa, Artificial Sequence
  Nuclear pore complex protein Nup160 (105-114)
GVYVSETQNR

SEQ ID NO: 5983 - protein, 9 aa, Artificial Sequence
  Alanine-tRNA ligase, cytoplasmic (301-309)
HARTITVAL

SEQ ID NO: 5984 - protein, 9 aa, Artificial Sequence
  Transketolase (243-251)
HASDRIIAL

SEQ ID NO: 5985 - protein, 9 aa, Artificial Sequence
  Stathmin (64-72)
HEAEVLKQL

SEQ ID NO: 5986 - protein, 9 aa, Artificial Sequence
  WD repeat-containing protein 6 (315-323)
HEGEILQAF

SEQ ID NO: 5987 - protein, 11 aa, Artificial Sequence
  Carbohydrate sulfotransferase 10 (215-225)
HEIAPGIIRKY

SEQ ID NO: 5988 - protein, 9 aa, Artificial Sequence
  Nardilysin (1054-1062)
HEIEALKSF

SEQ ID NO: 5989 - protein, 8 aa, Artificial Sequence
  LanC-like protein 1 (89-96)
HGYVKQSL

SEQ ID NO: 5990 - protein, 9 aa, Artificial Sequence
  Histone H2A.V (87-95)
HIHKSLIGK

SEQ ID NO: 5991 - protein, 9 aa, Artificial Sequence
  E3 ubiquitin-protein ligase TRIP12 (1751-1759)
HLEDIVRQK

SEQ ID NO: 5992 - protein, 9 aa, Artificial Sequence
  Unconventional myosin-VI (430-438)
HLFDHVVNR

SEQ ID NO: 5993 - protein, 9 aa, Artificial Sequence
  Nardilysin (708-716)
HLISPLIQK

SEQ ID NO: 5994 - protein, 11 aa, Artificial Sequence
  Hermansky-Pudlak syndrome 5 protein (400-410)
HLKSQLDHGTY

SEQ ID NO: 5995 - protein, 9 aa, Artificial Sequence
  Integrin-linked protein kinase (248-256)
HTLEPLIPR

SEQ ID NO: 5996 - protein, 10 aa, Artificial Sequence
  Serine/threonine-protein kinase WNK1 (339-348)
HTRTPPIIHR

SEQ ID NO: 5997 - protein, 9 aa, Artificial Sequence
  Centromere protein M (122-130)
HTYQSPLLY

SEQ ID NO: 5998 - protein, 10 aa, Artificial Sequence
  T-complex protein 1 subunit epsilon (135-144)
HVIETLIGKK

SEQ ID NO: 5999 - protein, 9 aa, Artificial Sequence
  Gamma-interferon-inducible protein 16 (241-249)
HVKVLNTSL

SEQ ID NO: 6000 - protein, 9 aa, Artificial Sequence
  Ankyrin repeat family A protein 2 (113-121)
HVYTPSTTK

SEQ ID NO: 6001 - protein, 10 aa, Artificial Sequence
  Little elongation complex subunit 1 (1936-1945)
HVYVGNISKK

SEQ ID NO: 6002 - protein, 11 aa, Artificial Sequence
  Deoxynucleoside triphosphate triphosphohydrolase SAMHD1 (397-407)
IEITGAGGKKY

SEQ ID NO: 6003 - protein, 9 aa, Artificial Sequence
  Lanosterol 14-alpha demethylase (175-183)
IEKETKEYF

SEQ ID NO: 6004 - protein, 9 aa, Artificial Sequence
  NADH dehydrogenase (ubiquinone) 1 beta subcomplex subunit 4 (60-68)
IENPALLRW

SEQ ID NO: 6005 - protein, 9 aa, Artificial Sequence
  Constitutive coactivator of PPAR-gamma-like protein 1 (325-333)
IGYYSATSK

SEQ ID NO: 6006 - protein, 9 aa, Artificial Sequence
  T-complex protein 1 subunit gamma (155-163)
IINSSITTK

SEQ ID NO: 6007 - protein, 9 aa, Artificial Sequence
  TFIIH basal transcription factor complex helicase XPD subunit (533-541)
ILENIQRNK

SEQ ID NO: 6008 - protein, 9 aa, Artificial Sequence
  Thymidine kinase, cytosolic (24-32)
ILGPMFSGK

SEQ ID NO: 6009 - protein, 9 aa, Artificial Sequence
  Pre-mRNA-processing-splicing factor 8 (2105-2113)
ILPKNVLKK

SEQ ID NO: 6010 - protein, 10 aa, Artificial Sequence
  BAG35700.1 (99-108)
ILRDGITAGK

SEQ ID NO: 6011 - protein, 9 aa, Artificial Sequence
  Trifunctional purine biosynthetic protein adenosine-3 (190-198)
ILSGPFVQK

SEQ ID NO: 6012 - protein, 9 aa, Artificial Sequence
  Actin, gamma-enteric smooth muscle (150-158)
ILTERGYSF

SEQ ID NO: 6013 - protein, 9 aa, Artificial Sequence
  Ornithine decarboxylase (218-226)
ILYDHAHVK

SEQ ID NO: 6014 - protein, 9 aa, Artificial Sequence
  Peroxiredoxin-6 (147-155)
ILYPATTGR

SEQ ID NO: 6015 - protein, 9 aa, Artificial Sequence
  LYR motif-containing protein 1 (79-87)
IPYPRPIHL

SEQ ID NO: 6016 - protein, 9 aa, Artificial Sequence
  SWI/SNF complex subunit SMARCC2 (39-47)
IQAEPPTNK

SEQ ID NO: 6017 - protein, 10 aa, Artificial Sequence
  Lysine-specific histone demethylase 1B (637-646)
IQFNPPLSEK

SEQ ID NO: 6018 - protein, 9 aa, Artificial Sequence
  Induced myeloid leukemia cell differentiation protein Mcl-1 (115-123)
ISFGAFVAK

SEQ ID NO: 6019 - protein, 9 aa, Artificial Sequence
  3-hydroxy-3-methylglutaryl-coenzyme A reductase (354-362)
ITSPVVTQK

SEQ ID NO: 6020 - protein, 9 aa, Artificial Sequence
  Pre-mRNA-processing factor 40 homolog A (229-237)
IVAGSLITK

SEQ ID NO: 6021 - protein, 9 aa, Artificial Sequence
  V-type proton ATPase 16 kDa proteolipid subunit (147-155)
IVALILSTK

SEQ ID NO: 6022 - protein, 9 aa, Artificial Sequence
  HLA class II histocompatibility antigen, DP alpha 1 chain (238-246)
IVGTVLIIK

SEQ ID NO: 6023 - protein, 11 aa, Artificial Sequence
  ATP synthase subunit g, mitochondrial (56-66)
IVNSAQTGSFK

SEQ ID NO: 6024 - protein, 10 aa, Artificial Sequence
  Interferon regulatory factor 9 (119-128)
IVSGQPGTQK

SEQ ID NO: 6025 - protein, 10 aa, Artificial Sequence
  Cleavage and polyadenylation specificity factor subunit 2 (17-26)
IVYAVDFNHK

SEQ ID NO: 6026 - protein, 9 aa, Artificial Sequence
  Serine palmitoyltransferase 2 (237-245)
IVYGQPRTR

SEQ ID NO: 6027 - protein, 9 aa, Artificial Sequence
  Sentrin-specific protease 6 (648-656)
IVYPPPPAK

SEQ ID NO: 6028 - protein, 10 aa, Artificial Sequence
  Elongation factor 1-gamma (428-437)
KAFNQGKIFK

SEQ ID NO: 6029 - protein, 9 aa, Artificial Sequence
  Tyrosine-protein kinase BAZ1B (885-893)
KAFQEGIAK

SEQ ID NO: 6030 - protein, 10 aa, Artificial Sequence
  Zinc finger CCCH domain-containing protein 4 (890-899)
KAKEPPFVRK

SEQ ID NO: 6031 - protein, 9 aa, Artificial Sequence
  Squalene monooxygenase (318-326)
KANHAELIL

SEQ ID NO: 6032 - protein, 9 aa, Artificial Sequence
  RNA cytidine acetyltransferase (367-375)
KASEVFLQR

SEQ ID NO: 6033 - protein, 9 aa, Artificial Sequence
  Ribonuclease inhibitor (226-234)
KASLRELAL

SEQ ID NO: 6034 - protein, 9 aa, Artificial Sequence
  UDP-glucose:glycoprotein glucosyltransferase 2 (5-13)
KATNVVRLL

SEQ ID NO: 6035 - protein, 9 aa, Artificial Sequence
  Bifunctional apoptosis regulator (261-269)
KAVNPGRSL

SEQ ID NO: 6036 - protein, 9 aa, Artificial Sequence
  SWI/SNF-related matrix-associated actin-dependent regulator of chromatin subfamily E member 1 (113-121)
KAYHNSPAY

SEQ ID NO: 6037 - protein, 9 aa, Artificial Sequence
  Zinc finger protein 302 (72-80)
KAYPFPLSH

SEQ ID NO: 6038 - protein, 9 aa, Artificial Sequence
  Phosphatidylinositol 4-phosphate 5-kinase type-1 alpha (187-195)
KEAEFLQKL

SEQ ID NO: 6039 - protein, 11 aa, Artificial Sequence
  Transmembrane emp24 domain-containing protein 10 (87-97)
KEDATKGKFAF

SEQ ID NO: 6040 - protein, 9 aa, Artificial Sequence
  COP9 signalosome complex subunit 6 (78-86)
KEEQFKQVF

SEQ ID NO: 6041 - protein, 9 aa, Artificial Sequence
  Septin-7 (100-108)
KEGGVQLLL

SEQ ID NO: 6042 - protein, 10 aa, Artificial Sequence
  Phosphatidylinositol-binding clathrin assembly protein (231-240)
KEGLDIYKKF

SEQ ID NO: 6043 - protein, 11 aa, Artificial Sequence
  Adenosylhomocysteinase 2 (20-30)
KEIEDAEKYSF

SEQ ID NO: 6044 - protein, 9 aa, Artificial Sequence
  Heat shock protein HSP 90-alpha A2 (41-49)
KEIFLRELI

SEQ ID NO: 6045 - protein, 10 aa, Artificial Sequence
  Putative homeodomain transcription factor 2 (737-746)
KELDSPFRLY

SEQ ID NO: 6046 - protein, 10 aa, Artificial Sequence
  DnaJ homolog subfamily B member 14 (282-291)
KELERLTSLY

SEQ ID NO: 6047 - protein, 9 aa, Artificial Sequence
  Ezrin (61-69)
KENPLQFKF

SEQ ID NO: 6048 - protein, 10 aa, Artificial Sequence
  Integrator complex subunit 11 (493-502)
KEQETALRVY

SEQ ID NO: 6049 - protein, 9 aa, Artificial Sequence
  Hypoxia-inducible factor 1-alpha (32-40)
KESEVFYEL

SEQ ID NO: 6050 - protein, 9 aa, Artificial Sequence
  Moesin (72-80)
KESPLLFKF

SEQ ID NO: 6051 - protein, 9 aa, Artificial Sequence
  Transcription elongation factor B polypeptide 2 (19-27)
KESSTVFEL

SEQ ID NO: 6052 - protein, 9 aa, Artificial Sequence
  CCAAT/enhancer-binding protein zeta (652-660)
KETEIVKKL

SEQ ID NO: 6053 - protein, 9 aa, Artificial Sequence
  Small kinetochore-associated protein (78-86)
KEVDVSKQL

SEQ ID NO: 6054 - protein, 9 aa, Artificial Sequence
  RANBP2-like and GRIP domain-containing protein 1 (31-39)
KEYDLAKKY

SEQ ID NO: 6055 - protein, 9 aa, Artificial Sequence
  Mitochondrial fission 1 protein (85-93)
KEYEKALKY

SEQ ID NO: 6056 - protein, 9 aa, Artificial Sequence
  Spliceosome RNA helicase DDX39B (131-139)
KEYERFSKY

SEQ ID NO: 6057 - protein, 9 aa, Artificial Sequence
  Activating signal cointegrator 1 complex subunit 2 (170-178)
KGNSPLLQK

SEQ ID NO: 6058 - protein, 9 aa, Artificial Sequence
  Fibroblast growth factor receptor 1 (669-677)
KIADFGLAR

SEQ ID NO: 6059 - protein, 10 aa, Artificial Sequence
  Kinetochore protein Nuf2 (447-456)
KIDEKTAELK

SEQ ID NO: 6060 - protein, 9 aa, Artificial Sequence
  60S ribosomal protein L7-like 1 (114-122)
KIFSGVFVK

SEQ ID NO: 6061 - protein, 9 aa, Artificial Sequence
  Tyrosine-protein kinase JAK2 (842-850)
KIGDFGLTK

SEQ ID NO: 6062 - protein, 9 aa, Artificial Sequence
  Replication factor C subunit 1 (306-314)
KIGEVSSPK

SEQ ID NO: 6063 - protein, 9 aa, Artificial Sequence
  Replication factor C subunit 2 (176-184)
KIIEPIQSR

SEQ ID NO: 6064 - protein, 10 aa, Artificial Sequence
  T-complex protein 1 subunit eta (48-57)
KIKEIAVTVK

SEQ ID NO: 6065 - protein, 9 aa, Artificial Sequence
  40S ribosomal protein S18 (78-86)
KIPDWFLNR

SEQ ID NO: 6066 - protein, 9 aa, Artificial Sequence
  SAGA-associated factor 29 (50-58)
KISPYYRTK

SEQ ID NO: 6067 - protein, 9 aa, Artificial Sequence
  B-cell linker protein (6-14)
KITVPASQK

SEQ ID NO: 6068 - protein, 10 aa, Artificial Sequence
  COMM domain-containing protein 2 (42-51)
KIYEGAARKL

SEQ ID NO: 6069 - protein, 8 aa, Artificial Sequence
  SWI/SNF-related matrix-associated actin-dependent regulator of chromatin subfamily A member 5 (411-418)
KIYVGLSK

SEQ ID NO: 6070 - protein, 9 aa, Artificial Sequence
  Cyclin-dependent kinase 4 (81-89)
KLADFGLAR

SEQ ID NO: 6071 - protein, 9 aa, Artificial Sequence
  DNA-dependent protein kinase catalytic subunit (1617-1625)
KLATTILQH

SEQ ID NO: 6072 - protein, 9 aa, Artificial Sequence
  Myc proto-oncogene protein (341-349)
KLDSVRVLR

SEQ ID NO: 6073 - protein, 11 aa, Artificial Sequence
  Translationally-controlled tumor protein (102-112)
KLEEQRPERVK

SEQ ID NO: 6074 - protein, 11 aa, Artificial Sequence
  Cleavage stimulation factor subunit 1 (198-208)
KLFDYSKPSAK

SEQ ID NO: 6075 - protein, 9 aa, Artificial Sequence
  Baculoviral IAP repeat-containing protein 2 (45-53)
KLGDSPIQK

SEQ ID NO: 6076 - protein, 9 aa, Artificial Sequence
  Nucleolar protein 58 (93-101)
KLGGVIKEK

SEQ ID NO: 6077 - protein, 10 aa, Artificial Sequence
  Serine/threonine-protein kinase Chk1 (461-470)
KLIDIVSSQK

SEQ ID NO: 6078 - protein, 9 aa, Artificial Sequence
  SHC SH2 domain-binding protein 1 (262-270)
KLIENPLLR

SEQ ID NO: 6079 - protein, 11 aa, Artificial Sequence
  40S ribosomal protein S9 (30-40)
KLIGEYGLRNK

SEQ ID NO: 6080 - protein, 11 aa, Artificial Sequence
  60S ribosomal protein L19 (24-34)
KLIKDGLIIRK

SEQ ID NO: 6081 - protein, 11 aa, Artificial Sequence
  Myc proto-oncogene protein (413-423)
KLISEEDLLRK

SEQ ID NO: 6082 - protein, 10 aa, Artificial Sequence
  60S ribosomal protein L4 (173-182)
KLKAWNDIKK

SEQ ID NO: 6083 - protein, 9 aa, Artificial Sequence
  Galactosylgalactosylxylosylprotein 3-beta-glucuronosyltransferase 3 (4-12)
KLKNVFLAY

SEQ ID NO: 6084 - protein, 9 aa, Artificial Sequence
  BRISC and BRCA1-A complex member 1 (297-305)
KLLAHPLQR

SEQ ID NO: 6085 - protein, 10 aa, Artificial Sequence
  SWI/SNF-related matrix-associated actin-dependent regulator of chromatin subfamily D member 3 (176-185)
KLLDDPSKQK

SEQ ID NO: 6086 - protein, 9 aa, Artificial Sequence
  Tyrosine-tRNA ligase, cytoplasmic (319-327)
KLLDPIREK

SEQ ID NO: 6087 - protein, 11 aa, Artificial Sequence
  T-complex protein 1 subunit eta (55-65)
KLLDVVHPAAK

SEQ ID NO: 6088 - protein, 11 aa, Artificial Sequence
  40S ribosomal protein S16 (49-59)
KLLEPVLLLGK

SEQ ID NO: 6089 - protein, 9 aa, Artificial Sequence
  Prefoldin subunit 6 (58-66)
KLLGPVLVK

SEQ ID NO: 6090 - protein, 10 aa, Artificial Sequence
  Nucleolar protein 7 (112-121)
KLLPDTILEK

SEQ ID NO: 6091 - protein, 9 aa, Artificial Sequence
  Target of rapamycin complex 2 subunit MAPKAP1 (222-230)
KLNDNVSAY

SEQ ID NO: 6092 - protein, 9 aa, Artificial Sequence
  116 kDa U5 small nuclear ribonucleoprotein component (409-417)
KLNIRPLLR

SEQ ID NO: 6093 - protein, 10 aa, Artificial Sequence
  60S ribosomal protein L4 (327-336)
KLNPYAKTMR

SEQ ID NO: 6094 - protein, 9 aa, Artificial Sequence
  Activator of 90 kDa heat shock protein ATPase homolog 1 (10-18)
KLNWTGTSK

SEQ ID NO: 6095 - protein, 9 aa, Artificial Sequence
  U5 small nuclear ribonucleoprotein 200 kDa helicase (885-893)
KLPEEVVKK

SEQ ID NO: 6096 - protein, 9 aa, Artificial Sequence
  Class E basic helix-loop-helix protein 40 (51-59)
KLPHRLIEK

SEQ ID NO: 6097 - protein, 10 aa, Artificial Sequence
  60S ribosomal protein L27a (116-125)
KLPKQPVIVK

SEQ ID NO: 6098 - protein, 10 aa, Artificial Sequence
  Hematopoietic SH2 domain-containing protein  (6-15)
KLPLPLPPRL

SEQ ID NO: 6099 - protein, 9 aa, Artificial Sequence
  EH domain-containing protein 1 (475-483)
KLPNTVLGK

SEQ ID NO: 6100 - protein, 9 aa, Artificial Sequence
  Protein SET (75-83)
KLRQPFFQK

SEQ ID NO: 6101 - protein, 9 aa, Artificial Sequence
  Phosphatidylethanolamine-binding protein 1 (88-96)
KLYEQLSGK

SEQ ID NO: 6102 - protein, 9 aa, Artificial Sequence
  Cilia- and flagella-associated protein 20 (182-190)
KLYLPVQNK

SEQ ID NO: 6103 - protein, 9 aa, Artificial Sequence
  Polyribonucleotide 5'-hydroxyl-kinase Clp1 (198-206)
KLYNKITSR

SEQ ID NO: 6104 - protein, 9 aa, Artificial Sequence
  DnaJ homolog subfamily B member 14 (36-44)
KLYPLPSAR

SEQ ID NO: 6105 - protein, 9 aa, Artificial Sequence
  Elongator complex protein 3 (316-324)
KLYPTLVIR

SEQ ID NO: 6106 - protein, 11 aa, Artificial Sequence
  Nodal modulator 2 (57-67)
KLYTKHGTLKY

SEQ ID NO: 6107 - protein, 10 aa, Artificial Sequence
  Midasin (592-601)
KMAEVIGSKL

SEQ ID NO: 6108 - protein, 9 aa, Artificial Sequence
  BCL-6 corepressor (460-468)
KMAPTVLVH

SEQ ID NO: 6109 - protein, 9 aa, Artificial Sequence
  Low density lipoprotein receptor adapter protein 1 (123-131)
KMHDKVFAY

SEQ ID NO: 6110 - protein, 11 aa, Artificial Sequence
  Protein FAM136A (128-138)
KMKEALLSIGK

SEQ ID NO: 6111 - protein, 9 aa, Artificial Sequence
  Protein LAP2 (174-182)
KMLPKTMNR

SEQ ID NO: 6112 - protein, 11 aa, Artificial Sequence
  Selenoprotein T (32-42)
KMQYATGPLLK

SEQ ID NO: 6113 - protein, 9 aa, Artificial Sequence
  Enhancer of rudimentary homolog (34-42)
KMYEEHLKR

SEQ ID NO: 6114 - protein, 10 aa, Artificial Sequence
  cAMP-dependent protein kinase catalytic subunit beta (71-80)
KQIEHTLNEK

SEQ ID NO: 6115 - protein, 10 aa, Artificial Sequence
  Pumilio homolog 3 (310-319)
KQILTPMAQK

SEQ ID NO: 6116 - protein, 11 aa, Artificial Sequence
  Small EDRK-rich factor 2 (37-47)
KQRDSEIMQQK

SEQ ID NO: 6117 - protein, 11 aa, Artificial Sequence
  T-complex protein 1 subunit theta (98-108)
KQYGNEVFLAK

SEQ ID NO: 6118 - protein, 9 aa, Artificial Sequence
  60S ribosomal protein L10a (47-55)
KRFSGTVRL

SEQ ID NO: 6119 - protein, 9 aa, Artificial Sequence
  A-kinase anchor protein 13 (266-274)
KRQEVIYEL

SEQ ID NO: 6120 - protein, 9 aa, Artificial Sequence
  DNA replication licensing factor MCM4 (216-224)
KSFDKNLYR

SEQ ID NO: 6121 - protein, 10 aa, Artificial Sequence
  Renin receptor (255-264)
KSFDTSLIRK

SEQ ID NO: 6122 - protein, 9 aa, Artificial Sequence
  Chromosome alignment-maintaining phosphoprotein 1 (334-342)
KSGPPELRK

SEQ ID NO: 6123 - protein, 9 aa, Artificial Sequence
  Aurora kinase B (125-133)
KSHFIVALK

SEQ ID NO: 6124 - protein, 10 aa, Artificial Sequence
  Cytoplasmic FMR1-interacting protein 2 (777-786)
KSLDQAISRF

SEQ ID NO: 6125 - protein, 10 aa, Artificial Sequence
  WD repeat-containing protein 36 (360-369)
KSLGHGLINK

SEQ ID NO: 6126 - protein, 9 aa, Artificial Sequence
  Mediator of RNA polymerase II transcription subunit 27 (195-203)
KSNYQVFQK

SEQ ID NO: 6127 - protein, 9 aa, Artificial Sequence
  Transport and Golgi organization protein 6 homolog (711-719)
KSSDFAVLK

SEQ ID NO: 6128 - protein, 9 aa, Artificial Sequence
  Histone H3.3 (57-65)
KSTELLIRK

SEQ ID NO: 6129 - protein, 9 aa, Artificial Sequence
  Nucleolar protein 7 (170-178)
KSYLAVRLK

SEQ ID NO: 6130 - protein, 9 aa, Artificial Sequence
  116 kDa U5 small nuclear ribonucleoprotein component (612-620)
KSYPSLTTK

SEQ ID NO: 6131 - protein, 10 aa, Artificial Sequence
  Pre-mRNA-processing-splicing factor 8 (1792-1801)
KTFEGNLTTK

SEQ ID NO: 6132 - protein, 9 aa, Artificial Sequence
  Zinc finger and BTB domain-containing protein 40 (1053-1061)
KTFPNTIEH

SEQ ID NO: 6133 - protein, 9 aa, Artificial Sequence
  Protein FAM3C (112-120)
KTGEVLDTK

SEQ ID NO: 6134 - protein, 10 aa, Artificial Sequence
  Pseudouridylate synthase 7 homolog (77-86)
KTKDPTAALR

SEQ ID NO: 6135 - protein, 10 aa, Artificial Sequence
  60S ribosomal protein L4 (163-172)
KTKEAVLLLK

SEQ ID NO: 6136 - protein, 10 aa, Artificial Sequence
  Cyclin-dependent kinase 11A (11-20)
KTLDEILQEK

SEQ ID NO: 6137 - protein, 11 aa, Artificial Sequence
  RNA cytidine acetyltransferase (184-194)
KTLDQAKAVLK

SEQ ID NO: 6138 - protein, 9 aa, Artificial Sequence
  Huntingtin (1402-1410)
KTNLTSVTK

SEQ ID NO: 6139 - protein, 9 aa, Artificial Sequence
  Actin-related protein 2/3 complex subunit 2 (214-222)
KTSDFLKVL

SEQ ID NO: 6140 - protein, 9 aa, Artificial Sequence
  Cyclin-dependent kinase 11B (551-559)
KTSNLLLSH

SEQ ID NO: 6141 - protein, 9 aa, Artificial Sequence
  26S proteasome non-ATPase regulatory subunit 1 (302-310)
KTSSAFVGK

SEQ ID NO: 6142 - protein, 9 aa, Artificial Sequence
  Zinc finger FYVE domain-containing protein 16 (1328-1336)
KTSSGFLAK

SEQ ID NO: 6143 - protein, 11 aa, Artificial Sequence
  Cyclic AMP-dependent transcription factor ATF-6 beta (655-665)
KTSTVPPSLRK

SEQ ID NO: 6144 - protein, 9 aa, Artificial Sequence
  Bridging integrator 3 (67-75)
KTVIEPLKK

SEQ ID NO: 6145 - protein, 10 aa, Artificial Sequence
  DNA damage-binding protein 1 (191-200)
KTYEVSLREK

SEQ ID NO: 6146 - protein, 11 aa, Artificial Sequence
  26S proteasome non-ATPase regulatory subunit 11 (175-185)
KTYHALSNLPK

SEQ ID NO: 6147 - protein, 11 aa, Artificial Sequence
  High mobility group protein B1 (76-86)
KTYIPPKGETK

SEQ ID NO: 6148 - protein, 11 aa, Artificial Sequence
  DNA-directed RNA polymerase II subunit RPB1 (697-707)
KTYQDIQNTIK

SEQ ID NO: 6149 - protein, 9 aa, Artificial Sequence
  Interferon-induced, double-stranded RNA-activated protein kinase (291-299)
KTYVIKRVK

SEQ ID NO: 6150 - protein, 9 aa, Artificial Sequence
  T-complex protein 1 subunit theta (296-304)
KVADMALHY

SEQ ID NO: 6151 - protein, 10 aa, Artificial Sequence
  RNA-binding protein 43 (71-80)
KVAENVIRQK

SEQ ID NO: 6152 - protein, 9 aa, Artificial Sequence
  Serine/threonine-protein kinase Chk2 (245-253)
KVAIKIISK

SEQ ID NO: 6153 - protein, 10 aa, Artificial Sequence
  60S ribosomal protein L7a (11-20)
KVAPAPAVVK

SEQ ID NO: 6154 - protein, 11 aa, Artificial Sequence
  60S ribosomal protein L7a (11-21)
KVAPAPAVVKK

SEQ ID NO: 6155 - protein, 10 aa, Artificial Sequence
  Heat shock cognate 71 kDa protein (601-610)
KVCNPIITKL

SEQ ID NO: 6156 - protein, 10 aa, Artificial Sequence
  60S ribosomal protein L13a (103-112)
KVFDGIPPPY

SEQ ID NO: 6157 - protein, 10 aa, Artificial Sequence
  GMP synthase (glutamine-hydrolyzing) (207-216)
KVFGGTVHKK

SEQ ID NO: 6158 - protein, 9 aa, Artificial Sequence
  Cytoskeleton-associated protein 5 (96-104)
KVFNQPKAK

SEQ ID NO: 6159 - protein, 10 aa, Artificial Sequence
  Thioredoxin (64-73)
KVGEFSGANK

SEQ ID NO: 6160 - protein, 9 aa, Artificial Sequence
  28S ribosomal protein S17, mitochondrial (90-98)
KVIDPVTGK

SEQ ID NO: 6161 - protein, 9 aa, Artificial Sequence
  Serine hydroxymethyltransferase, mitochondrial (238-246)
KVIPSPFKH

SEQ ID NO: 6162 - protein, 10 aa, Artificial Sequence
  Structural maintenance of chromosomes protein 4 (512-521)
KVLDAIIQEK

SEQ ID NO: 6163 - protein, 10 aa, Artificial Sequence
  Eukaryotic translation initiation factor 3 subunit L (292-301)
KVLENIELNK

SEQ ID NO: 6164 - protein, 11 aa, Artificial Sequence
  G2/mitotic-specific cyclin-B2 (318-328)
KVLGQGKWNLK

SEQ ID NO: 6165 - protein, 9 aa, Artificial Sequence
  Tryptophan-tRNA ligase, mitochondrial (333-341)
KVLQIGSAK

SEQ ID NO: 6166 - protein, 10 aa, Artificial Sequence
  Septin-7 (185-194)
KVNIIPLIAK

SEQ ID NO: 6167 - protein, 10 aa, Artificial Sequence
  Septin-2 (174-183)
KVNIVPVIAK

SEQ ID NO: 6168 - protein, 9 aa, Artificial Sequence
  Transferrin receptor protein 1 (495-503)
KVSASPLLY

SEQ ID NO: 6169 - protein, 9 aa, Artificial Sequence
  B-lymphocyte antigen CD19 (291-299)
KVSAVTLAY

SEQ ID NO: 6170 - protein, 9 aa, Artificial Sequence
  Astrotactin-2 (149-157)
KVSDYILQH

SEQ ID NO: 6171 - protein, 9 aa, Artificial Sequence
  Thioredoxin-related transmembrane protein 2 (207-215)
KVSTSPLTK

SEQ ID NO: 6172 - protein, 10 aa, Artificial Sequence
  Rab GDP dissociation inhibitor beta (23-32)
KVTEGSFVYK

SEQ ID NO: 6173 - protein, 9 aa, Artificial Sequence
  Unconventional myosin-Id (707-715)
KVWRGTLAR

SEQ ID NO: 6174 - protein, 9 aa, Artificial Sequence
  Nipped-B-like protein (52-60)
KVYDKAINR

SEQ ID NO: 6175 - protein, 11 aa, Artificial Sequence
  78 kDa glucose-regulated protein (446-456)
KVYEGERPLTK

SEQ ID NO: 6176 - protein, 9 aa, Artificial Sequence
  Eukaryotic translation initiation factor 3 subunit L (70-78)
KVYELQASR

SEQ ID NO: 6177 - protein, 9 aa, Artificial Sequence
  E3 ubiquitin-protein ligase RAD18 (115-123)
KVYTPVASR

SEQ ID NO: 6178 - protein, 10 aa, Artificial Sequence
  Motile sperm domain-containing protein 2 (172-181)
KVYYPKYLSK

SEQ ID NO: 6179 - protein, 10 aa, Artificial Sequence
  Ubiquitin-associated protein 2-like (87-96)
LEGNPDTHSW

SEQ ID NO: 6180 - protein, 9 aa, Artificial Sequence
  Microtubule-associated protein RP/EB family member 1 (67-75)
LEHEYIQNF

SEQ ID NO: 6181 - protein, 8 aa, Artificial Sequence
  Hyaluronan mediated motility receptor (121-128)
LEKQLIEL

SEQ ID NO: 6182 - protein, 10 aa, Artificial Sequence
  DNA replication licensing factor MCM2 (790-799)
LESFIDTQKF

SEQ ID NO: 6183 - protein, 10 aa, Artificial Sequence
  Guanine nucleotide-binding protein G(s) subunit alpha isoforms short (286-295)
LLAEKVLAGK

SEQ ID NO: 6184 - protein, 11 aa, Artificial Sequence
  Eukaryotic translation initiation factor 3 subunit C-like protein (634-644)
LLDIQSSGRAK

SEQ ID NO: 6185 - protein, 9 aa, Artificial Sequence
  Prelamin-A/C (140-148)
LLNSKEAAL

SEQ ID NO: 6186 - protein, 11 aa, Artificial Sequence
  T-complex protein 1 subunit beta (109-119)
LLREAESLIAK

SEQ ID NO: 6187 - protein, 11 aa, Artificial Sequence
  Methionine synthase reductase (6-16)
LLYATQQGQAK

SEQ ID NO: 6188 - protein, 10 aa, Artificial Sequence
  Replication factor C subunit 5 (57-66)
LLYGPPGTGK

SEQ ID NO: 6189 - protein, 9 aa, Artificial Sequence
  Leucine-rich repeat-containing protein 58 (83-91)
LPHNRLVSL

SEQ ID NO: 6190 - protein, 9 aa, Artificial Sequence
  Ribosomal RNA processing protein 1 homolog B (585-593)
LPSQKTASL

SEQ ID NO: 6191 - protein, 9 aa, Artificial Sequence
  Proteasome assembly chaperone 2 (40-48)
LPSRKLVAL

SEQ ID NO: 6192 - protein, 9 aa, Artificial Sequence
  Squalene monooxygenase (548-556)
LSSGAVLYK

SEQ ID NO: 6193 - protein, 9 aa, Artificial Sequence
  Neuroguidin (201-209)
LSSSVIREL

SEQ ID NO: 6194 - protein, 9 aa, Artificial Sequence
  60S ribosomal protein L34 (11-19)
LSYNTASNK

SEQ ID NO: 6195 - protein, 10 aa, Artificial Sequence
  Importin subunit alpha-1 (344-353)
LTNPKTNIQK

SEQ ID NO: 6196 - protein, 10 aa, Artificial Sequence
  40S ribosomal protein S7 (131-140)
LVFPSEIVGK

SEQ ID NO: 6197 - protein, 9 aa, Artificial Sequence
  Filamin-A (1766-1774)
LVIPFTIKK

SEQ ID NO: 6198 - protein, 9 aa, Artificial Sequence
  PRELI domain containing protein 3B (186-194)
MAAAAFAEK

SEQ ID NO: 6199 - protein, 9 aa, Artificial Sequence
  Cyclin-T1 (410-418)
MEANVKSQY

SEQ ID NO: 6200 - protein, 9 aa, Artificial Sequence
  Transformation/transcription domain-associated protein (1736-1744)
MEEEIPKNY

SEQ ID NO: 6201 - protein, 9 aa, Artificial Sequence
  Nucleolar protein 58 (64-72)
MEGKINKQL

SEQ ID NO: 6202 - protein, 9 aa, Artificial Sequence
  Ribonucleoside-diphosphate reductase subunit M2 (228-236)
MENIHSEMY

SEQ ID NO: 6203 - protein, 10 aa, Artificial Sequence
  Dolichyl-diphosphooligosaccharide-proteinosyltransferase 48 kDa subunit (18-27)
MEPSTAARAW

SEQ ID NO: 6204 - protein, 11 aa, Artificial Sequence
  Large proline-rich protein BAG6 (929-939)
MPVGPDAILRY

SEQ ID NO: 6205 - protein, 9 aa, Artificial Sequence
  60S ribosomal protein L26 (30-38)
MSSPLSKEL

SEQ ID NO: 6206 - protein, 9 aa, Artificial Sequence
  Histone deacetylase 1 (37-45)
MTHNLLLNY

SEQ ID NO: 6207 - protein, 9 aa, Artificial Sequence
  Myosin-7B (138-146)
NEASVLHNL

SEQ ID NO: 6208 - protein, 9 aa, Artificial Sequence
  DnaJ homolog subfamily B member 5 (16-24)
NEDEIKKAY

SEQ ID NO: 6209 - protein, 9 aa, Artificial Sequence
  Nuclear factor interleukin-3-regulated protein (343-351)
NEFEATQKL

SEQ ID NO: 6210 - protein, 9 aa, Artificial Sequence
  Ras-related protein Rab-7a (184-192)
NEFPEPIKL

SEQ ID NO: 6211 - protein, 10 aa, Artificial Sequence
  Kinetochore protein NDC80 homolog (555-564)
NELDAVQREY

SEQ ID NO: 6212 - protein, 9 aa, Artificial Sequence
  Putative eukaryotic translation initiation factor 2 subunit 3-like protein (71-79)
NELERNITI

SEQ ID NO: 6213 - protein, 9 aa, Artificial Sequence
  Fizzy-related protein homolog (412-420)
NELVSTHGY

SEQ ID NO: 6214 - protein, 9 aa, Artificial Sequence
  Mediator of RNA polymerase II transcription subunit 23 (148-156)
NENDIITHF

SEQ ID NO: 6215 - protein, 9 aa, Artificial Sequence
  CUGBP Elav-like family member 2 (120-128)
NENDIRVMF

SEQ ID NO: 6216 - protein, 9 aa, Artificial Sequence
  Serine/threonine-protein kinase PAK 2 (445-453)
NENPLRALY

SEQ ID NO: 6217 - protein, 9 aa, Artificial Sequence
  Serine/threonine/tyrosine-interacting-like protein 1 (124-132)
NEQTLQRSW

SEQ ID NO: 6218 - protein, 9 aa, Artificial Sequence
  Monocarboxylate transporter 7 (57-65)
NESNSRISW

SEQ ID NO: 6219 - protein, 9 aa, Artificial Sequence
  Oxysterol-binding protein-related protein 9 (671-679)
NEYESRSLW

SEQ ID NO: 6220 - protein, 9 aa, Artificial Sequence
  DnaJ homolog subfamily A member 1 (120-128)
NGATRKLAL

SEQ ID NO: 6221 - protein, 9 aa, Artificial Sequence
  Lysine-specific histone demethylase 1A (474-482)
NLKEKIKEL

SEQ ID NO: 6222 - protein, 9 aa, Artificial Sequence
  Histone-binding protein RBBP4 (245-253)
NLKLKLHSF

SEQ ID NO: 6223 - protein, 9 aa, Artificial Sequence
  AP-3 complex subunit delta-1 (372-380)
NLMEIVKKL

SEQ ID NO: 6224 - protein, 8 aa, Artificial Sequence
  Serine/threonine-protein phosphatase 2A 65 kDa regulatory subunit A beta isoform isoform b (350-357)
NQHVKSAL

SEQ ID NO: 6225 - protein, 9 aa, Artificial Sequence
  Copine-8 (263-271)
NVYEVVNPK

SEQ ID NO: 6226 - protein, 10 aa, Artificial Sequence
  Polypyrimidine tract-binding protein 1 (440-449)
QEDQGLTKDY

SEQ ID NO: 6227 - protein, 10 aa, Artificial Sequence
  Forkhead box protein K2 (318-327)
QEEPGKGSFW

SEQ ID NO: 6228 - protein, 11 aa, Artificial Sequence
  RNA polymerase II subunit A C-terminal domain phosphatase SSU72 (177-187)
QEFEEKSGRTF

SEQ ID NO: 6229 - protein, 9 aa, Artificial Sequence
  Alpha-galactosidase A (357-365)
QEIGGPRSY

SEQ ID NO: 6230 - protein, 11 aa, Artificial Sequence
  Splicing factor 3B subunit 1 (41-51)
QEIYGGSDSRF

SEQ ID NO: 6231 - protein, 10 aa, Artificial Sequence
  Translin-associated protein X (44-53)
QELDARHDKY

SEQ ID NO: 6232 - protein, 9 aa, Artificial Sequence
  Mis18-binding protein 1 (582-590)
QELIGKKEY

SEQ ID NO: 6233 - protein, 10 aa, Artificial Sequence
  Desmin (113-122)
QELNDRFANY

SEQ ID NO: 6234 - protein, 10 aa, Artificial Sequence
  DNA-(apurinic or apyrimidinic site) lyase (109-118)
QELPGLSHQY

SEQ ID NO: 6235 - protein, 10 aa, Artificial Sequence
  Protein phosphatase 1G (202-211)
QENGPTAKAY

SEQ ID NO: 6236 - protein, 9 aa, Artificial Sequence
  tRNA (cytosine(34)-C(5))-methyltransferase (545-553)
QENPFFRKL

SEQ ID NO: 6237 - protein, 9 aa, Artificial Sequence
  Condensin-2 complex subunit H2 (444-452)
QETELSQRI

SEQ ID NO: 6238 - protein, 9 aa, Artificial Sequence
  Protein C10 (28-36)
QEVIKAYGF

SEQ ID NO: 6239 - protein, 8 aa, Artificial Sequence
  60S ribosomal protein L6 (269-276)
QGYLRSVF

SEQ ID NO: 6240 - protein, 9 aa, Artificial Sequence
  Histone deacetylase 2 (240-248)
QIFKPIISK

SEQ ID NO: 6241 - protein, 9 aa, Artificial Sequence
  60S ribosomal protein L7 (116-124)
QIFNGTFVK

SEQ ID NO: 6242 - protein, 10 aa, Artificial Sequence
  Ubiquitin-60S ribosomal protein L40 (7-16)
QIFVKTLTGK

SEQ ID NO: 6243 - protein, 11 aa, Artificial Sequence
  40S ribosomal protein S16 (79-89)
QIYAIRQSISK

SEQ ID NO: 6244 - protein, 8 aa, Artificial Sequence
  60S ribosomal protein L15 (91-98)
QLKFARSL

SEQ ID NO: 6245 - protein, 9 aa, Artificial Sequence
  Cleft lip and palate transmembrane protein 1 (316-324)
QLYAAQSTK

SEQ ID NO: 6246 - protein, 9 aa, Artificial Sequence
  Myosin-9 (648-656)
QLYKEQLAK

SEQ ID NO: 6247 - protein, 9 aa, Artificial Sequence
  F-box only protein 5 (293-301)
QLYSKAIQR

SEQ ID NO: 6248 - protein, 8 aa, Artificial Sequence
  40S ribosomal protein S11 (18-25)
QNKKRVLL

SEQ ID NO: 6249 - protein, 9 aa, Artificial Sequence
  TRAF3-interacting JNK-activating modulator (38-46)
QSTQRSLAL

SEQ ID NO: 6250 - protein, 9 aa, Artificial Sequence
  U5 small nuclear ribonucleoprotein 200 kDa helicase (438-446)
QTYVGITEK

SEQ ID NO: 6251 - protein, 9 aa, Artificial Sequence
  40S ribosomal protein S9 (113-121)
QVFKLGLAK

SEQ ID NO: 6252 - protein, 9 aa, Artificial Sequence
  Eukaryotic translation initiation factor 3 subunit E (354-362)
QVIEKTKSL

SEQ ID NO: 6253 - protein, 9 aa, Artificial Sequence
  TCF3 fusion partner (94-102)
QVNERVLNR

SEQ ID NO: 6254 - protein, 9 aa, Artificial Sequence
  Inorganic pyrophosphatase (9-17)
RAAPFSLEY

SEQ ID NO: 6255 - protein, 9 aa, Artificial Sequence
  ATP-dependent RNA helicase DDX19B (56-64)
RAAQSLLNK

SEQ ID NO: 6256 - protein, 9 aa, Artificial Sequence
  LBH domain-containing protein 1 (95-103)
RANITLSGK

SEQ ID NO: 6257 - protein, 9 aa, Artificial Sequence
  Midasin (1000-1008)
RASHPIVQK

SEQ ID NO: 6258 - protein, 9 aa, Artificial Sequence
  Perilipin-2 (230-238)
RAYQQALSR

SEQ ID NO: 6259 - protein, 10 aa, Artificial Sequence
  Protein VPRBP (31-40)
READQPLRTY

SEQ ID NO: 6260 - protein, 9 aa, Artificial Sequence
  Signal peptidase complex subunit 2 (185-193)
REAEFTKSI

SEQ ID NO: 6261 - protein, 9 aa, Artificial Sequence
  NADH dehydrogenase (ubiquinone) 1 beta subcomplex subunit 11, mitochondrial (120-128)
REAERLVKY

SEQ ID NO: 6262 - protein, 9 aa, Artificial Sequence
  Ubiquilin-2 (597-605)
REANLQALI

SEQ ID NO: 6263 - protein, 9 aa, Artificial Sequence
  Gamma-taxilin (154-162)
REEHIDKVF

SEQ ID NO: 6264 - protein, 10 aa, Artificial Sequence
  Nuclear receptor-binding protein (234-243)
REEQKNLHFF

SEQ ID NO: 6265 - protein, 10 aa, Artificial Sequence
  Exostosin-2 (567-576)
REFPDRLVGY

SEQ ID NO: 6266 - protein, 10 aa, Artificial Sequence
  Di-N-acetylchitobiase (169-178)
REIEGSQVTF

SEQ ID NO: 6267 - protein, 9 aa, Artificial Sequence
  Ataxin-2-like protein (324-332)
REIESSPQY

SEQ ID NO: 6268 - protein, 10 aa, Artificial Sequence
  Sorting nexin-17 (146-155)
REKEDGAFSF

SEQ ID NO: 6269 - protein, 10 aa, Artificial Sequence
  Ras-related GTP-binding protein A (97-106)
RELEKDMHYY

SEQ ID NO: 6270 - protein, 9 aa, Artificial Sequence
  Tropomyosin alpha-3 chain (7-15)
REMDEQIRL

SEQ ID NO: 6271 - protein, 10 aa, Artificial Sequence
  Tetratricopeptide repeat protein 39C (46-55)
RESDQLFKQY

SEQ ID NO: 6272 - protein, 9 aa, Artificial Sequence
  Aurora kinase A (180-188)
REVEIQSHL

SEQ ID NO: 6273 - protein, 11 aa, Artificial Sequence
  Histone H2B type 2-E (48-58)
RIAGEASRLAH

SEQ ID NO: 6274 - protein, 11 aa, Artificial Sequence
  40S ribosomal protein S19 (133-143)
RIAGQVAAANK

SEQ ID NO: 6275 - protein, 11 aa, Artificial Sequence
  60S ribosomal protein L18a (31-41)
RIFAPNHVVAK

SEQ ID NO: 6276 - protein, 9 aa, Artificial Sequence
  60S ribosomal protein L10 (32-40)
RIFDLGRKK

SEQ ID NO: 6277 - protein, 11 aa, Artificial Sequence
  Nuclear pore complex protein Nup214 (26-36)
RIFDSPEELPK

SEQ ID NO: 6278 - protein, 10 aa, Artificial Sequence
  Ribonucleoside-diphosphate reductase subunit M2 (50-59)
RIFQEPTEPK

SEQ ID NO: 6279 - protein, 9 aa, Artificial Sequence
  Unconventional myosin-Ie (627-635)
RIFQKFLQR

SEQ ID NO: 6280 - protein, 9 aa, Artificial Sequence
  Sorbitol dehydrogenase (56-64)
RIGNFIVKK

SEQ ID NO: 6281 - protein, 10 aa, Artificial Sequence
  Serine/threonine-protein kinase Nek6 (243-252)
RIHENGYNFK

SEQ ID NO: 6282 - protein, 9 aa, Artificial Sequence
  U3 small nucleolar ribonucleoprotein protein MPP10 (48-56)
RIHGSPLQK

SEQ ID NO: 6283 - protein, 9 aa, Artificial Sequence
  60S ribosomal protein L31 (32-40)
RIHGVGFKK

SEQ ID NO: 6284 - protein, 9 aa, Artificial Sequence
  Importin-8 (433-441)
RIIDLVLQK

SEQ ID NO: 6285 - protein, 9 aa, Artificial Sequence
  Replication factor C subunit 4 (185-193)
RIIEPLTSR

SEQ ID NO: 6286 - protein, 9 aa, Artificial Sequence
  Putative Polycomb group protein ASXL1 (573-581)
RIKPPWVVK

SEQ ID NO: 6287 - protein, 9 aa, Artificial Sequence
  26S proteasome non-ATPase regulatory subunit 8 (196-204)
RILFFNTPK

SEQ ID NO: 6288 - protein, 9 aa, Artificial Sequence
  60S ribosomal protein L10a (122-130)
RILGPGLNK

SEQ ID NO: 6289 - protein, 9 aa, Artificial Sequence
  40S ribosomal protein S7 (97-105)
RILPKPTRK

SEQ ID NO: 6290 - protein, 9 aa, Artificial Sequence
  40S ribosomal protein S11 (71-79)
RILSGVVTK

SEQ ID NO: 6291 - protein, 10 aa, Artificial Sequence
  Helicase-like transcription factor (514-523)
RIREPALLSK

SEQ ID NO: 6292 - protein, 11 aa, Artificial Sequence
  Heat shock 70 kDa protein 14 (56-66)
RIRNISNTVMK

SEQ ID NO: 6293 - protein, 11 aa, Artificial Sequence
  Protein PML (31-41)
RIRTGSALVQR

SEQ ID NO: 6294 - protein, 9 aa, Artificial Sequence
  DNA-directed RNA polymerases I, II, and III subunit RPABC2 (51-59)
RITTPYMTK

SEQ ID NO: 6295 - protein, 9 aa, Artificial Sequence
  Translational activator GCN1 (122-130)
RIVFPSRAK

SEQ ID NO: 6296 - protein, 9 aa, Artificial Sequence
  Zinc finger protein 195 (247-255)
RIYAGGEHY

SEQ ID NO: 6297 - protein, 11 aa, Artificial Sequence
  Fragile X mental retardation syndrome-related protein 1 (263-273)
RIYGESADAVK

SEQ ID NO: 6298 - protein, 9 aa, Artificial Sequence
  Dual specificity tyrosine-phosphorylation-regulated kinase 1A (317-325)
RIYQYIQSR

SEQ ID NO: 6299 - protein, 10 aa, Artificial Sequence
  Integrator complex subunit 1 (219-228)
RLAEAAVAEK

SEQ ID NO: 6300 - protein, 10 aa, Artificial Sequence
  RNA pseudouridylate synthase domain-containing protein 4 (45-54)
RLAEKLRAQK

SEQ ID NO: 6301 - protein, 9 aa, Artificial Sequence
  Ubiquitin carboxyl-terminal hydrolase 19 (897-905)
RLAEVIKNR

SEQ ID NO: 6302 - protein, 10 aa, Artificial Sequence
  Phosducin-like protein 3 (78-87)
RLAEWKATKL

SEQ ID NO: 6303 - protein, 11 aa, Artificial Sequence
  40S ribosomal protein S21 (71-81)
RLAKADGIVSK

SEQ ID NO: 6304 - protein, 9 aa, Artificial Sequence
  Golgi phosphoprotein 3 (176-184)
RLAKNLVEK

SEQ ID NO: 6305 - protein, 11 aa, Artificial Sequence
  60S ribosomal protein L19 (9-19)
RLASSVLRCGK

SEQ ID NO: 6306 - protein, 10 aa, Artificial Sequence
  Guanine nucleotide-binding protein G(I)/G(S)/G(O) subunit gamma-5 (18-27)
RLEAGLNRVK

SEQ ID NO: 6307 - protein, 10 aa, Artificial Sequence
  40S ribosomal protein S9 (70-79)
RLFEGNALLR

SEQ ID NO: 6308 - protein, 9 aa, Artificial Sequence
  Cartilage-associated protein (107-115)
RLFGGLLRR

SEQ ID NO: 6309 - protein, 8 aa, Artificial Sequence
  60S ribosomal protein L13 (190-197)
RLFGIRAK

SEQ ID NO: 6310 - protein, 9 aa, Artificial Sequence
  Ubiquitin-associated domain-containing protein 2 (164-172)
RLFPPLRQR

SEQ ID NO: 6311 - protein, 9 aa, Artificial Sequence
  Heterogeneous nuclear ribonucleoprotein R (146-154)
RLFVGSIPK

SEQ ID NO: 6312 - protein, 11 aa, Artificial Sequence
  Heterogeneous nuclear ribonucleoprotein Q (244-254)
RLFVGSIPKSK

SEQ ID NO: 6313 - protein, 9 aa, Artificial Sequence
  DNA damage-binding protein 1 (327-335)
RLGDSQLVK

SEQ ID NO: 6314 - protein, 9 aa, Artificial Sequence
  Semaphorin-7A (24-32)
RLGLPLRLR

SEQ ID NO: 6315 - protein, 9 aa, Artificial Sequence
  Cleavage and polyadenylation specificity factor subunit 1 (387-395)
RLGNSLLLK

SEQ ID NO: 6316 - protein, 9 aa, Artificial Sequence
  Pentatricopeptide repeat domain-containing protein 3, mitochondrial (15-23)
RLGQPLTGR

SEQ ID NO: 6317 - protein, 10 aa, Artificial Sequence
  Egl nine homolog 2 (270-279)
RLGSYVINGR

SEQ ID NO: 6318 - protein, 11 aa, Artificial Sequence
  Parkinson disease 7 domain-containing protein 1 (68-78)
RLKAYASPAKL

SEQ ID NO: 6319 - protein, 9 aa, Artificial Sequence
  Protein RRP5 homolog (385-393)
RLKDGVLAY

SEQ ID NO: 6320 - protein, 11 aa, Artificial Sequence
  Nuclear pore complex protein Nup98-Nup96 (515-525)
RLKPTNPAAQK

SEQ ID NO: 6321 - protein, 10 aa, Artificial Sequence
  HAUS augmin-like complex subunit 1 (226-235)
RLKQQTIPLK

SEQ ID NO: 6322 - protein, 11 aa, Artificial Sequence
  FERM, RhoGEF and pleckstrin domain-containing protein 2 (321-331)
RLLDQPKPKAK

SEQ ID NO: 6323 - protein, 10 aa, Artificial Sequence
  Glycogen synthase kinase-3 beta (319-328)
RLLEYTPTAR

SEQ ID NO: 6324 - protein, 11 aa, Artificial Sequence
  Nucleolar protein 56 (77-87)
RLLLETHLPSK

SEQ ID NO: 6325 - protein, 10 aa, Artificial Sequence
  Histone H2B type 2-F (100-109)
RLLLPGELAK

SEQ ID NO: 6326 - protein, 11 aa, Artificial Sequence
  Poly (ADP-ribose) polymerase 14 (858-868)
RLLPGNATISK

SEQ ID NO: 6327 - protein, 9 aa, Artificial Sequence
  BTB/POZ domain-containing protein KCTD20 (259-267)
RLNAPLSQM

SEQ ID NO: 6328 - protein, 10 aa, Artificial Sequence
  Tubulin gamma-1 chain (156-165)
RLNDRYPKKL

SEQ ID NO: 6329 - protein, 10 aa, Artificial Sequence
  LYR motif-containing protein 2 (5-14)
RLPPATLTLK

SEQ ID NO: 6330 - protein, 9 aa, Artificial Sequence
  NF-kappa-B inhibitor beta (339-347)
RLPPTPASK

SEQ ID NO: 6331 - protein, 9 aa, Artificial Sequence
  Kinesin-like protein KIF18B (390-398)
RLPSSTLKR

SEQ ID NO: 6332 - protein, 10 aa, Artificial Sequence
  Histone deacetylase 5 (529-538)
RLQETGLLSK

SEQ ID NO: 6333 - protein, 11 aa, Artificial Sequence
  Egl nine homolog 2 (218-228)
RLRDGQLVSQR

SEQ ID NO: 6334 - protein, 9 aa, Artificial Sequence
  HCLS1-associated protein X-1 (118-126)
RLREGQTLR

SEQ ID NO: 6335 - protein, 9 aa, Artificial Sequence
  AP-5 complex subunit zeta-1 (429-437)
RLSFPNLFK

SEQ ID NO: 6336 - protein, 9 aa, Artificial Sequence
  A-kinase anchor protein 11 (941-949)
RLSKSIIKH

SEQ ID NO: 6337 - protein, 10 aa, Artificial Sequence
  40S ribosomal protein S4, X isoform (202-211)
RLSNIFVIGK

SEQ ID NO: 6338 - protein, 10 aa, Artificial Sequence
  Prelamin-A/C (307-316)
RLSPSPTSQR

SEQ ID NO: 6339 - protein, 10 aa, Artificial Sequence
  60S ribosomal protein L34 (10-19)
RLSYNTASNK

SEQ ID NO: 6340 - protein, 10 aa, Artificial Sequence
  Proliferating cell nuclear antigen (5-14)
RLVQGSILKK

SEQ ID NO: 6341 - protein, 10 aa, Artificial Sequence
  E3 ubiquitin-protein ligase MARCH6 (597-606)
RLYEHIKNDK

SEQ ID NO: 6342 - protein, 9 aa, Artificial Sequence
  ATP-binding cassette sub-family D member 1 (172-180)
RLYFSQQTY

SEQ ID NO: 6343 - protein, 9 aa, Artificial Sequence
  Kelch-like protein 20 (534-542)
RLYGGMNYR

SEQ ID NO: 6344 - protein, 10 aa, Artificial Sequence
  Protein KIAA0100 (809-818)
RLYGNTPMRR

SEQ ID NO: 6345 - protein, 10 aa, Artificial Sequence
  Terminal uridylyltransferase 4 (269-278)
RLYGSSLTRF

SEQ ID NO: 6346 - protein, 11 aa, Artificial Sequence
  TNF receptor-associated factor 1 (308-318)
RLYLNGDGTGK

SEQ ID NO: 6347 - protein, 9 aa, Artificial Sequence
  DnaJ homolog subfamily B member 12 (36-44)
RLYPTPRVR

SEQ ID NO: 6348 - protein, 10 aa, Artificial Sequence
  E3 ubiquitin-protein ligase UBR5 (2771-2780)
RLYVPLYSSK

SEQ ID NO: 6349 - protein, 10 aa, Artificial Sequence
  60S ribosomal protein L4 (100-109)
RMFAPTKTWR

SEQ ID NO: 6350 - protein, 11 aa, Artificial Sequence
  DNA methyltransferase 1-associated protein 1 (326-336)
RMKLPSSVGQK

SEQ ID NO: 6351 - protein, 9 aa, Artificial Sequence
  Dolichyl-diphosphooligosaccharide-proteinosyltransferase subunit 2 (619-627)
RMLAQQAVK

SEQ ID NO: 6352 - protein, 8 aa, Artificial Sequence
  Proteasome subunit beta type-5 (80-87)
RNKERISV

SEQ ID NO: 6353 - protein, 9 aa, Artificial Sequence
  Chromosome transmission fidelity protein 8 homolog (109-117)
RPKPIITSV

SEQ ID NO: 6354 - protein, 8 aa, Artificial Sequence
  Zinc finger MIZ domain-containing protein 1 (589-596)
RPSVRSVL

SEQ ID NO: 6355 - protein, 9 aa, Artificial Sequence
  Apoptosis inhibitor 5 (189-197)
RQAVPLFSK

SEQ ID NO: 6356 - protein, 9 aa, Artificial Sequence
  39S ribosomal protein L55, mitochondrial (47-55)
RQFWTRTKK

SEQ ID NO: 6357 - protein, 9 aa, Artificial Sequence
  Phosphate carrier protein, mitochondrial (224-232)
RQIPYTMMK

SEQ ID NO: 6358 - protein, 9 aa, Artificial Sequence
  60S ribosomal protein L7a (89-97)
RQTATQLLK

SEQ ID NO: 6359 - protein, 9 aa, Artificial Sequence
  Formin-binding protein 1 (239-247)
RQVIPIIGK

SEQ ID NO: 6360 - protein, 9 aa, Artificial Sequence
  F-box only protein 33 (21-29)
RQYDKFLTH

SEQ ID NO: 6361 - protein, 9 aa, Artificial Sequence
  Protein-lysine N-methyltransferase EEF2KMT (18-26)
RRFLAARTL

SEQ ID NO: 6362 - protein, 9 aa, Artificial Sequence
  Growth factor receptor-bound protein 2 (137-145)
RRGDFIHVM

SEQ ID NO: 6363 - protein, 9 aa, Artificial Sequence
  60S ribosomal protein L23 (89-97)
RRKDGVFLY

SEQ ID NO: 6364 - protein, 9 aa, Artificial Sequence
  Neuroepithelial cell-transforming gene 1 protein (32-40)
RRQEAIYEM

SEQ ID NO: 6365 - protein, 9 aa, Artificial Sequence
  Isoleucine-tRNA ligase, cytoplasmic (402-410)
RSDTPLIYK

SEQ ID NO: 6366 - protein, 9 aa, Artificial Sequence
  Uncharacterized protein KIAA1551 (365-373)
RSLGSSPVK

SEQ ID NO: 6367 - protein, 10 aa, Artificial Sequence
  60S ribosomal protein L30 (106-115)
RSMPEQTGEK

SEQ ID NO: 6368 - protein, 9 aa, Artificial Sequence
  Structural maintenance of chromosomes protein 3 (132-140)
RSNPYYIVK

SEQ ID NO: 6369 - protein, 10 aa, Artificial Sequence
  Protein BRICK1 (44-53)
RSRLATLNEK

SEQ ID NO: 6370 - protein, 9 aa, Artificial Sequence
  Protein PRRC2C (2148-2156)
RSTDPVTTK

SEQ ID NO: 6371 - protein, 11 aa, Artificial Sequence
  Cytoskeleton-associated protein 2-like (319-329)
RSYPVTEQRVK

SEQ ID NO: 6372 - protein, 9 aa, Artificial Sequence
  Heterogeneous nuclear ribonucleoprotein F (192-200)
RSYSDPPLK

SEQ ID NO: 6373 - protein, 9 aa, Artificial Sequence
  Vimentin (28-36)
RSYVTTSTR

SEQ ID NO: 6374 - protein, 9 aa, Artificial Sequence
  Sorting and assembly machinery component 50 homolog (240-248)
RTASFAVRK

SEQ ID NO: 6375 - protein, 10 aa, Artificial Sequence
  T-complex protein 1 subunit eta (114-123)
RTATQLAVNK

SEQ ID NO: 6376 - protein, 10 aa, Artificial Sequence
  UAP56-interacting factor (226-235)
RTAVPSFLTK

SEQ ID NO: 6377 - protein, 9 aa, Artificial Sequence
  Plectin (471-479)
RTEYNLRLK

SEQ ID NO: 6378 - protein, 9 aa, Artificial Sequence
  Cyclin-dependent kinase 12 (1374-1382)
RTFSGSLSH

SEQ ID NO: 6379 - protein, 10 aa, Artificial Sequence
  Cold shock domain-containing protein E1 (78-87)
RTGKPIAVKL

SEQ ID NO: 6380 - protein, 9 aa, Artificial Sequence
  Eukaryotic translation initiation factor 4H (221-229)
RTGPPMGSR

SEQ ID NO: 6381 - protein, 10 aa, Artificial Sequence
  Eukaryotic translation initiation factor 4H (155-164)
RTGPPMGSRF

SEQ ID NO: 6382 - protein, 9 aa, Artificial Sequence
  Cell division cycle 5-like protein (83-91)
RTIAPIIGR

SEQ ID NO: 6383 - protein, 9 aa, Artificial Sequence
  Biogenesis of lysosome-related organelles complex 1 subunit 1 (106-114)
RTIATALEY

SEQ ID NO: 6384 - protein, 9 aa, Artificial Sequence
  Beta-catenin-like protein 1 (270-278)
RTIFPLFMK

SEQ ID NO: 6385 - protein, 10 aa, Artificial Sequence
  60S ribosomal protein L37a (4-13)
RTKKVGIVGK

SEQ ID NO: 6386 - protein, 10 aa, Artificial Sequence
  39S ribosomal protein L2, mitochondrial (69-78)
RTKYTITPVK

SEQ ID NO: 6387 - protein, 10 aa, Artificial Sequence
  Peroxisomal multifunctional enzyme type 2 (251-260)
RTLGAIVRQK

SEQ ID NO: 6388 - protein, 9 aa, Artificial Sequence
  Cytosolic carboxypeptidase 1 (1067-1075)
RTLPKILSH

SEQ ID NO: 6389 - protein, 10 aa, Artificial Sequence
  Ubiquitin-40S ribosomal protein S27a (74-83)
RTLSDYNIQK

SEQ ID NO: 6390 - protein, 9 aa, Artificial Sequence
  RAD50-interacting protein 1 (155-163)
RTNWPNTGK

SEQ ID NO: 6391 - protein, 11 aa, Artificial Sequence
  Dynamin-binding protein (144-154)
RTRDYASLPPK

SEQ ID NO: 6392 - protein, 9 aa, Artificial Sequence
  ATP-dependent RNA helicase DDX24 (666-674)
RTSEIYVHR

SEQ ID NO: 6393 - protein, 9 aa, Artificial Sequence
  Sterol regulatory element-binding protein 2 (332-340)
RTTHNIIEK

SEQ ID NO: 6394 - protein, 10 aa, Artificial Sequence
  Cleavage and polyadenylation specificity factor subunit 2 (358-367)
RTTPGTLARF

SEQ ID NO: 6395 - protein, 10 aa, Artificial Sequence
  Diphosphoinositol polyphosphate phosphohydrolase 1 (10-19)
RTYDGDGYKK

SEQ ID NO: 6396 - protein, 10 aa, Artificial Sequence
  Diphosphoinositol polyphosphate phosphohydrolase 2 (7-16)
RTYDREGFKK

SEQ ID NO: 6397 - protein, 10 aa, Artificial Sequence
  Coatomer subunit beta' (759-768)
RTYLPSQVSR

SEQ ID NO: 6398 - protein, 9 aa, Artificial Sequence
  Exocyst complex component 4 (74-82)
RTYQSITER

SEQ ID NO: 6399 - protein, 10 aa, Artificial Sequence
  Lon protease homolog 2, peroxisomal (371-380)
RTYVGSMPGR

SEQ ID NO: 6400 - protein, 9 aa, Artificial Sequence
  Plakophilin-4 (418-426)
RTYYSPVYR

SEQ ID NO: 6401 - protein, 11 aa, Artificial Sequence
  tRNA pseudouridine synthase-like 1 (270-280)
RVAPAHGLFLK

SEQ ID NO: 6402 - protein, 10 aa, Artificial Sequence
  Protein ERGIC-53 (12-21)
RVAPSLKSQR

SEQ ID NO: 6403 - protein, 11 aa, Artificial Sequence
  Chromobox protein homolog 6 (9-19)
RVFAAESIIKR

SEQ ID NO: 6404 - protein, 9 aa, Artificial Sequence
  F-box only protein 3 (143-151)
RVFDVPIRR

SEQ ID NO: 6405 - protein, 11 aa, Artificial Sequence
  ATP synthase mitochondrial F1 complex assembly factor 1 (45-55)
RVFPVRPGSGR

SEQ ID NO: 6406 - protein, 10 aa, Artificial Sequence
  tRNA (guanine(26)-N(2))-dimethyltransferase (327-336)
RVFTGQAKVK

SEQ ID NO: 6407 - protein, 9 aa, Artificial Sequence
  Poly (ADP-ribose) polymerase 3 (110-118)
RVGEVGQSK

SEQ ID NO: 6408 - protein, 10 aa, Artificial Sequence
  Poly (ADP-ribose) polymerase 1 (591-600)
RVGTVIGSNK

SEQ ID NO: 6409 - protein, 11 aa, Artificial Sequence
  Bifunctional methylenetetrahydrofolate dehydrogenase/cyclohydrolase, mitochondrial (278-288)
RVHDPVTAKPK

SEQ ID NO: 6410 - protein, 10 aa, Artificial Sequence
  Choline/ethanolaminephosphotransferase 1 (267-276)
RVIFTGGVGK

SEQ ID NO: 6411 - protein, 11 aa, Artificial Sequence
  Drebrin-like protein (68-78)
RVKDPNSGLPK

SEQ ID NO: 6412 - protein, 9 aa, Artificial Sequence
  YEATS domain-containing protein 4 (11-19)
RVKGVTIVK

SEQ ID NO: 6413 - protein, 10 aa, Artificial Sequence
  60S ribosomal protein L8 (147-156)
RVKLPSGSKK

SEQ ID NO: 6414 - protein, 10 aa, Artificial Sequence
  Sorting nexin-3 (52-61)
RVKTNLPIFK

SEQ ID NO: 6415 - protein, 10 aa, Artificial Sequence
  Copper transport protein ATOX1 (20-29)
RVLNKLGGVK

SEQ ID NO: 6416 - protein, 9 aa, Artificial Sequence
  U3 small nucleolar RNA-associated protein 14 homolog A (631-639)
RVLPYPFTH

SEQ ID NO: 6417 - protein, 9 aa, Artificial Sequence
  60S ribosomal export protein NMD3 (397-405)
RVPDVVLIK

SEQ ID NO: 6418 - protein, 11 aa, Artificial Sequence
  Protein FAM136A (8-18)
RVQEAVESMVK

SEQ ID NO: 6419 - protein, 10 aa, Artificial Sequence
  Acetolactate synthase-like protein (181-190)
RVRDIVPTLR

SEQ ID NO: 6420 - protein, 9 aa, Artificial Sequence
  Inosine-5'-monophosphate dehydrogenase 2 (126-134)
RVRDVFEAK

SEQ ID NO: 6421 - protein, 10 aa, Artificial Sequence
  Transmembrane protein 107 (3-12)
RVSGLVPSRF

SEQ ID NO: 6422 - protein, 9 aa, Artificial Sequence
  Mitochondrial import receptor subunit TOM5 homolog (39-47)
RVTPFILKK

SEQ ID NO: 6423 - protein, 9 aa, Artificial Sequence
  Dolichyl-diphosphooligosaccharide-proteinosyltransferase subunit 2 (256-264)
RVTYPAKAK

SEQ ID NO: 6424 - protein, 11 aa, Artificial Sequence
  Fanconi anemia group D2 protein (185-195)
RVVDGKDLTTK

SEQ ID NO: 6425 - protein, 11 aa, Artificial Sequence
  Ribosome biogenesis protein WDR12 (281-291)
RVWDVESGSLK

SEQ ID NO: 6426 - protein, 9 aa, Artificial Sequence
  Splicing factor 3B subunit 3 (968-976)
RVYDLGKKK

SEQ ID NO: 6427 - protein, 11 aa, Artificial Sequence
  WD repeat-containing protein 74 (208-218)
RVYDPASPQRR

SEQ ID NO: 6428 - protein, 10 aa, Artificial Sequence
  Arf-GAP with coiled-coil, ANK repeat and PH domain-containing protein 2 (477-486)
RVYEANVEKM

SEQ ID NO: 6429 - protein, 11 aa, Artificial Sequence
  Centrosomal protein of 104 kDa (621-631)
RVYEVRETAVR

SEQ ID NO: 6430 - protein, 9 aa, Artificial Sequence
  Programmed cell death 6-interacting protein (606-614)
RVYGGLTTK

SEQ ID NO: 6431 - protein, 9 aa, Artificial Sequence
  Probable E3 ubiquitin-protein ligase TRIM8 (538-546)
RVYGQPSTK

SEQ ID NO: 6432 - protein, 11 aa, Artificial Sequence
  Probable E3 ubiquitin-protein ligase TRIM8 (538-548)
RVYGQPSTKHY

SEQ ID NO: 6433 - protein, 11 aa, Artificial Sequence
  UPF0769 protein C21orf59 (33-43)
RVYNGRLKVQR

SEQ ID NO: 6434 - protein, 11 aa, Artificial Sequence
  Serine/threonine-protein kinase pim-2 (201-211)
RVYSPPEWISR

SEQ ID NO: 6435 - protein, 10 aa, Artificial Sequence
  E3 ubiquitin-protein ligase Itchy homolog (177-186)
RVYYVDHVEK

SEQ ID NO: 6436 - protein, 9 aa, Artificial Sequence
  Superkiller viralicidic activity 2-like 2 (738-746)
SAISSVRLY

SEQ ID NO: 6437 - protein, 9 aa, Artificial Sequence
  Ubiquilin-1 (452-460)
SAMSNPRAM

SEQ ID NO: 6438 - protein, 10 aa, Artificial Sequence
  40S ribosomal protein S21 (18-27)
SASNRIIGAK

SEQ ID NO: 6439 - protein, 9 aa, Artificial Sequence
  Condensin-2 complex subunit G2 (606-614)
SEAAAPRAF

SEQ ID NO: 6440 - protein, 9 aa, Artificial Sequence
  Ferritin heavy chain (79-87)
SEAAINRQI

SEQ ID NO: 6441 - protein, 9 aa, Artificial Sequence
  Microtubule-actin cross-linking factor 1, isoforms 1/2/3/5 (3831-3839)
SEAEQTLRF

SEQ ID NO: 6442 - protein, 9 aa, Artificial Sequence
  Single-stranded DNA-binding protein 2 (86-94)
SEAKAFHDY

SEQ ID NO: 6443 - protein, 10 aa, Artificial Sequence
  PERQ amino acid-rich with GYF domain-containing protein 2 (1182-1191)
SEAKEFAKQF

SEQ ID NO: 6444 - protein, 11 aa, Artificial Sequence
  Transcriptional adapter 1 (16-26)
SEALGDNVKQY

SEQ ID NO: 6445 - protein, 9 aa, Artificial Sequence
  Cytoplasmic dynein 1 heavy chain 1 (1405-1413)
SEALKDRHW

SEQ ID NO: 6446 - protein, 9 aa, Artificial Sequence
  Zinc finger protein 296 (189-197)
SEAPEAPLL

SEQ ID NO: 6447 - protein, 10 aa, Artificial Sequence
  ATP-dependent RNA helicase DDX50 (2-11)
SEDNPQTLLF

SEQ ID NO: 6448 - protein, 9 aa, Artificial Sequence
  UV-stimulated scaffold protein A (35-43)
SEEQLSRAY

SEQ ID NO: 6449 - protein, 9 aa, Artificial Sequence
  X-ray repair cross-complementing protein 5 (650-658)
SEEQRFNNF

SEQ ID NO: 6450 - protein, 9 aa, Artificial Sequence
  WD repeat-containing protein 63 (190-198)
SEFGAPIKF

SEQ ID NO: 6451 - protein, 10 aa, Artificial Sequence
  Pre-mRNA-processing-splicing factor 8 (1377-1386)
SEFIDSQRVW

SEQ ID NO: 6452 - protein, 9 aa, Artificial Sequence
  Programmed cell death protein 6 (83-91)
SEFTGVWKY

SEQ ID NO: 6453 - protein, 11 aa, Artificial Sequence
  Proteasome subunit beta type-5 (72-82)
SEGNRISGATF

SEQ ID NO: 6454 - protein, 11 aa, Artificial Sequence
  WD repeat-containing protein 62 (1273-1283)
SEGQEPALRSW

SEQ ID NO: 6455 - protein, 10 aa, Artificial Sequence
  E3 ubiquitin-protein ligase MARCH6 (14-23)
SEGTPEKPLY

SEQ ID NO: 6456 - protein, 10 aa, Artificial Sequence
  Serine hydroxymethyltransferase, mitochondrial (67-76)
SEGYPGKRYY

SEQ ID NO: 6457 - protein, 9 aa, Artificial Sequence
  Serine hydroxymethyltransferase, cytosolic (74-82)
SEGYPGQRY

SEQ ID NO: 6458 - protein, 9 aa, Artificial Sequence
  Pre-mRNA-splicing factor CWC22 homolog (326-334)
SEIDKRVQY

SEQ ID NO: 6459 - protein, 9 aa, Artificial Sequence
  Talin-1 (290-298)
SEIEAKVRY

SEQ ID NO: 6460 - protein, 9 aa, Artificial Sequence
  Beta-parvin (141-149)
SEIGQKQKL

SEQ ID NO: 6461 - protein, 11 aa, Artificial Sequence
  Ribosome-binding protein 1 (242-252)
SEKAGIIQDTW

SEQ ID NO: 6462 - protein, 9 aa, Artificial Sequence
  Nuclear pore complex protein Nup155 (295-303)
SEKGVIQVY

SEQ ID NO: 6463 - protein, 9 aa, Artificial Sequence
  Plectin (3212-3220)
SELQARETF

SEQ ID NO: 6464 - protein, 9 aa, Artificial Sequence
  Inositol 1,4,5-trisphosphate receptor type 1 (2099-2107)
SENAERILY

SEQ ID NO: 6465 - protein, 9 aa, Artificial Sequence
  AP-2 complex subunit mu (347-355)
SENAIVWKI

SEQ ID NO: 6466 - protein, 9 aa, Artificial Sequence
  DnaJ homolog subfamily A member 2 (20-28)
SENELKKAY

SEQ ID NO: 6467 - protein, 11 aa, Artificial Sequence
  DNA-dependent protein kinase catalytic subunit (2174-2184)
SENNGGEGIHY

SEQ ID NO: 6468 - protein, 10 aa, Artificial Sequence
  Mediator of RNA polymerase II transcription subunit 12 (891-900)
SENPANRYSF

SEQ ID NO: 6469 - protein, 9 aa, Artificial Sequence
  F-box/LRR-repeat protein 3 (261-269)
SENPGQTHF

SEQ ID NO: 6470 - protein, 11 aa, Artificial Sequence
  Protein sel-1 homolog 1 (20-30)
SEQQHSAQAMF

SEQ ID NO: 6471 - protein, 9 aa, Artificial Sequence
  HLA class II histocompatibility antigen, DRB1-11 beta chain (221-229)
SESAQSKML

SEQ ID NO: 6472 - protein, 11 aa, Artificial Sequence
  Eukaryotic initiation factor 4A-I (40-50)
SESLLRGIYAY

SEQ ID NO: 6473 - protein, 9 aa, Artificial Sequence
  Retinoic acid receptor alpha (17-25)
SESRMVVTF

SEQ ID NO: 6474 - protein, 9 aa, Artificial Sequence
  Vacuolar protein sorting-associated protein 51 homolog (16-24)
SETDMVRQI

SEQ ID NO: 6475 - protein, 9 aa, Artificial Sequence
  26S proteasome non-ATPase regulatory subunit 2 (546-554)
SETELKDTY

SEQ ID NO: 6476 - protein, 9 aa, Artificial Sequence
  Misshapen-like kinase 1 (969-977)
SETPEIRKY

SEQ ID NO: 6477 - protein, 9 aa, Artificial Sequence
  Serine/threonine-protein kinase Nek6 (224-232)
SETTAAHSL

SEQ ID NO: 6478 - protein, 9 aa, Artificial Sequence
  U5 small nuclear ribonucleoprotein 200 kDa helicase (1230-1238)
SEVILHHEY

SEQ ID NO: 6479 - protein, 9 aa, Artificial Sequence
  Arginine-glutamic acid dipeptide repeats protein (1257-1265)
SEYARPHVM

SEQ ID NO: 6480 - protein, 10 aa, Artificial Sequence
  Proteasome subunit alpha type-5 (6-15)
SEYDRGVNTF

SEQ ID NO: 6481 - protein, 10 aa, Artificial Sequence
  Nucleolar protein 56 (275-284)
SEYRQSLHTY

SEQ ID NO: 6482 - protein, 8 aa, Artificial Sequence
  Pleiotropic regulator 1 (226-233)
SGKLKLSL

SEQ ID NO: 6483 - protein, 9 aa, Artificial Sequence
  Manganese-transporting ATPase 13A1 (75-83)
SIAAPFTSK

SEQ ID NO: 6484 - protein, 9 aa, Artificial Sequence
  Myotubularin-related protein 10 (210-218)
SILGTPLSK

SEQ ID NO: 6485 - protein, 10 aa, Artificial Sequence
  U2 small nuclear ribonucleoprotein A' (119-128)
SILRNPVTNK

SEQ ID NO: 6486 - protein, 10 aa, Artificial Sequence
  Cytospin-A (887-896)
SISGPISTSK

SEQ ID NO: 6487 - protein, 11 aa, Artificial Sequence
  Double-stranded RNA-specific adenosine deaminase (1110-1120)
SIYDSKRQSGK

SEQ ID NO: 6488 - protein, 9 aa, Artificial Sequence
  Importin-8 (234-242)
SLAEILLKK

SEQ ID NO: 6489 - protein, 10 aa, Artificial Sequence
  Heterogeneous nuclear ribonucleoprotein K (154-163)
SLAGGIIGVK

SEQ ID NO: 6490 - protein, 9 aa, Artificial Sequence
  G2/M phase-specific E3 ubiquitin-protein ligase (424-432)
SLFEGSLSK

SEQ ID NO: 6491 - protein, 9 aa, Artificial Sequence
  Serine/threonine-protein phosphatase 2A 56 kDa regulatory subunit epsilon isoform (278-286)
SLFHAQLAY

SEQ ID NO: 6492 - protein, 9 aa, Artificial Sequence
  Adenylate cyclase type 6 (161-169)
SLFPKALQR

SEQ ID NO: 6493 - protein, 9 aa, Artificial Sequence
  Cytochrome c oxidase subunit 6C (30-38)
SLGVAALYK

SEQ ID NO: 6494 - protein, 10 aa, Artificial Sequence
  Histone H2A.V (91-100)
SLIGKKGQQK

SEQ ID NO: 6495 - protein, 9 aa, Artificial Sequence
  N-alpha-acetyltransferase 30 (63-71)
SLKSKVLSV

SEQ ID NO: 6496 - protein, 9 aa, Artificial Sequence
  COP9 signalosome complex subunit 2 (433-441)
SLNQAVVSK

SEQ ID NO: 6497 - protein, 10 aa, Artificial Sequence
  Cell division cycle-associated protein 2 (247-256)
SLPANTPLRK

SEQ ID NO: 6498 - protein, 9 aa, Artificial Sequence
  Zinc finger protein 697 (327-335)
SLSSHLLSH

SEQ ID NO: 6499 - protein, 11 aa, Artificial Sequence
  Protection of telomeres protein 1 (417-427)
SLYDSKIWTTK

SEQ ID NO: 6500 - protein, 11 aa, Artificial Sequence
  MICOS complex subunit MIC26 (41-51)
SLYSVPEGQSK

SEQ ID NO: 6501 - protein, 9 aa, Artificial Sequence
  A-kinase anchor protein 13 (930-938)
SPLTKSISL

SEQ ID NO: 6502 - protein, 8 aa, Artificial Sequence
  Elongation factor 2 (95-102)
SPNKHNRL

SEQ ID NO: 6503 - protein, 9 aa, Artificial Sequence
  WD repeat-containing protein 3 (558-566)
SPNQKLLAV

SEQ ID NO: 6504 - protein, 8 aa, Artificial Sequence
  Gamma-interferon-inducible protein 16 (166-173)
SPSPKTSL

SEQ ID NO: 6505 - protein, 8 aa, Artificial Sequence
  Elongation factor 2 (2-9)
SPVVRVAV

SEQ ID NO: 6506 - protein, 9 aa, Artificial Sequence
  Uridine diphosphate glucose pyrophosphatase (83-91)
SPYLRPLTL

SEQ ID NO: 6507 - protein, 9 aa, Artificial Sequence
  Ubiquitin carboxyl-terminal hydrolase 48 (410-418)
SRNAYMLVY

SEQ ID NO: 6508 - protein, 9 aa, Artificial Sequence
  RNA-binding protein EWS (328-336)
SSAPPLTGK

SEQ ID NO: 6509 - protein, 9 aa, Artificial Sequence
  Immediate early response gene 5 protein (275-283)
SSFSGLLRK

SEQ ID NO: 6510 - protein, 9 aa, Artificial Sequence
  40S ribosomal protein S5 (184-192)
SSNSYAIKK

SEQ ID NO: 6511 - protein, 9 aa, Artificial Sequence
  Proteasome activator complex subunit 4 (977-985)
SSYSQVRNK

SEQ ID NO: 6512 - protein, 9 aa, Artificial Sequence
  PCI domain-containing protein 2 (203-211)
STAQRVTYK

SEQ ID NO: 6513 - protein, 9 aa, Artificial Sequence
  MAP7 domain-containing protein 1 (454-462)
STASELSPK

SEQ ID NO: 6514 - protein, 9 aa, Artificial Sequence
  60S ribosomal protein L18 (41-49)
STFNQVVLK

SEQ ID NO: 6515 - protein, 9 aa, Artificial Sequence
  WD repeat and coiled-coil-containing protein C2orf44 (449-457)
STFSAPLNK

SEQ ID NO: 6516 - protein, 9 aa, Artificial Sequence
  Kanadaptin (238-246)
STHGTFLNK

SEQ ID NO: 6517 - protein, 9 aa, Artificial Sequence
  Double-stranded RNA-binding protein Staufen homolog 2 (41-49)
STLPKPVQK

SEQ ID NO: 6518 - protein, 9 aa, Artificial Sequence
  F-box only protein 11 (143-151)
STNSHPILR

SEQ ID NO: 6519 - protein, 9 aa, Artificial Sequence
  LisH domain-containing protein ARMC9 (382-390)
STSDVVRQY

SEQ ID NO: 6520 - protein, 9 aa, Artificial Sequence
  E3 ubiquitin-protein ligase CHFR (78-86)
STSGTVINK

SEQ ID NO: 6521 - protein, 9 aa, Artificial Sequence
  Lysine-specific histone demethylase 1A (633-641)
STSQTFIYK

SEQ ID NO: 6522 - protein, 9 aa, Artificial Sequence
  Heterogeneous nuclear ribonucleoprotein U-like protein 2 (165-173)
STYGVTKGK

SEQ ID NO: 6523 - protein, 9 aa, Artificial Sequence
  Cathepsin Z (38-46)
STYPRPHEY

SEQ ID NO: 6524 - protein, 9 aa, Artificial Sequence
  Nucleolar pre-ribosomal-associated protein 1 (2084-2092)
SVAEHPLSR

SEQ ID NO: 6525 - protein, 9 aa, Artificial Sequence
  MOB kinase activator 1A (188-196)
SVAKTILKR

SEQ ID NO: 6526 - protein, 10 aa, Artificial Sequence
  Lysine-specific demethylase 5C (959-968)
SVAPSPAVDK

SEQ ID NO: 6527 - protein, 9 aa, Artificial Sequence
  Lysine-specific demethylase 5A (796-804)
SVAQLLLSK

SEQ ID NO: 6528 - protein, 9 aa, Artificial Sequence
  Probable cation-transporting ATPase 13A4 (871-879)
SVASPFTSK

SEQ ID NO: 6529 - protein, 9 aa, Artificial Sequence
  Sentrin-specific protease 5 (115-123)
SVDGPVSQK

SEQ ID NO: 6530 - protein, 9 aa, Artificial Sequence
  Exostosin-2 (692-700)
SVFGTMPLK

SEQ ID NO: 6531 - protein, 9 aa, Artificial Sequence
  SRR1-like protein (301-309)
SVHWFPVQK

SEQ ID NO: 6532 - protein, 9 aa, Artificial Sequence
  Epidermal growth factor receptor kinase substrate 8 (380-388)
SVLSPLLNK

SEQ ID NO: 6533 - protein, 9 aa, Artificial Sequence
  Nodal modulator 2 (130-138)
SVNGKVLSK

SEQ ID NO: 6534 - protein, 9 aa, Artificial Sequence
  Ubiquitin carboxyl-terminal hydrolase 11 (442-450)
SVPLPISHK

SEQ ID NO: 6535 - protein, 10 aa, Artificial Sequence
  Cytoplasmic dynein 1 light intermediate chain 1 (419-428)
SVSPIPAGSK

SEQ ID NO: 6536 - protein, 10 aa, Artificial Sequence
  Zinc finger protein 697 (10-19)
SVSSHLFTHK

SEQ ID NO: 6537 - protein, 9 aa, Artificial Sequence
  Zinc finger protein 619 (226-234)
SVSTHLITK

SEQ ID NO: 6538 - protein, 9 aa, Artificial Sequence
  Fatty acyl-CoA reductase 1 (39-47)
SVYVLVRQK

SEQ ID NO: 6539 - protein, 9 aa, Artificial Sequence
  Histone H2B type 2-F (39-47)
SVYVYKVLK

SEQ ID NO: 6540 - protein, 9 aa, Artificial Sequence
  Nucleolar RNA helicase 2 (15-23)
TAMKKGETL

SEQ ID NO: 6541 - protein, 10 aa, Artificial Sequence
  Pre-mRNA-processing-splicing factor 8 (1079-1088)
TEAAHPIRLF

SEQ ID NO: 6542 - protein, 10 aa, Artificial Sequence
  NHP2-like protein 1 (2-11)
TEADVNPKAY

SEQ ID NO: 6543 - protein, 9 aa, Artificial Sequence
  Splicing factor, proline- and glutamine-rich (309-317)
TEDEFKRLF

SEQ ID NO: 6544 - protein, 10 aa, Artificial Sequence
  60S ribosomal protein L13 (170-179)
TEEEKNFKAF

SEQ ID NO: 6545 - protein, 10 aa, Artificial Sequence
  Protein SET (136-145)
TEFEDIKSGY

SEQ ID NO: 6546 - protein, 10 aa, Artificial Sequence
  Neutral alpha-glucosidase AB (174-183)
TEGGEPYRLY

SEQ ID NO: 6547 - protein, 9 aa, Artificial Sequence
  T-complex protein 1 subunit theta (342-350)
TEIELAKQI

SEQ ID NO: 6548 - protein, 9 aa, Artificial Sequence
  RNA-binding protein 27 (734-742)
TELDLHKRL

SEQ ID NO: 6549 - protein, 9 aa, Artificial Sequence
  RNA-binding protein 26 (793-801)
TELDLYKKM

SEQ ID NO: 6550 - protein, 9 aa, Artificial Sequence
  Cell cycle progression protein 1 (432-440)
TELERKLTF

SEQ ID NO: 6551 - protein, 10 aa, Artificial Sequence
  Exocyst complex component 4 (67-76)
TELTTAIRTY

SEQ ID NO: 6552 - protein, 9 aa, Artificial Sequence
  Geranylgeranyl pyrophosphate synthase (238-246)
TENIDIKKY

SEQ ID NO: 6553 - protein, 11 aa, Artificial Sequence
  Fructose-bisphosphate aldolase A (103-113)
TENTEENRRFY

SEQ ID NO: 6554 - protein, 9 aa, Artificial Sequence
  Probable cation-transporting ATPase 13A3 (132-140)
TESQQIRYF

SEQ ID NO: 6555 - protein, 9 aa, Artificial Sequence
  Nuclear factor erythroid 2-related factor 2 (198-206)
TEVDNYHFY

SEQ ID NO: 6556 - protein, 8 aa, Artificial Sequence
  Basigin (48-55)
TEVTGHRW

SEQ ID NO: 6557 - protein, 9 aa, Artificial Sequence
  Myosin phosphatase Rho-interacting protein (441-449)
TEYPVQRNY

SEQ ID NO: 6558 - protein, 11 aa, Artificial Sequence
  GPI transamidase component PIG-T (450-460)
TEYTPDPNHGF

SEQ ID NO: 6559 - protein, 9 aa, Artificial Sequence
  Protein kinase C delta-binding protein (181-189)
TGLQKVQSL

SEQ ID NO: 6560 - protein, 9 aa, Artificial Sequence
  Alpha-enolase (72-80)
TIAPALVSK

SEQ ID NO: 6561 - protein, 9 aa, Artificial Sequence
  Histidine triad nucleotide-binding protein 1 (17-25)
TIFGKIIRK

SEQ ID NO: 6562 - protein, 9 aa, Artificial Sequence
  NHP2-like protein 1 (105-113)
TIKEGSQLK

SEQ ID NO: 6563 - protein, 9 aa, Artificial Sequence
  H/ACA ribonucleoprotein complex subunit 3 (47-55)
TIKKRFKVL

SEQ ID NO: 6564 - protein, 9 aa, Artificial Sequence
  Signal peptidase complex subunit 2 (129-137)
TIYTSYKEK

SEQ ID NO: 6565 - protein, 8 aa, Artificial Sequence
  Retinoblastoma-like protein 1 (803-810)
TIYVGRVK

SEQ ID NO: 6566 - protein, 8 aa, Artificial Sequence
  Interferon-related developmental regulator 1 (118-125)
TLGPILKK

SEQ ID NO: 6567 - protein, 9 aa, Artificial Sequence
  Protein BRICK1 (49-57)
TLNEKLTAL

SEQ ID NO: 6568 - protein, 9 aa, Artificial Sequence
  GPI mannosyltransferase 3 (40-48)
TLYFNTQEK

SEQ ID NO: 6569 - protein, 9 aa, Artificial Sequence
  Splicing factor 3B subunit 3 (759-767)
TNTLRILAL

SEQ ID NO: 6570 - protein, 9 aa, Artificial Sequence
  Ubiquitin-like protein 7 (248-256)
TPSSRPASL

SEQ ID NO: 6571 - protein, 9 aa, Artificial Sequence
  Exportin-6 (55-63)
TRNDYVMMY

SEQ ID NO: 6572 - protein, 9 aa, Artificial Sequence
  Perilipin-2 (63-71)
TSALPIIQK

SEQ ID NO: 6573 - protein, 9 aa, Artificial Sequence
  Huntingtin (1215-1223)
TSGPVTTSK

SEQ ID NO: 6574 - protein, 8 aa, Artificial Sequence
  YTH domain-containing protein 1 (327-334)
TSKLKYVL

SEQ ID NO: 6575 - protein, 9 aa, Artificial Sequence
  Male-specific lethal 3 homolog (328-336)
TTGEPATPK

SEQ ID NO: 6576 - protein, 10 aa, Artificial Sequence
  Flap endonuclease 1 (60-69)
TTSHLMGMFY

SEQ ID NO: 6577 - protein, 9 aa, Artificial Sequence
  Elongation factor 1-alpha 1 (22-30)
TTTGHLIYK

SEQ ID NO: 6578 - protein, 9 aa, Artificial Sequence
  Derlin-1 (22-30)
TVAVPLVGK

SEQ ID NO: 6579 - protein, 9 aa, Artificial Sequence
  COP9 signalosome complex subunit 3 (378-386)
TVNPQFVQK

SEQ ID NO: 6580 - protein, 10 aa, Artificial Sequence
  HIG1 domain family member 2A, mitochondrial (27-36)
TVYRNPESFK

SEQ ID NO: 6581 - protein, 9 aa, Artificial Sequence
  Talin-1 (1188-1196)
VAKAVTQAL

SEQ ID NO: 6582 - protein, 9 aa, Artificial Sequence
  DNA damage-binding protein 1 (510-518)
VAVGRALYY

SEQ ID NO: 6583 - protein, 9 aa, Artificial Sequence
  Translin-associated protein X (128-136)
VEAVSFQHF

SEQ ID NO: 6584 - protein, 11 aa, Artificial Sequence
  Nodal modulator 3 (448-458)
VEGTIGDFKAY

SEQ ID NO: 6585 - protein, 9 aa, Artificial Sequence
  3-phosphoinositide-dependent protein kinase 1 (325-333)
VENNLILKM

SEQ ID NO: 6586 - protein, 9 aa, Artificial Sequence
  Sodium-coupled neutral amino acid transporter 2 (354-362)
VESELLHTY

SEQ ID NO: 6587 - protein, 9 aa, Artificial Sequence
  Intraflagellar transport protein 81 homolog (196-204)
VETAQNHQW

SEQ ID NO: 6588 - protein, 10 aa, Artificial Sequence
  Cleavage and polyadenylation specificity factor subunit 3 (444-453)
VILEVQSNPK

SEQ ID NO: 6589 - protein, 9 aa, Artificial Sequence
  Centrosomal protein of 57 kDa (326-334)
VINSIPLAK

SEQ ID NO: 6590 - protein, 9 aa, Artificial Sequence
  DNA-directed RNA polymerase I subunit RPA2 (81-89)
VISPPTVPK

SEQ ID NO: 6591 - protein, 11 aa, Artificial Sequence
  Ras GTPase-activating protein-binding protein 1 (113-123)
VLAPEGSVANK

SEQ ID NO: 6592 - protein, 11 aa, Artificial Sequence
  Ras GTPase-activating protein-binding protein 2 (113-123)
VLAPEGSVPNK

SEQ ID NO: 6593 - protein, 9 aa, Artificial Sequence
  Interferon-stimulated gene 20 kDa protein (132-140)
VLSERLLHK

SEQ ID NO: 6594 - protein, 9 aa, Artificial Sequence
  DNA-directed RNA polymerase II subunit RPB2 (1020-1028)
VLYNGFTGR

SEQ ID NO: 6595 - protein, 9 aa, Artificial Sequence
  Long-chain-fatty-acid-CoA ligase 4 (576-584)
VPNQKRLTL

SEQ ID NO: 6596 - protein, 9 aa, Artificial Sequence
  Protein kintoun (155-163)
VPRIQPQSL

SEQ ID NO: 6597 - protein, 9 aa, Artificial Sequence
  Leucine-rich repeat-containing protein 20 (35-43)
VSFPIGIYK

SEQ ID NO: 6598 - protein, 8 aa, Artificial Sequence
  Vimentin (31-38)
VTTSTRTY

SEQ ID NO: 6599 - protein, 9 aa, Artificial Sequence
  Nucleolar and spindle-associated protein 1 (308-316)
VTVSGGTPK

SEQ ID NO: 6600 - protein, 10 aa, Artificial Sequence
  Septin-7 (317-326)
VTYNGVDNNK

SEQ ID NO: 6601 - protein, 9 aa, Artificial Sequence
  Histone deacetylase 9 (78-86)
VVDPVVREK

SEQ ID NO: 6602 - protein, 9 aa, Artificial Sequence
  Probable 18S rRNA (guanine-N(7))-methyltransferase (188-196)
VVDYPNSAK

SEQ ID NO: 6603 - protein, 9 aa, Artificial Sequence
  Heterogeneous nuclear ribonucleoproteins A2/B1 (39-47)
VVMRDPASK

SEQ ID NO: 6604 - protein, 9 aa, Artificial Sequence
  Heterogeneous nuclear ribonucleoprotein A3 (65-73)
VVMRDPQTK

SEQ ID NO: 6605 - protein, 10 aa, Artificial Sequence
  Transmembrane protein 263 (101-110)
VVNKVPLTGK

SEQ ID NO: 6606 - protein, 11 aa, Artificial Sequence
  X-ray repair cross-complementing protein 5 (574-584)
VVQDGITLITK

SEQ ID NO: 6607 - protein, 9 aa, Artificial Sequence
  60S ribosomal protein L22-like 1 (65-73)
VVSEKQFSK

SEQ ID NO: 6608 - protein, 9 aa, Artificial Sequence
  Glutathione S-transferase P (6-14)
VVYFPVRGR

SEQ ID NO: 6609 - protein, 9 aa, Artificial Sequence
  Adenylosuccinate lyase (363-371)
VVYPKVIER

SEQ ID NO: 6610 - protein, 9 aa, Artificial Sequence
  ER membrane protein complex subunit 1 (790-798)
VVYQYWNTK

SEQ ID NO: 6611 - protein, 11 aa, Artificial Sequence
  NmrA-like family domain-containing protein 1 (109-119)
VVYSGLENIKK

SEQ ID NO: 6612 - protein, 9 aa, Artificial Sequence
  JmjC domain-containing protein 8 (81-89)
YAFVRPVIL

SEQ ID NO: 6613 - protein, 9 aa, Artificial Sequence
  CCR4-NOT transcription complex subunit 1 (93-101)
YAIDNPLHY

SEQ ID NO: 6614 - protein, 9 aa, Artificial Sequence
  WD repeat-containing protein 82 (63-71)
YANSKAVTL

SEQ ID NO: 6615 - protein, 9 aa, Artificial Sequence
  Splicing factor 3B subunit 1 (761-769)
YANYYTREV

SEQ ID NO: 6616 - protein, 9 aa, Artificial Sequence
  WD repeat-containing protein 3 (84-92)
YEDGSIRIF

SEQ ID NO: 6617 - protein, 10 aa, Artificial Sequence
  NADH dehydrogenase (ubiquinone) 1 beta subcomplex subunit 11, mitochondrial (67-76)
YEKNPDSHGY

SEQ ID NO: 6618 - protein, 9 aa, Artificial Sequence
  Lon protease homolog 2, peroxisomal (599-607)
YEMEVSQRL

SEQ ID NO: 6619 - protein, 9 aa, Artificial Sequence
  AN1-type zinc finger protein 5 (21-29)
YGNPRTNGM

SEQ ID NO: 6620 - protein, 9 aa, Artificial Sequence
  Cullin-3 (34-42)
YRNAYTMVL

SEQ ID NO: 6621 - protein, 9 aa, Artificial Sequence
  MICOS complex subunit MIC27 (44-52)
YTAPPLQSK

SEQ ID NO: 6622 - protein, 9 aa, Artificial Sequence
  ATP-dependent RNA helicase DDX3X (200-208)
YTRPTPVQK

SEQ ID NO: 6623 - protein, 9 aa, Artificial Sequence
  Vimentin (30-38)
YVTTSTRTY

SEQ ID NO: 6624 - protein, 9 aa, Artificial Sequence
  Serine/threonine-protein kinase mTOR (853-861)
YVVEPYRKY

SEQ ID NO: 6625 - protein, 9 aa, Artificial Sequence
  Enhancer of filamentation 1 (164-172)
YVYEYPSRY

SEQ ID NO: 6626 - protein, 10 aa, Artificial Sequence
  Nucleolar pre-ribosomal-associated protein 1 (1468-1477)
YYSHLEGARF

SEQ ID NO: 6627 - protein, 9 aa, Artificial Sequence
  Selenoprotein H (10-18)
AEAAVVAVA

SEQ ID NO: 6628 - protein, 9 aa, Artificial Sequence
  Transcription factor BTF3 (128-136)
AEALPKQSV

SEQ ID NO: 6629 - protein, 9 aa, Artificial Sequence
  E3 ubiquitin-protein ligase HUWE1 (1156-1164)
AEDKDTPAL

SEQ ID NO: 6630 - protein, 11 aa, Artificial Sequence
  Centromere protein H (228-238)
AEDPALKEIVL

SEQ ID NO: 6631 - protein, 11 aa, Artificial Sequence
  Probable ATP-dependent RNA helicase DDX56 (121-131)
AEDSVSQRAVL

SEQ ID NO: 6632 - protein, 9 aa, Artificial Sequence
  Transforming acidic coiled-coil-containing protein 3 (469-477)
AEDTPVVQL

SEQ ID NO: 6633 - protein, 10 aa, Artificial Sequence
  Beta-hexosaminidase subunit alpha (266-275)
AEFDTPGHTL

SEQ ID NO: 6634 - protein, 10 aa, Artificial Sequence
  26S proteasome non-ATPase regulatory subunit 8 (113-122)
AEFHTELERL

SEQ ID NO: 6635 - protein, 9 aa, Artificial Sequence
  Zinc phosphodiesterase ELAC protein 2 (677-685)
AEFIMLNHF

SEQ ID NO: 6636 - protein, 10 aa, Artificial Sequence
  Calmodulin (11-20)
AEFKEAFSLF

SEQ ID NO: 6637 - protein, 10 aa, Artificial Sequence
  BRCA1-A complex subunit BRE (90-99)
AEFLPDPSAL

SEQ ID NO: 6638 - protein, 12 aa, Artificial Sequence
  DNA dC-dU-editing enzyme APOBEC-3B (105-116)
AEFLSEHPNVTL

SEQ ID NO: 6639 - protein, 9 aa, Artificial Sequence
  ATP-dependent RNA helicase DHX8 (979-987)
AEFPLEPML

SEQ ID NO: 6640 - protein, 9 aa, Artificial Sequence
  Cytochrome c oxidase subunit 6B1 (9-17)
AEGTFPGKI

SEQ ID NO: 6641 - protein, 9 aa, Artificial Sequence
  SRSF protein kinase 1 (114-122)
AEHYTETAL

SEQ ID NO: 6642 - protein, 11 aa, Artificial Sequence
  DNA repair protein RAD50 (134-144)
AEIDREMISSL

SEQ ID NO: 6643 - protein, 9 aa, Artificial Sequence
  Insulin-like growth factor 2 mRNA-binding protein 2 (201-209)
AEIEIMKKL

SEQ ID NO: 6644 - protein, 12 aa, Artificial Sequence
  Sodium/potassium-transporting ATPase subunit alpha-1 (69-80)
AEILARDGPNAL

SEQ ID NO: 6645 - protein, 11 aa, Artificial Sequence
  Lamin-B1 (347-357)
AEIRDQMQQQL

SEQ ID NO: 6646 - protein, 9 aa, Artificial Sequence
  Transcription factor 25 (361-369)
AEISQPPAL

SEQ ID NO: 6647 - protein, 12 aa, Artificial Sequence
  BAG64702.1 (100-111)
AEITDKLGLHSL

SEQ ID NO: 6648 - protein, 10 aa, Artificial Sequence
  Importin subunit alpha-1 (451-460)
AEKLGETEKL

SEQ ID NO: 6649 - protein, 9 aa, Artificial Sequence
  T-complex protein 1 subunit epsilon (350-358)
AEKLGFAGL

SEQ ID NO: 6650 - protein, 10 aa, Artificial Sequence
  Coiled-coil domain-containing protein 85B (121-130)
AELEGRQEEL

SEQ ID NO: 6651 - protein, 10 aa, Artificial Sequence
  Centrosomal protein of 55 kDa (140-149)
AELESKTNTL

SEQ ID NO: 6652 - protein, 12 aa, Artificial Sequence
  Tropomodulin-3 (286-297)
AELKIDNQRQQL

SEQ ID NO: 6653 - protein, 9 aa, Artificial Sequence
  COMM domain-containing protein 4 (192-200)
AELKQAQTL

SEQ ID NO: 6654 - protein, 9 aa, Artificial Sequence
  trabeculin-alpha (1770-1778)
AELKQVQTL

SEQ ID NO: 6655 - protein, 10 aa, Artificial Sequence
  Microtubule-associated protein RP/EB family member 1 (194-203)
AELMQQVNVL

SEQ ID NO: 6656 - protein, 11 aa, Artificial Sequence
  14-3-3 protein theta (34-44)
AELSNEERNLL

SEQ ID NO: 6657 - protein, 11 aa, Artificial Sequence
  Sodium/potassium-transporting ATPase subunit alpha-1 (677-687)
AENGFLPIHLL

SEQ ID NO: 6658 - protein, 11 aa, Artificial Sequence
  Armadillo repeat-containing X-linked protein 3 (271-281)
AENPAMTRELL

SEQ ID NO: 6659 - protein, 9 aa, Artificial Sequence
  Eukaryotic translation initiation factor 4 gamma 1 (1379-1387)
AEQKVEYTL

SEQ ID NO: 6660 - protein, 9 aa, Artificial Sequence
  Double-strand-break repair protein rad21 homolog (576-584)
AESISLLEL

SEQ ID NO: 6661 - protein, 9 aa, Artificial Sequence
  Uncharacterized protein C6orf226 (67-75)
AESLPPPTL

SEQ ID NO: 6662 - protein, 11 aa, Artificial Sequence
  Endoplasmin (528-538)
AESSPFVERLL

SEQ ID NO: 6663 - protein, 9 aa, Artificial Sequence
  Magnesium transporter protein 1 (299-307)
AETHIVLLF

SEQ ID NO: 6664 - protein, 9 aa, Artificial Sequence
  DNA-directed RNA polymerase I subunit RPA1 (1590-1598)
AEVLDLRRL

SEQ ID NO: 6665 - protein, 11 aa, Artificial Sequence
  Syntaxin-binding protein 1 (297-307)
AEVSQEVTRSL

SEQ ID NO: 6666 - protein, 10 aa, Artificial Sequence
  Cytochrome b-c1 complex subunit 9 (42-51)
AIYDHINEGV

SEQ ID NO: 6667 - protein, 10 aa, Artificial Sequence
  Rab GDP dissociation inhibitor beta (137-146)
ARYGKSPYLY

SEQ ID NO: 6668 - protein, 9 aa, Artificial Sequence
  Replication factor C subunit 4 (343-351)
DEHLQLISL

SEQ ID NO: 6669 - protein, 11 aa, Artificial Sequence
  Small nuclear ribonucleoprotein Sm D2 (22-32)
EEFNTGPLSVL

SEQ ID NO: 6670 - protein, 9 aa, Artificial Sequence
  Transmembrane emp24 domain-containing protein 10 (136-144)
EEIAKVEKL

SEQ ID NO: 6671 - protein, 9 aa, Artificial Sequence
  Protein RRP5 homolog (820-828)
EELQGVRSL

SEQ ID NO: 6672 - protein, 11 aa, Artificial Sequence
  T-complex protein 1 subunit delta (363-373)
EEVNLNGSGKL

SEQ ID NO: 6673 - protein, 9 aa, Artificial Sequence
  Nucleophosmin (92-100)
FEITPPVVL

SEQ ID NO: 6674 - protein, 9 aa, Artificial Sequence
  Actin, cytoplasmic 1 (223-231)
FEQEMATAA

SEQ ID NO: 6675 - protein, 9 aa, Artificial Sequence
  Serine/arginine repetitive matrix protein 2 (873-881)
FESSPDPEL

SEQ ID NO: 6676 - protein, 10 aa, Artificial Sequence
  Mitochondrial Rho GTPase 2 (11-20)
GEAQVGKTSL

SEQ ID NO: 6677 - protein, 12 aa, Artificial Sequence
  Heterogeneous nuclear ribonucleoprotein C-like 1 (69-80)
GEDGRMIAGQVL

SEQ ID NO: 6678 - protein, 10 aa, Artificial Sequence
  Cytoplasmic dynein 1 heavy chain 1 (1073-1082)
GEDLNKWQAL

SEQ ID NO: 6679 - protein, 10 aa, Artificial Sequence
  HDAC2 protein (482-491)
GEDPDKRISI

SEQ ID NO: 6680 - protein, 9 aa, Artificial Sequence
  Histone-binding protein RBBP7 (146-154)
GEFGGFGSV

SEQ ID NO: 6681 - protein, 11 aa, Artificial Sequence
  PC4 and SFRS1-interacting protein (251-261)
GEGDSVITQVL

SEQ ID NO: 6682 - protein, 9 aa, Artificial Sequence
  Nardilysin-arginine dibasic convertase), isoform CRA_d (823-831)
GEHGLIIRV

SEQ ID NO: 6683 - protein, 11 aa, Artificial Sequence
  Elongation factor 2 (42-52)
GEHIIAGAGEL

SEQ ID NO: 6684 - protein, 9 aa, Artificial Sequence
  Ragulator complex protein LAMTOR4 (44-52)
GEHTLLVTV

SEQ ID NO: 6685 - protein, 11 aa, Artificial Sequence
  26S protease regulatory subunit 10B (338-348)
GEIDYEAIVKL

SEQ ID NO: 6686 - protein, 11 aa, Artificial Sequence
  Golgin subfamily B member 1 (2640-2650)
GEIEDKLKKEL

SEQ ID NO: 6687 - protein, 11 aa, Artificial Sequence
  Coatomer subunit beta' (518-528)
GEIQEIVKTGL

SEQ ID NO: 6688 - protein, 9 aa, Artificial Sequence
  Prolyl 4-hydroxylase subunit alpha-1 (197-205)
GEISTIDKV

SEQ ID NO: 6689 - protein, 9 aa, Artificial Sequence
  Filamin-A (1802-1810)
GEITGEVRM

SEQ ID NO: 6690 - protein, 9 aa, Artificial Sequence
  Coatomer subunit beta' (549-557)
GEIVTIAHL

SEQ ID NO: 6691 - protein, 10 aa, Artificial Sequence
  Proliferating cell nuclear antigen (173-182)
GELGNGNIKL

SEQ ID NO: 6692 - protein, 9 aa, Artificial Sequence
  E3 SUMO-protein ligase PIAS3 (130-138)
GELIRPTTL

SEQ ID NO: 6693 - protein, 9 aa, Artificial Sequence
  Prohibitin (137-145)
GELITQREL

SEQ ID NO: 6694 - protein, 10 aa, Artificial Sequence
  40S ribosomal protein S21 (63-72)
GESDDSILRL

SEQ ID NO: 6695 - protein, 11 aa, Artificial Sequence
  Ubiquitin carboxyl-terminal hydrolase 22 (352-362)
GESHVSGTTTL

SEQ ID NO: 6696 - protein, 11 aa, Artificial Sequence
  Maspardin (165-175)
GQSELASRLTL

SEQ ID NO: 6697 - protein, 10 aa, Artificial Sequence
  RNA-binding protein EWS (382-391)
HEAQHGVTSL

SEQ ID NO: 6698 - protein, 9 aa, Artificial Sequence
  Kinesin-associated protein 3 (357-365)
HEDLLNITL

SEQ ID NO: 6699 - protein, 9 aa, Artificial Sequence
  Chromodomain-helicase-DNA-binding protein 6 (1642-1650)
HEDPGQATL

SEQ ID NO: 6700 - protein, 9 aa, Artificial Sequence
  V-type proton ATPase subunit D (113-121)
HEGTDSYEL

SEQ ID NO: 6701 - protein, 10 aa, Artificial Sequence
  Taperin (362-371)
HEIEVIGGYL

SEQ ID NO: 6702 - protein, 9 aa, Artificial Sequence
  Transcription elongation factor SPT6 (746-754)
HELDQGQQL

SEQ ID NO: 6703 - protein, 11 aa, Artificial Sequence
  Coronin-1C (313-323)
HEMDTSNGVLL

SEQ ID NO: 6704 - protein, 9 aa, Artificial Sequence
  Importin subunit alpha-4 (468-476)
HENEDIYKL

SEQ ID NO: 6705 - protein, 10 aa, Artificial Sequence
  Pre-mRNA-processing factor 19 (305-314)
HESAVTGLSL

SEQ ID NO: 6706 - protein, 9 aa, Artificial Sequence
  Single-stranded DNA-binding protein, mitochondrial (16-24)
HESETTTSL

SEQ ID NO: 6707 - protein, 9 aa, Artificial Sequence
  Vacuolar protein sorting-associated protein 33A (58-66)
HEVEKMFTL

SEQ ID NO: 6708 - protein, 9 aa, Artificial Sequence
  STAGA complex 65 subunit gamma (219-227)
HEVGIGSVL

SEQ ID NO: 6709 - protein, 9 aa, Artificial Sequence
  DNA replication licensing factor MCM4 (588-596)
HEVMEQQTL

SEQ ID NO: 6710 - protein, 9 aa, Artificial Sequence
  F-box only protein 38 (323-331)
HEVRIQPSL

SEQ ID NO: 6711 - protein, 10 aa, Artificial Sequence
  3-hydroxy-3-methylglutaryl-coenzyme A reductase (619-628)
HEYFPEMQIL

SEQ ID NO: 6712 - protein, 9 aa, Artificial Sequence
  Protein C-ets-1 (189-197)
HPISSEELL

SEQ ID NO: 6713 - protein, 11 aa, Artificial Sequence
  DNA repair endonuclease XPF (748-758)
IEFDPSKPFSL

SEQ ID NO: 6714 - protein, 9 aa, Artificial Sequence
  Proliferating cell nuclear antigen (197-205)
IEMNEPVQL

SEQ ID NO: 6715 - protein, 10 aa, Artificial Sequence
  Nuclear poreoprotein p62 (366-375)
IENGEKITSL

SEQ ID NO: 6716 - protein, 10 aa, Artificial Sequence
  Melanoma-associated antigen F1 (112-121)
ILFPDIIARA

SEQ ID NO: 6717 - protein, 10 aa, Artificial Sequence
  Clathrin light chain A (227-236)
ISLKQAPLVH

SEQ ID NO: 6718 - protein, 9 aa, Artificial Sequence
  NAD(P)H dehydrogenase (quinone) 1 (143-151)
IWDETPLYF

SEQ ID NO: 6719 - protein, 8 aa, Artificial Sequence
  Guanine nucleotide-binding protein subunit beta-2-like 1 (106-113)
KDVLSVAF

SEQ ID NO: 6720 - protein, 11 aa, Artificial Sequence
  T-complex protein 1 subunit theta (367-377)
KEDGAISTIVL

SEQ ID NO: 6721 - protein, 9 aa, Artificial Sequence
  Ubiquitin carboxyl-terminal hydrolase 48 (790-798)
KEDSKLIAL

SEQ ID NO: 6722 - protein, 9 aa, Artificial Sequence
  Myosin-9 (1084-1092)
KEEELQAAL

SEQ ID NO: 6723 - protein, 10 aa, Artificial Sequence
  Plasminogen activator inhibitor 1 RNA-binding protein (8-17)
KEETQPPVAL

SEQ ID NO: 6724 - protein, 10 aa, Artificial Sequence
  Chitinase domain-containing protein 1 (269-278)
KEFEQLAPVL

SEQ ID NO: 6725 - protein, 10 aa, Artificial Sequence
  ATP-dependent RNA helicase DDX24 (116-125)
KEFEVKDPEL

SEQ ID NO: 6726 - protein, 11 aa, Artificial Sequence
  E3 ubiquitin-protein ligase listerin (1308-1318)
KEFFSQGIHSL

SEQ ID NO: 6727 - protein, 10 aa, Artificial Sequence
  Inhibitor of growth protein 4 (52-61)
KEFGDDKVQL

SEQ ID NO: 6728 - protein, 10 aa, Artificial Sequence
  Eukaryotic translation initiation factor 4 gamma 1 (1365-1374)
KEFLPEGQDI

SEQ ID NO: 6729 - protein, 11 aa, Artificial Sequence
  Serine-tRNA ligase, cytoplasmic (457-467)
KEFMPPGLQEL

SEQ ID NO: 6730 - protein, 12 aa, Artificial Sequence
  Heterogeneous nuclear ribonucleoprotein Q (66-77)
KEFNEDGALAVL

SEQ ID NO: 6731 - protein, 9 aa, Artificial Sequence
  Protein zer-1 homolog (579-587)
KEFPEKQEL

SEQ ID NO: 6732 - protein, 9 aa, Artificial Sequence
  Regulator of G-protein signaling 10 (61-69)
KEFSEENVL

SEQ ID NO: 6733 - protein, 12 aa, Artificial Sequence
  Apolipoprotein L2 (196-207)
KEFVGGNTPNVL

SEQ ID NO: 6734 - protein, 9 aa, Artificial Sequence
  Cyclin-dependent kinase 9 (56-64)
KEGFPITAL

SEQ ID NO: 6735 - protein, 11 aa, Artificial Sequence
  Vacuolar protein sorting-associated protein 33A (56-66)
KEHEVEKMFTL

SEQ ID NO: 6736 - protein, 12 aa, Artificial Sequence
  Serine/Arginine-related protein 53 (223-234)
KEIDPTSIPTAI

SEQ ID NO: 6737 - protein, 9 aa, Artificial Sequence
  Ran GTPase-activating protein 1 (43-51)
KEIEDFDSL

SEQ ID NO: 6738 - protein, 10 aa, Artificial Sequence
  RNA cytidine acetyltransferase (729-738)
KEIELPSGQL

SEQ ID NO: 6739 - protein, 9 aa, Artificial Sequence
  Transcription initiation factor IIB (272-280)
KEIGDIAGV

SEQ ID NO: 6740 - protein, 9 aa, Artificial Sequence
  Ras suppressor protein 1 (177-185)
KEIGELTQL

SEQ ID NO: 6741 - protein, 10 aa, Artificial Sequence
  V-type proton ATPase 116 kDa subunit a isoform 1 (109-118)
KEINTNQEAL

SEQ ID NO: 6742 - protein, 9 aa, Artificial Sequence
  Scavenger receptor class B member 1 (57-65)
KEIPIPFYL

SEQ ID NO: 6743 - protein, 10 aa, Artificial Sequence
  Centromere protein F (1675-1684)
KEIQELEQLL

SEQ ID NO: 6744 - protein, 10 aa, Artificial Sequence
  Spatacsin (1706-1715)
KEITQEMQTL

SEQ ID NO: 6745 - protein, 12 aa, Artificial Sequence
  Importin-11 (778-789)
KEITTEGQVQVL

SEQ ID NO: 6746 - protein, 10 aa, Artificial Sequence
  Eukaryotic translation initiation factor 3 subunit E (29-38)
KEIYNEKELL

SEQ ID NO: 6747 - protein, 10 aa, Artificial Sequence
  Double-stranded RNA-binding protein Staufen homolog 2 (288-297)
KEKEPDYVLL

SEQ ID NO: 6748 - protein, 10 aa, Artificial Sequence
  Double-stranded RNA-binding protein Staufen homolog 1 (258-267)
KEKEPEYTLL

SEQ ID NO: 6749 - protein, 9 aa, Artificial Sequence
  Protein transport protein Sec16A (1490-1498)
KEKPEEESL

SEQ ID NO: 6750 - protein, 10 aa, Artificial Sequence
  Heat shock protein HSP 90-alpha A2 (280-289)
KEKYIDQEEL

SEQ ID NO: 6751 - protein, 10 aa, Artificial Sequence
  Alpha-2-macroglobulin receptor-associated protein (272-281)
KELEAFREEL

SEQ ID NO: 6752 - protein, 10 aa, Artificial Sequence
  Ribosome-binding protein 1 (235-244)
KELESQVSGL

SEQ ID NO: 6753 - protein, 11 aa, Artificial Sequence
  Probable ATP-dependent RNA helicase DDX56 (208-218)
KELILHNPVTL

SEQ ID NO: 6754 - protein, 10 aa, Artificial Sequence
  CDK5 regulatory subunit-associated protein 2 (665-674)
KELYTDNQHL

SEQ ID NO: 6755 - protein, 9 aa, Artificial Sequence
  Aurora kinase B (57-65)
KEPVTPSAL

SEQ ID NO: 6756 - protein, 9 aa, Artificial Sequence
  CDK5 regulatory subunit-associated protein 2 (559-567)
KEQDIYTHL

SEQ ID NO: 6757 - protein, 9 aa, Artificial Sequence
  Plectin (2047-2055)
KEQELQQTL

SEQ ID NO: 6758 - protein, 10 aa, Artificial Sequence
  Nucleoprotein TPR (995-1004)
KESAEFQTQL

SEQ ID NO: 6759 - protein, 10 aa, Artificial Sequence
  Antizyme inhibitor 1 (203-212)
KESQVYVHAL

SEQ ID NO: 6760 - protein, 9 aa, Artificial Sequence
  Gamma-interferon-inducible protein 16 (299-307)
KETLKIDIL

SEQ ID NO: 6761 - protein, 9 aa, Artificial Sequence
  Periodic tryptophan protein 1 homolog (19-27)
KETPDKVEL

SEQ ID NO: 6762 - protein, 13 aa, Artificial Sequence
  Sequestosome-1 (324-336)
KEVDPSTGELQSL

SEQ ID NO: 6763 - protein, 9 aa, Artificial Sequence
  DNA replication licensing factor MCM6 (332-340)
KEWEKVFEM

SEQ ID NO: 6764 - protein, 11 aa, Artificial Sequence
  Lupus La protein (75-85)
KEWLEDKGQVL

SEQ ID NO: 6765 - protein, 9 aa, Artificial Sequence
  40S ribosomal protein S2 (58-66)
KEWMPVTKL

SEQ ID NO: 6766 - protein, 9 aa, Artificial Sequence
  DNA-directed RNA polymerases I, II, and III subunit RPABC4 (50-58)
KRLVVFDAR

SEQ ID NO: 6767 - protein, 11 aa, Artificial Sequence
  Dual specificity protein kinase CLK3 (601-611)
LEFDPAQRITL

SEQ ID NO: 6768 - protein, 9 aa, Artificial Sequence
  Microtubule-associated protein RP/EB family member 2 (98-106)
LEHEYIHNF

SEQ ID NO: 6769 - protein, 9 aa, Artificial Sequence
  Mitochondrial import inner membrane translocase subunit TIM50 (324-332)
LEQEEQQRL

SEQ ID NO: 6770 - protein, 10 aa, Artificial Sequence
  Cyclin-dependent kinase 7 (5-14)
LEVIIKDNSL

SEQ ID NO: 6771 - protein, 11 aa, Artificial Sequence
  POTE ankyrin domain family member F (794-804)
LRVAPEEHPVL

SEQ ID NO: 6772 - protein, 10 aa, Artificial Sequence
  Eukaryotic translation initiation factor 4 gamma 1 (1290-1299)
MEIDIPHVWL

SEQ ID NO: 6773 - protein, 9 aa, Artificial Sequence
  MICOS complex subunit MIC60 (474-482)
MENEMRTQL

SEQ ID NO: 6774 - protein, 10 aa, Artificial Sequence
  Interleukin enhancer-binding factor 3 (561-570)
MEVEVDGQKF

SEQ ID NO: 6775 - protein, 9 aa, Artificial Sequence
  Pre-mRNA-processing-splicing factor 8 (1868-1876)
MLDPLEVHL

SEQ ID NO: 6776 - protein, 9 aa, Artificial Sequence
  Elongation factor 2 (673-681)
NEIKDSVVA

SEQ ID NO: 6777 - protein, 8 aa, Artificial Sequence
  Heterogeneous nuclear ribonucleoprotein K (38-45)
NTDEMVEL

SEQ ID NO: 6778 - protein, 10 aa, Artificial Sequence
  Poly(U)-binding-splicing factor PUF60 (318-327)
QEAVAGAAVL

SEQ ID NO: 6779 - protein, 11 aa, Artificial Sequence
  Tyrosine-protein kinase BAZ1B (891-901)
QEFLTDMKQVF

SEQ ID NO: 6780 - protein, 9 aa, Artificial Sequence
  Pumilio homolog 3 (495-503)
QEHAQEVVL

SEQ ID NO: 6781 - protein, 9 aa, Artificial Sequence
  Nuclear pore complex protein Nup205 (13-21)
QEIPEPLQL

SEQ ID NO: 6782 - protein, 9 aa, Artificial Sequence
  Fc receptor-like A (166-174)
QELFPAPIL

SEQ ID NO: 6783 - protein, 11 aa, Artificial Sequence
  40S ribosomal protein S9 (27-37)
QELKLIGEYGL

SEQ ID NO: 6784 - protein, 12 aa, Artificial Sequence
  Heterogeneous nuclear ribonucleoprotein H (438-449)
QENSSDFQSNIA

SEQ ID NO: 6785 - protein, 11 aa, Artificial Sequence
  T-complex protein 1 subunit theta (95-105)
QEVGDGTNFVL

SEQ ID NO: 6786 - protein, 8 aa, Artificial Sequence
  Coatomer subunit epsilon (97-104)
RDSIVAEL

SEQ ID NO: 6787 - protein, 10 aa, Artificial Sequence
  Ribosome-binding protein 1 (360-369)
REAEETQSTL

SEQ ID NO: 6788 - protein, 11 aa, Artificial Sequence
  Nodal modulator 2 (274-284)
REDGSFSFYSL

SEQ ID NO: 6789 - protein, 9 aa, Artificial Sequence
  Guanine nucleotide-binding protein G(s) subunit alpha isoforms short (244-252)
REDNQTNRL

SEQ ID NO: 6790 - protein, 9 aa, Artificial Sequence
  Nucleolar complex protein 2 homolog (609-617)
REEGTPLTL

SEQ ID NO: 6791 - protein, 9 aa, Artificial Sequence
  DNA topoisomerase 1 (708-716)
REENKQIAL

SEQ ID NO: 6792 - protein, 9 aa, Artificial Sequence
  Eukaryotic initiation factor 4A-II (256-264)
REEWKLDTL

SEQ ID NO: 6793 - protein, 10 aa, Artificial Sequence
  Spermine synthase (251-260)
REFDYVINDL

SEQ ID NO: 6794 - protein, 10 aa, Artificial Sequence
  DNA mismatch repair protein Msh6 (1321-1330)
REFEKMNQSL

SEQ ID NO: 6795 - protein, 12 aa, Artificial Sequence
  Heterogeneous nuclear ribonucleoprotein R (69-80)
REFNEEGALSVL

SEQ ID NO: 6796 - protein, 9 aa, Artificial Sequence
  Inner centromere protein (47-55)
REFSKEPEL

SEQ ID NO: 6797 - protein, 9 aa, Artificial Sequence
  Eukaryotic translation initiation factor 3 subunit I (20-28)
REGDLLFTV

SEQ ID NO: 6798 - protein, 9 aa, Artificial Sequence
  ZW10 interactor (104-112)
REHVEAIKI

SEQ ID NO: 6799 - protein, 11 aa, Artificial Sequence
  ZW10 interactor (104-114)
REHVEAIKIGL

SEQ ID NO: 6800 - protein, 11 aa, Artificial Sequence
  Histone H3.3 (73-83)
REIAQDFKTDL

SEQ ID NO: 6801 - protein, 11 aa, Artificial Sequence
  Serine/threonine-protein phosphatase PP1-alpha catalytic subunit (21-31)
REIFLSQPILL

SEQ ID NO: 6802 - protein, 10 aa, Artificial Sequence
  Structural maintenance of chromosomes flexible hinge domain-containing protein 1 (393-402)
REIQDDMQTL

SEQ ID NO: 6803 - protein, 9 aa, Artificial Sequence
  DNA-dependent protein kinase catalytic subunit (2753-2761)
REKEIKSEL

SEQ ID NO: 6804 - protein, 9 aa, Artificial Sequence
  Actin-related protein 2 (125-133)
REKIVEVMF

SEQ ID NO: 6805 - protein, 9 aa, Artificial Sequence
  Aurora kinase A (151-159)
REKQSKFIL

SEQ ID NO: 6806 - protein, 10 aa, Artificial Sequence
  Myosin-9 (1110-1119)
RELESQISEL

SEQ ID NO: 6807 - protein, 10 aa, Artificial Sequence
  TRAF3-interacting JNK-activating modulator (73-82)
RELESQLHVL

SEQ ID NO: 6808 - protein, 11 aa, Artificial Sequence
  NADH dehydrogenase (ubiquinone) 1 alpha subcomplex subunit 13 (79-89)
RENLEEEAIIM

SEQ ID NO: 6809 - protein, 12 aa, Artificial Sequence
  T-complex protein 1 subunit delta (160-171)
RETLLNSATTSL

SEQ ID NO: 6810 - protein, 11 aa, Artificial Sequence
  Elongation factor 2 (80-90)
RETVSEESNVL

SEQ ID NO: 6811 - protein, 10 aa, Artificial Sequence
  Epsilon-sarcoglycan (213-222)
REVENPQNQL

SEQ ID NO: 6812 - protein, 9 aa, Artificial Sequence
  Protein disulfide-isomerase A6 (18-26)
REVIQSDSL

SEQ ID NO: 6813 - protein, 10 aa, Artificial Sequence
  Proteasome subunit beta type-4 (165-174)
REVLEKQPVL

SEQ ID NO: 6814 - protein, 9 aa, Artificial Sequence
  SWI/SNF complex subunit SMARCC2 (599-607)
REWTEQETL

SEQ ID NO: 6815 - protein, 10 aa, Artificial Sequence
  Transcription factor E2F7 (615-624)
REYEDGPLSL

SEQ ID NO: 6816 - protein, 11 aa, Artificial Sequence
  GDP-L-fucose synthase (38-48)
REYNEVEPIIL

SEQ ID NO: 6817 - protein, 11 aa, Artificial Sequence
  Vimentin (381-391)
REYQDLLNVKM

SEQ ID NO: 6818 - protein, 9 aa, Artificial Sequence
  Metastasis-associated protein MTA2 (188-196)
RQIDQFLVV

SEQ ID NO: 6819 - protein, 9 aa, Artificial Sequence
  Runt-related transcription factor 3 (264-272)
RSFPTLPTL

SEQ ID NO: 6820 - protein, 11 aa, Artificial Sequence
  HLA class I histocompatibility antigen, B-15 alpha chain (352-362)
SAQGSDVSLTA

SEQ ID NO: 6821 - protein, 9 aa, Artificial Sequence
  Asparagine synthetase (glutamine-hydrolyzing) (159-167)
SEAKGLVTL

SEQ ID NO: 6822 - protein, 9 aa, Artificial Sequence
  Chromodomain-helicase-DNA-binding protein 4 (1833-1841)
SEDPSHPSM

SEQ ID NO: 6823 - protein, 9 aa, Artificial Sequence
  SRA stem-loop-interacting RNA-binding protein, mitochondrial (69-77)
SEEGLRNAL

SEQ ID NO: 6824 - protein, 10 aa, Artificial Sequence
  Poly (ADP-ribose) polymerase 9 (292-301)
SEFILGKSEL

SEQ ID NO: 6825 - protein, 10 aa, Artificial Sequence
  Cold shock domain-containing protein E1 (183-192)
SEFKGDLETL

SEQ ID NO: 6826 - protein, 10 aa, Artificial Sequence
  Cold shock domain-containing protein E1 (519-528)
SEFSGDVDSL

SEQ ID NO: 6827 - protein, 9 aa, Artificial Sequence
  Zinc finger protein 451 (35-43)
SEGPLRPVL

SEQ ID NO: 6828 - protein, 9 aa, Artificial Sequence
  Protein SON (1526-1534)
SEHGINIDL

SEQ ID NO: 6829 - protein, 11 aa, Artificial Sequence
  Spectrin beta chain, non-erythrocytic 1 (1024-1034)
SEHPDQAQAIL

SEQ ID NO: 6830 - protein, 12 aa, Artificial Sequence
  Copper transport protein ATOX1 (44-55)
SEHSMDTLLATL

SEQ ID NO: 6831 - protein, 9 aa, Artificial Sequence
  Coatomer subunit zeta-1 (34-42)
SEIALLEGL

SEQ ID NO: 6832 - protein, 10 aa, Artificial Sequence
  Cyclin-dependent kinase 1 (208-217)
SEIDQLFRIF

SEQ ID NO: 6833 - protein, 9 aa, Artificial Sequence
  Rho guanine nucleotide exchange factor 18 (689-697)
SEIEGIQSL

SEQ ID NO: 6834 - protein, 10 aa, Artificial Sequence
  Neuroblast differentiation-associated protein AHNAK (845-854)
SEIKVPDVEL

SEQ ID NO: 6835 - protein, 10 aa, Artificial Sequence
  Eukaryotic translation initiation factor 4B (442-451)
SEKSLENETL

SEQ ID NO: 6836 - protein, 9 aa, Artificial Sequence
  116 kDa U5 small nuclear ribonucleoprotein component (91-99)
SELIRNVTL

SEQ ID NO: 6837 - protein, 11 aa, Artificial Sequence
  E3 ubiquitin-protein ligase UBR5 (466-476)
SELQGERIVSL

SEQ ID NO: 6838 - protein, 9 aa, Artificial Sequence
  Death-associated protein kinase 3 (429-437)
SEMRFVQDL

SEQ ID NO: 6839 - protein, 9 aa, Artificial Sequence
  Leucine-rich repeat-containing protein 47 (315-323)
SENPVPLTV

SEQ ID NO: 6840 - protein, 9 aa, Artificial Sequence
  Protein SON (197-205)
SEPHILETL

SEQ ID NO: 6841 - protein, 9 aa, Artificial Sequence
  Programmed cell death protein 5 (88-96)
SEQGLIEIL

SEQ ID NO: 6842 - protein, 9 aa, Artificial Sequence
  DNA replication licensing factor MCM4 (142-150)
SEQSLGQKL

SEQ ID NO: 6843 - protein, 9 aa, Artificial Sequence
  Guanylate-binding protein 1 (360-368)
SEREAIEVF

SEQ ID NO: 6844 - protein, 9 aa, Artificial Sequence
  Signal peptidase complex catalytic subunit SEC11C (57-65)
SESPIVVVL

SEQ ID NO: 6845 - protein, 9 aa, Artificial Sequence
  Actin-related protein 2/3 complex subunit 1B (242-250)
SETLPLLAL

SEQ ID NO: 6846 - protein, 12 aa, Artificial Sequence
  Annexin A2 (296-307)
SEVDMLKIRSEF

SEQ ID NO: 6847 - protein, 9 aa, Artificial Sequence
  Proteasome maturation protein (124-132)
SEVMGEPHL

SEQ ID NO: 6848 - protein, 9 aa, Artificial Sequence
  AP-1 complex subunit beta-1 (347-355)
SQANIAQVL

SEQ ID NO: 6849 - protein, 9 aa, Artificial Sequence
  Rab GTPase-activating protein 1-like (162-170)
SQYPFPVTL

SEQ ID NO: 6850 - protein, 11 aa, Artificial Sequence
  Probable ATP-dependent RNA helicase DDX41 (118-128)
SVAEGRALMSV

SEQ ID NO: 6851 - protein, 9 aa, Artificial Sequence
  General vesicular transport factor p115 (18-26)
TEAETIQKL

SEQ ID NO: 6852 - protein, 9 aa, Artificial Sequence
  SH2 domain-containing protein 3C (769-777)
TEHGVEVVL

SEQ ID NO: 6853 - protein, 10 aa, Artificial Sequence
  Nucleolin (452-461)
TEIDGRSISL

SEQ ID NO: 6854 - protein, 9 aa, Artificial Sequence
  Adenosylhomocysteinase (244-252)
TEIDPINAL

SEQ ID NO: 6855 - protein, 10 aa, Artificial Sequence
  Polyadenylate-binding protein-interacting protein 1 (66-75)
TEIEQFAETL

SEQ ID NO: 6856 - protein, 9 aa, Artificial Sequence
  Suppressor of SWI4 1 homolog (72-80)
TEIGPRMTL

SEQ ID NO: 6857 - protein, 11 aa, Artificial Sequence
  Microtubule-associated protein 4 (428-438)
TEISSAEKVAL

SEQ ID NO: 6858 - protein, 8 aa, Artificial Sequence
  Histone H3.1 (59-66)
TELLIRKL

SEQ ID NO: 6859 - protein, 10 aa, Artificial Sequence
  Chromodomain-helicase-DNA-binding protein 4 (1265-1274)
TELQGMNEYL

SEQ ID NO: 6860 - protein, 11 aa, Artificial Sequence
  Transcription factor BTF3 (106-116)
TEMLPSILNQL

SEQ ID NO: 6861 - protein, 9 aa, Artificial Sequence
  Probable ATP-dependent RNA helicase DDX6 (6-14)
TENPVIMGL

SEQ ID NO: 6862 - protein, 9 aa, Artificial Sequence
  Poly(rC)-binding protein 1 (6-14)
TESGLNVTL

SEQ ID NO: 6863 - protein, 9 aa, Artificial Sequence
  Steroid hormone receptor ERR1 (88-96)
TETEPPVAL

SEQ ID NO: 6864 - protein, 8 aa, Artificial Sequence
  Elongation factor 1-alpha 1 (287-294)
TEVKSVEM

SEQ ID NO: 6865 - protein, 9 aa, Artificial Sequence
  Pinin (538-546)
TEVPVEPVL

SEQ ID NO: 6866 - protein, 9 aa, Artificial Sequence
  Cytoskeleton-associated protein 4 (55-63)
TEVRELVSL

SEQ ID NO: 6867 - protein, 9 aa, Artificial Sequence
  Asparagine synthetase (glutamine-hydrolyzing) (269-277)
TLLKQLKEA

SEQ ID NO: 6868 - protein, 11 aa, Artificial Sequence
  Integrin beta-7 (702-712)
VEDDARGTVVL

SEQ ID NO: 6869 - protein, 10 aa, Artificial Sequence
  Eukaryotic translation initiation factor 3 subunit A (253-262)
VEDIHGLFSL

SEQ ID NO: 6870 - protein, 11 aa, Artificial Sequence
  Serine/threonine-protein phosphatase 2A 65 kDa regulatory subunit A alpha isoform (436-446)
VEFFDEKLNSL

SEQ ID NO: 6871 - protein, 9 aa, Artificial Sequence
  F-box only protein 7 (135-143)
VEGQVPHSL

SEQ ID NO: 6872 - protein, 9 aa, Artificial Sequence
  GPN-loop GTPase 2 (169-177)
VELPHINLL

SEQ ID NO: 6873 - protein, 9 aa, Artificial Sequence
  Melanoma-associated antigen 12 (279-287)
VETSYVKVL

SEQ ID NO: 6874 - protein, 9 aa, Artificial Sequence
  Melanoma-associated antigen D2 (37-45)
VEVPETPKA

SEQ ID NO: 6875 - protein, 9 aa, Artificial Sequence
  Vigilin (656-664)
VEVSIPAKL

SEQ ID NO: 6876 - protein, 9 aa, Artificial Sequence
  Basic leucine zipper and W2 domain-containing protein 2 (305-313)
VEWNKKEEL

SEQ ID NO: 6877 - protein, 10 aa, Artificial Sequence
  Stomatin-like protein 3 (151-160)
VLGTQTLSQI

SEQ ID NO: 6878 - protein, 9 aa, Artificial Sequence
  Condensin complex subunit 1 (162-170)
WEEERQPIL

SEQ ID NO: 6879 - protein, 9 aa, Artificial Sequence
  Catenin beta-1 (66-74)
WEQGFSQSF

SEQ ID NO: 6880 - protein, 9 aa, Artificial Sequence
  Myosin light polypeptide 6 (141-149)
YEELVRMVL

SEQ ID NO: 6881 - protein, 10 aa, Artificial Sequence
  Nucleophosmin (67-76)
YEGSPIKVTL

SEQ ID NO: 6882 - protein, 9 aa, Artificial Sequence
  60S ribosomal protein L6 (240-248)
YEITEQRKI

SEQ ID NO: 6883 - protein, 10 aa, Artificial Sequence
  Septin-11 (95-104)
YELQESNVRL

SEQ ID NO: 6884 - protein, 10 aa, Artificial Sequence
  Glutamine-dependent NAD(+) synthetase (58-67)
YESDTLLHSF

SEQ ID NO: 6885 - protein, 12 aa, Artificial Sequence
  Mitogen-activated protein kinase kinase kinase 5 (675-686)
YEYDENGDRVVL

SEQ ID NO: 6886 - protein, 9 aa, Artificial Sequence
  60S ribosomal protein L7a (158-166)
AHDVDPIEL

SEQ ID NO: 6887 - protein, 10 aa, Artificial Sequence
  40S ribosomal protein S29 (47-56)
AKDIGFIKLD

SEQ ID NO: 6888 - protein, 8 aa, Artificial Sequence
  Long-chain-fatty-acid-CoA ligase 4 (42-49)
FDHAVSKF

SEQ ID NO: 6889 - protein, 9 aa, Artificial Sequence
  Eukaryotic translation initiation factor 3 subunit L (478-486)
FLDLTEQEF

SEQ ID NO: 6890 - protein, 9 aa, Artificial Sequence
  Ubiquitin-like modifier-activating enzyme 1 (637-645)
FPNAIEHTL

SEQ ID NO: 6891 - protein, 9 aa, Artificial Sequence
  Bcl-2-associated transcription factor 1 (338-346)
FTDEESRVF

SEQ ID NO: 6892 - protein, 10 aa, Artificial Sequence
  Bcl-2-associated transcription factor 1 (338-347)
FTDEESRVFL

SEQ ID NO: 6893 - protein, 9 aa, Artificial Sequence
  Disco-interacting protein 2 homolog B (444-452)
FYDERIVVV

SEQ ID NO: 6894 - protein, 9 aa, Artificial Sequence
  WD repeat-containing protein 46 (188-196)
HFDLNLRQF

SEQ ID NO: 6895 - protein, 10 aa, Artificial Sequence
  HLA class I histocompatibility antigen, A-24 alpha chain (216-225)
HPISDHEATL

SEQ ID NO: 6896 - protein, 9 aa, Artificial Sequence
  Integrator complex subunit 2 (1006-1014)
IADPNIAKL

SEQ ID NO: 6897 - protein, 9 aa, Artificial Sequence
  Heterogeneous nuclear ribonucleoprotein M (188-196)
IPNEIIHAL

SEQ ID NO: 6898 - protein, 9 aa, Artificial Sequence
  UPF0428 protein CXorf56 (100-108)
IVDGAVVKF

SEQ ID NO: 6899 - protein, 9 aa, Artificial Sequence
  Long-chain-fatty-acid-CoA ligase 4 (41-49)
LFDHAVSKF

SEQ ID NO: 6900 - protein, 9 aa, Artificial Sequence
  Cleavage stimulation factor subunit 1 (370-378)
LPDERTISL

SEQ ID NO: 6901 - protein, 10 aa, Artificial Sequence
  Nucleolar transcription factor 1 (365-374)
LPEEEQQRVL

SEQ ID NO: 6902 - protein, 9 aa, Artificial Sequence
  Microtubule-associated protein 4 (308-316)
LPTEKEVAL

SEQ ID NO: 6903 - protein, 8 aa, Artificial Sequence
  Fructose-bisphosphate aldolase A (271-278)
LSDHHIYL

SEQ ID NO: 6904 - protein, 9 aa, Artificial Sequence
  MMS19 nucleotide excision repair protein homolog (636-644)
MPEKEPSVL

SEQ ID NO: 6905 - protein, 9 aa, Artificial Sequence
  AF4/FMR2 family member 4 (1053-1061)
MPSPVSPKL

SEQ ID NO: 6906 - protein, 9 aa, Artificial Sequence
  Ras-related C3 botulinum toxin substrate 1 (45-53)
MVDGKPVNL

SEQ ID NO: 6907 - protein, 9 aa, Artificial Sequence
  Bone morphogenetic protein receptor type-1B (507-515)
NPASRLTAL

SEQ ID NO: 6908 - protein, 9 aa, Artificial Sequence
  Multiple epidermal growth factor-like domains protein 8 (2530-2538)
PAPPPPPPP

SEQ ID NO: 6909 - protein, 10 aa, Artificial Sequence
  Keratin, type II cytoskeletal 1 (338-347)
SMDNNRSLDL

SEQ ID NO: 6910 - protein, 9 aa, Artificial Sequence
  Nuclear pore complex protein Nup155 (220-228)
STDNGRIFL

SEQ ID NO: 6911 - protein, 9 aa, Artificial Sequence
  Coatomer subunit epsilon (111-119)
SVDVTNTTF

SEQ ID NO: 6912 - protein, 9 aa, Artificial Sequence
  Fatty acid synthase (545-553)
TFDDIVHSF

SEQ ID NO: 6913 - protein, 9 aa, Artificial Sequence
  Tumor suppressor candidate 3 (165-173)
TFDLQRIGF

SEQ ID NO: 6914 - protein, 9 aa, Artificial Sequence
  Rho GTPase-activating protein 24 (436-444)
TYDNVHQQF

SEQ ID NO: 6915 - protein, 9 aa, Artificial Sequence
  ATP-dependent RNA helicase A (697-705)
VFDPVPVGV

SEQ ID NO: 6916 - protein, 10 aa, Artificial Sequence
  10 kDa heat shock protein, mitochondrial (81-90)
VLDDKDYFLF

SEQ ID NO: 6917 - protein, 10 aa, Artificial Sequence
  Metastasis-associated protein MTA3 (135-144)
VYDPSLKTLL

SEQ ID NO: 6918 - protein, 8 aa, Artificial Sequence
  ADP-ribosylation factor GTPase-activating protein 3 (312-319)
YFDEPVEL

SEQ ID NO: 6919 - protein, 9 aa, Artificial Sequence
  Transcription factor HES-1 (155-163)
YPGQPHPAL

SEQ ID NO: 6920 - protein, 9 aa, Artificial Sequence
  Nuclear nucleic acid-binding protein C1D (10-18)
YPVEIHEYL

SEQ ID NO: 6921 - protein, 9 aa, Artificial Sequence
  Pecanex-like protein 1 (22-30)
YYDPHQATF

SEQ ID NO: 6922 - protein, 9 aa, Artificial Sequence
  ATP-binding cassette sub-family F member 3 (500-508)
YYDPKHVIF

SEQ ID NO: 6923 - protein, 10 aa, Artificial Sequence
  Melanoma antigen preferentially expressed in tumors (300-309)
ALYVDSLFFL

SEQ ID NO: 6924 - protein, 9 aa, Artificial Sequence
  Fatty acid synthase (986-994)
AQAEVYKEL

SEQ ID NO: 6925 - protein, 10 aa, Artificial Sequence
  2',3'-cyclic-nucleotide 3'-phosphodiesterase (249-258)
AQQDVLKKSY

SEQ ID NO: 6926 - protein, 8 aa, Artificial Sequence
  Cytochrome c oxidase subunit 2 (156-163)
SQDVLHSW

SEQ ID NO: 6927 - protein, 9 aa, Artificial Sequence
  RNA exonuclease 4 (126-134)
ARVSIVNQY

SEQ ID NO: 6928 - protein, 10 aa, Artificial Sequence
  RNA-binding protein 14 (646-655)
ARYSGSYNDY

SEQ ID NO: 6929 - protein, 10 aa, Artificial Sequence
  Talin-1 (1272-1281)
GRFGQDFSTF

SEQ ID NO: 6930 - protein, 9 aa, Artificial Sequence
  YTH domain-containing family protein 2 (30-38)
GRVFIIKSY

SEQ ID NO: 6931 - protein, 9 aa, Artificial Sequence
  ATP-dependent RNA helicase DDX42 (228-236)
KRFGKAYNL

SEQ ID NO: 6932 - protein, 9 aa, Artificial Sequence
  Eukaryotic translation initiation factor 3 subunit E (73-81)
KRTTVVAQL

SEQ ID NO: 6933 - protein, 9 aa, Artificial Sequence
  Proteasome subunit beta type-5 (113-121)
RRAIYQATY

SEQ ID NO: 6934 - protein, 9 aa, Artificial Sequence
  DNA replication licensing factor MCM5 (602-610)
RRSSIPITV

SEQ ID NO: 6935 - protein, 13 aa, Artificial Sequence
  HLA class I histocompatibility antigen, B-15 alpha chain (193-205)
RRYLENGKETLQR

SEQ ID NO: 6936 - protein, 10 aa, Artificial Sequence
  Probable bifunctional methylenetetrahydrofolate dehydrogenase/cyclohydrolase 2 (246-255)
HRYTPKEQLK

SEQ ID NO: 6937 - protein, 9 aa, Artificial Sequence
  60S ribosomal protein L7 (199-207)
KRFKEANNF

SEQ ID NO: 6938 - protein, 15 aa, Artificial Sequence
  Heat shock 70 kDa protein 1-like (171-185)
VLRIINEPTAAAIAY

SEQ ID NO: 6939 - protein, 9 aa, Artificial Sequence
  Polypyrimidine tract-binding protein 1 (169-177)
AAVDAGMAM

SEQ ID NO: 6940 - protein, 11 aa, Artificial Sequence
  HLA class I histocompatibility antigen, alpha chain E (137-147)
FAYDGKDYLTL

SEQ ID NO: 6941 - protein, 14 aa, Artificial Sequence
  HLA class I histocompatibility antigen, A-29 alpha chain (21-34)
FIAVGYVDDTQFVR

SEQ ID NO: 6942 - protein, 10 aa, Artificial Sequence
  Ubiquitin-like protein ISG15 (45-54)
LAVHPSGVAL

SEQ ID NO: 6943 - protein, 9 aa, Artificial Sequence
  N-acetyltransferase 8 (174-182)
ILDTGTIQL

SEQ ID NO: 6944 - protein, 9 aa, Artificial Sequence
  Protein prune homolog 2 (1910-1918)
ALFDGDPHL

SEQ ID NO: 6945 - protein, 9 aa, Artificial Sequence
  Phosphatidylinositol 4,5-bisphosphate 3-kinase catalytic subunit delta isoform (477-485)
EVAPHPVYY

SEQ ID NO: 6946 - protein, 9 aa, Artificial Sequence
  Chloride intracellular channel protein 1 (167-175)
FLDGNELTL

SEQ ID NO: 6947 - protein, 9 aa, Artificial Sequence
  Carbonic anhydrase 9 (254-262)
HLSTAFARV

SEQ ID NO: 6948 - protein, 9 aa, Artificial Sequence
  40S ribosomal protein S16 (49-57)
KLLEPVLLL

SEQ ID NO: 6949 - protein, 9 aa, Artificial Sequence
  Glutathione peroxidase 1 (40-48)
LLIENVASL

SEQ ID NO: 6950 - protein, 9 aa, Artificial Sequence
  Proliferating cell nuclear antigen (228-236)
SMSADVPLV

SEQ ID NO: 6951 - protein, 13 aa, Artificial Sequence
  Dermokine (410-422)
AIIEGADASSLQK

SEQ ID NO: 6952 - protein, 11 aa, Artificial Sequence
  PRELI domain-containing protein 1, mitochondrial (142-152)
AVQEFGLARFK

SEQ ID NO: 6953 - protein, 9 aa, Artificial Sequence
  Putative WAS protein family homolog 3 (42-50)
KVSGDIFSR

SEQ ID NO: 6954 - protein, 13 aa, Artificial Sequence
  Mitochondrial import inner membrane translocase subunit Tim23 (156-168)
TVAAGTMTGMLYK

SEQ ID NO: 6955 - protein, 11 aa, Artificial Sequence
  Tryptophan-tRNA ligase, mitochondrial (162-172)
VLQAADILLYK

SEQ ID NO: 6956 - protein, 9 aa, Artificial Sequence
  Cytochrome c oxidase subunit 6A1, mitochondrial (29-37)
VSMLNVYLK

SEQ ID NO: 6957 - protein, 9 aa, Artificial Sequence
  40S ribosomal protein S4, X isoform (171-179)
GRIGVITNR

SEQ ID NO: 6958 - protein, 17 aa, Artificial Sequence
  SLAM family member 6 (103-119)
DTGSYRAQISTKTSAKL

SEQ ID NO: 6959 - protein, 15 aa, Artificial Sequence
  Transferrin receptor protein 1 (680-694)
RVEYHFLSPYVSPKE

SEQ ID NO: 6960 - protein, 18 aa, Artificial Sequence
  Transferrin receptor protein 1 (680-697)
RVEYHFLSPYVSPKESPF

SEQ ID NO: 6961 - protein, 15 aa, Artificial Sequence
  HLA class I histocompatibility antigen, A-1 alpha chain (28-42)
DDTQFVRFDSDAASQ

SEQ ID NO: 6962 - protein, 16 aa, Artificial Sequence
  HLA class I histocompatibility antigen, A-2 alpha chain (28-43)
DDTQFVRFDSDAASQR

SEQ ID NO: 6963 - protein, 17 aa, Artificial Sequence
  HLA class I histocompatibility antigen, A-2 alpha chain (28-44)
DDTQFVRFDSDAASQRM

SEQ ID NO: 6964 - protein, 18 aa, Artificial Sequence
  HLA class I histocompatibility antigen, A-2 alpha chain (28-45)
DDTQFVRFDSDAASQRME

SEQ ID NO: 6965 - protein, 17 aa, Artificial Sequence
  HLA class I histocompatibility antigen, Cw-7 alpha chain (153-169)
DLRSWTAADTAAQITQR

SEQ ID NO: 6966 - protein, 13 aa, Artificial Sequence
  HLA class I histocompatibility antigen, alpha chain E (140-152)
DLRSWTAVDTAAQ

SEQ ID NO: 6967 - protein, 16 aa, Artificial Sequence
  HLA class I histocompatibility antigen, A-2 alpha chain (29-44)
DTQFVRFDSDAASQRM

SEQ ID NO: 6968 - protein, 18 aa, Artificial Sequence
  HLA class I histocompatibility antigen, Cw-7 alpha chain (152-169)
EDLRSWTAADTAAQITQR

SEQ ID NO: 6969 - protein, 18 aa, Artificial Sequence
  HLA class I histocompatibility antigen, B-15 alpha chain (152-169)
EDLSSWTAADTAAQITQR

SEQ ID NO: 6970 - protein, 12 aa, Artificial Sequence
  HLA class I histocompatibility antigen, A-2 alpha chain (32-43)
FVRFDSDAASQR

SEQ ID NO: 6971 - protein, 15 aa, Artificial Sequence
  Heat shock cognate 71 kDa protein (484-498)
GILNVSAVDKSTGKE

SEQ ID NO: 6972 - protein, 14 aa, Artificial Sequence
  HLA class I histocompatibility antigen, B-15 alpha chain (154-167)
LSSWTAADTAAQIT

SEQ ID NO: 6973 - protein, 16 aa, Artificial Sequence
  HLA class I histocompatibility antigen, B-15 alpha chain (154-169)
LSSWTAADTAAQITQR

SEQ ID NO: 6974 - protein, 18 aa, Artificial Sequence
  HLA class I histocompatibility antigen, Cw-7 alpha chain (151-168)
NEDLRSWTAADTAAQITQ

SEQ ID NO: 6975 - protein, 14 aa, Artificial Sequence
  HLA class I histocompatibility antigen, B-15 alpha chain (155-168)
SSWTAADTAAQITQ

SEQ ID NO: 6976 - protein, 14 aa, Artificial Sequence
  HLA class I histocompatibility antigen, B-15 alpha chain (55-68)
TQFVRFDSDAASPR

SEQ ID NO: 6977 - protein, 14 aa, Artificial Sequence
  HLA class I histocompatibility antigen, A-2 alpha chain (30-43)
TQFVRFDSDAASQR

SEQ ID NO: 6978 - protein, 16 aa, Artificial Sequence
  HLA class I histocompatibility antigen, A-1 alpha chain (27-42)
VDDTQFVRFDSDAASQ

SEQ ID NO: 6979 - protein, 18 aa, Artificial Sequence
  HLA class I histocompatibility antigen, A-2 alpha chain (27-44)
VDDTQFVRFDSDAASQRM

SEQ ID NO: 6980 - protein, 9 aa, Artificial Sequence
  Ankyrin repeat domain-containing protein 17 (744-752)
APRVPVQAL

SEQ ID NO: 6981 - protein, 9 aa, Artificial Sequence
  Probable ubiquitin carboxyl-terminal hydrolase FAF-Y (2050-2058)
ARFLFTTGF

SEQ ID NO: 6982 - protein, 14 aa, Artificial Sequence
  Transferrin receptor protein 1 (15-28)
GEPLSYTRFSLARQ

SEQ ID NO: 6983 - protein, 16 aa, Artificial Sequence
  Transferrin receptor protein 1 (15-30)
GEPLSYTRFSLARQVD

SEQ ID NO: 6984 - protein, 17 aa, Artificial Sequence
  Transferrin receptor protein 1 (14-30)
GGEPLSYTRFSLARQVD

SEQ ID NO: 6985 - protein, 18 aa, Artificial Sequence
  Transferrin receptor protein 1 (14-31)
GGEPLSYTRFSLARQVDG

SEQ ID NO: 6986 - protein, 9 aa, Artificial Sequence
  Annexin A3 (33-41)
GIGTDEKML

SEQ ID NO: 6987 - protein, 9 aa, Artificial Sequence
  Microtubule-associated protein 1B (225-233)
GLSEFTEYL

SEQ ID NO: 6988 - protein, 9 aa, Artificial Sequence
  SCAN domain-containing protein 1 (121-129)
GPREAFRQL

SEQ ID NO: 6989 - protein, 9 aa, Artificial Sequence
  Splicing factor 3B subunit 3 (430-438)
GPRSSLRVL

SEQ ID NO: 6990 - protein, 9 aa, Artificial Sequence
  Glyoxylate reductase/hydroxypyruvate reductase (162-170)
GRIGQAIAR

SEQ ID NO: 6991 - protein, 10 aa, Artificial Sequence
  40S ribosomal protein S11 (70-79)
GRILSGVVTK

SEQ ID NO: 6992 - protein, 9 aa, Artificial Sequence
  Eukaryotic initiation factor 4A-II (368-376)
GRKGVAINF

SEQ ID NO: 6993 - protein, 9 aa, Artificial Sequence
  40S ribosomal protein S4, Y isoform 1 (190-198)
GRVGVITNR

SEQ ID NO: 6994 - protein, 9 aa, Artificial Sequence
  Splicing factor 3B subunit 3 (957-965)
GRVLIGVGK

SEQ ID NO: 6995 - protein, 10 aa, Artificial Sequence
  Nucleolar RNA helicase 2 (403-412)
IPQKQREITL

SEQ ID NO: 6996 - protein, 9 aa, Artificial Sequence
  Probable ATP-dependent RNA helicase DDX4 (355-363)
ITASRFKEL

SEQ ID NO: 6997 - protein, 9 aa, Artificial Sequence
  EH domain-containing protein 2 (480-488)
KLPNSVLGR

SEQ ID NO: 6998 - protein, 9 aa, Artificial Sequence
  Speriolin-like protein (246-254)
KLRELTQRY

SEQ ID NO: 6999 - protein, 9 aa, Artificial Sequence
  Ubiquitin carboxyl-terminal hydrolase 45 (297-305)
LLHYLLDAV

SEQ ID NO: 7000 - protein, 9 aa, Artificial Sequence
  40S ribosomal protein S4, X isoform (238-246)
LPRGKGIRL

SEQ ID NO: 7001 - protein, 10 aa, Artificial Sequence
  DNA replication licensing factor MCM6 (215-224)
LPRGSIPRSL

SEQ ID NO: 7002 - protein, 11 aa, Artificial Sequence
  2',3'-cyclic-nucleotide 3'-phosphodiesterase (303-313)
LPRGSRAHITL

SEQ ID NO: 7003 - protein, 9 aa, Artificial Sequence
  39S ribosomal protein L20, mitochondrial (89-97)
NLVKCQVEL

SEQ ID NO: 7004 - protein, 11 aa, Artificial Sequence
  Trinucleotide repeat-containing gene 18 protein (554-564)
NRKALAKGLGL

SEQ ID NO: 7005 - protein, 11 aa, Artificial Sequence
  Transmembrane emp24 domain-containing protein 4 (23-33)
NYPEIAAKDKL

SEQ ID NO: 7006 - protein, 9 aa, Artificial Sequence
  Lymphocyte antigen 75 (791-799)
QIPKGRTPK

SEQ ID NO: 7007 - protein, 9 aa, Artificial Sequence
  Ribonucleoside-diphosphate reductase large subunit (742-750)
RPAANPIQF

SEQ ID NO: 7008 - protein, 9 aa, Artificial Sequence
  Aldo-keto reductase family 1 member C1 (91-99)
RPELVRPAL

SEQ ID NO: 7009 - protein, 10 aa, Artificial Sequence
  Protein phosphatase 1 regulatory subunit 35 (234-243)
RPRPSEDTFL

SEQ ID NO: 7010 - protein, 9 aa, Artificial Sequence
  Frizzled-2 (2-10)
RPRSALPRL

SEQ ID NO: 7011 - protein, 9 aa, Artificial Sequence
  HLA class I histocompatibility antigen, alpha chain E (25-33)
SLKYFHTSV

SEQ ID NO: 7012 - protein, 9 aa, Artificial Sequence
  Histone H2B type 2-F (79-87)
SRLAHYNKR

SEQ ID NO: 7013 - protein, 9 aa, Artificial Sequence
  EH domain-containing protein 2 (484-492)
SVLGRIWKL

SEQ ID NO: 7014 - protein, 11 aa, Artificial Sequence
  Heterogeneous nuclear ribonucleoprotein K (78-88)
VPDSSGPERIL

SEQ ID NO: 7015 - protein, 9 aa, Artificial Sequence
  Vimentin (216-224)
ARLDLERKV

SEQ ID NO: 7016 - protein, 9 aa, Artificial Sequence
  E3 ubiquitin-protein ligase HECTD1 (174-182)
ARLGVISKV

SEQ ID NO: 7017 - protein, 10 aa, Artificial Sequence
  V-type proton ATPase subunit S1 (217-226)
ARLSLTYERL

SEQ ID NO: 7018 - protein, 9 aa, Artificial Sequence
  Peroxisomal membrane protein PEX16 (38-46)
GRFADSHEL

SEQ ID NO: 7019 - protein, 10 aa, Artificial Sequence
  40S ribosomal protein S21 (44-53)
GRFNGQFKTY

SEQ ID NO: 7020 - protein, 9 aa, Artificial Sequence
  Pro-interleukin-16 (881-889)
GRFSGLLGR

SEQ ID NO: 7021 - protein, 9 aa, Artificial Sequence
  60S ribosomal protein L13a (17-25)
GRLAAIVAK

SEQ ID NO: 7022 - protein, 9 aa, Artificial Sequence
  Leucine-tRNA ligase, cytoplasmic (57-65)
GRLHLGHTF

SEQ ID NO: 7023 - protein, 9 aa, Artificial Sequence
  Amidophosphoribosyltransferase (354-362)
GRTFIQPNM

SEQ ID NO: 7024 - protein, 9 aa, Artificial Sequence
  Ubiquitin-60S ribosomal protein L40 (58-66)
GRTLSDYNI

SEQ ID NO: 7025 - protein, 10 aa, Artificial Sequence
  Lamin-B receptor (14-23)
GRWPGSSLYY

SEQ ID NO: 7026 - protein, 9 aa, Artificial Sequence
  40S ribosomal protein S25 (103-111)
HRAQVIYTR

SEQ ID NO: 7027 - protein, 9 aa, Artificial Sequence
  Transcription activator BRG1 (1255-1263)
HRIGQQNEV

SEQ ID NO: 7028 - protein, 9 aa, Artificial Sequence
  H/ACA ribonucleoprotein complex subunit 3 (44-52)
HRITIKKRF

SEQ ID NO: 7029 - protein, 10 aa, Artificial Sequence
  Heterogeneous nuclear ribonucleoprotein H (274-283)
HRYGDGGSTF

SEQ ID NO: 7030 - protein, 9 aa, Artificial Sequence
  Histone H2A type 1-A (88-96)
IRNDEELNK

SEQ ID NO: 7031 - protein, 9 aa, Artificial Sequence
  Hsc70-interacting protein (153-161)
KRASVFVKL

SEQ ID NO: 7032 - protein, 9 aa, Artificial Sequence
  Signal peptidase complex subunit 2 (164-172)
KRFDDKYTL

SEQ ID NO: 7033 - protein, 9 aa, Artificial Sequence
  YEATS domain-containing protein 2 (299-307)
KRIDIIHNL

SEQ ID NO: 7034 - protein, 9 aa, Artificial Sequence
  Protein arginine N-methyltransferase 1 (266-274)
KRNDYVHAL

SEQ ID NO: 7035 - protein, 9 aa, Artificial Sequence
  Cyclic AMP-responsive element-binding protein 3-like protein 2 (270-278)
KRTLIAEGY

SEQ ID NO: 7036 - protein, 10 aa, Artificial Sequence
  DNA-dependent protein kinase catalytic subunit (263-272)
KRYAVPSAGL

SEQ ID NO: 7037 - protein, 9 aa, Artificial Sequence
  Small nuclear ribonucleoprotein Sm D2 (110-118)
LRNPLIAGK

SEQ ID NO: 7038 - protein, 10 aa, Artificial Sequence
  Solute carrier family 25 member 46 (98-107)
NRFAGFGIGL

SEQ ID NO: 7039 - protein, 9 aa, Artificial Sequence
  General transcription factor II-I (491-499)
NRIKFVIKR

SEQ ID NO: 7040 - protein, 9 aa, Artificial Sequence
  L-lactate dehydrogenase A chain (111-119)
QRNVNIFKF

SEQ ID NO: 7041 - protein, 9 aa, Artificial Sequence
  Annexin A2 (67-75)
QRQDIAFAY

SEQ ID NO: 7042 - protein, 12 aa, Artificial Sequence
  40S ribosomal protein S30 (114-125)
RRFVNVVPTFGK

SEQ ID NO: 7043 - protein, 9 aa, Artificial Sequence
  2'-5'-oligoadenylate synthase 1 (94-102)
RRGEFIQEI

SEQ ID NO: 7044 - protein, 10 aa, Artificial Sequence
  NADH dehydrogenase (ubiquinone) 1 alpha subcomplex subunit 1 (52-61)
RRISGVDRYY

SEQ ID NO: 7045 - protein, 10 aa, Artificial Sequence
  Protein disulfide-isomerase A3 (4-13)
RRLALFPGVA

SEQ ID NO: 7046 - protein, 9 aa, Artificial Sequence
  Reticulocalbin-1 (8-16)
RRLGLALGL

SEQ ID NO: 7047 - protein, 9 aa, Artificial Sequence
  S-adenosylmethionine synthase isoform type-1 (312-320)
RRVLVQVSY

SEQ ID NO: 7048 - protein, 11 aa, Artificial Sequence
  Probable ATP-dependent RNA helicase DDX5 (24-34)
SRAGPLSGKKF

SEQ ID NO: 7049 - protein, 9 aa, Artificial Sequence
  Membralin (120-128)
SRAPVFLQF

SEQ ID NO: 7050 - protein, 10 aa, Artificial Sequence
  Dynamin-like 120 kDa protein, mitochondrial (499-508)
SRIQQIIEGK

SEQ ID NO: 7051 - protein, 9 aa, Artificial Sequence
  Growth hormone-inducible transmembrane protein (146-154)
SRTPVLMNF

SEQ ID NO: 7052 - protein, 10 aa, Artificial Sequence
  Clathrin heavy chain 1 (1341-1350)
SRVNIPKVLR

SEQ ID NO: 7053 - protein, 9 aa, Artificial Sequence
  Heat shock-related 70 kDa protein 2 (344-352)
TRIPKIQKL

SEQ ID NO: 7054 - protein, 9 aa, Artificial Sequence
  Polyadenylate-binding protein 1 (289-297)
TRYQGVNLY

SEQ ID NO: 7055 - protein, 11 aa, Artificial Sequence
  Histone H2B type 2-F (99-109)
VRLLLPGELAK

SEQ ID NO: 7056 - protein, 10 aa, Artificial Sequence
  Eukaryotic translation initiation factor 3 subunit B (340-349)
VRWSPKGTYL

SEQ ID NO: 7057 - protein, 9 aa, Artificial Sequence
  Ras-specific guanine nucleotide-releasing factor 1 (983-991)
AAANIIRTL

SEQ ID NO: 7058 - protein, 9 aa, Artificial Sequence
  Cytoskeleton-associated protein 4 (73-81)
AADTERLAL

SEQ ID NO: 7059 - protein, 14 aa, Artificial Sequence
  Voltage-dependent anion-selective channel protein 2 (222-235)
AAKYQLDPTASISA

SEQ ID NO: 7060 - protein, 9 aa, Artificial Sequence
  RNA polymerase II subunit A C-terminal domain phosphatase (41-49)
AAVRIGSVL

SEQ ID NO: 7061 - protein, 12 aa, Artificial Sequence
  Protein unc-13 homolog D (1011-1022)
ADDLEGEAFLPL

SEQ ID NO: 7062 - protein, 13 aa, Artificial Sequence
  Protein unc-13 homolog D (1011-1023)
ADDLEGEAFLPLR

SEQ ID NO: 7063 - protein, 14 aa, Artificial Sequence
  Protein unc-13 homolog D (1011-1024)
ADDLEGEAFLPLRE

SEQ ID NO: 7064 - protein, 15 aa, Artificial Sequence
  SLAM family member 6 (47-61)
ADDNVSFRWEALGNT

SEQ ID NO: 7065 - protein, 16 aa, Artificial Sequence
  SLAM family member 6 (47-62)
ADDNVSFRWEALGNTL

SEQ ID NO: 7066 - protein, 12 aa, Artificial Sequence
  Golgi apparatus protein 1 (724-735)
ADIFVDPVLHTA

SEQ ID NO: 7067 - protein, 14 aa, Artificial Sequence
  Golgi apparatus protein 1 (1059-1072)
ADIFVDPVLHTACA

SEQ ID NO: 7068 - protein, 12 aa, Artificial Sequence
  Low affinity immunoglobulin epsilon Fc receptor (40-51)
ADLSSFKSQELN

SEQ ID NO: 7069 - protein, 14 aa, Artificial Sequence
  Low affinity immunoglobulin epsilon Fc receptor (40-53)
ADLSSFKSQELNER

SEQ ID NO: 7070 - protein, 15 aa, Artificial Sequence
  Low affinity immunoglobulin epsilon Fc receptor (40-54)
ADLSSFKSQELNERN

SEQ ID NO: 7071 - protein, 16 aa, Artificial Sequence
  Low affinity immunoglobulin epsilon Fc receptor (40-55)
ADLSSFKSQELNERNE

SEQ ID NO: 7072 - protein, 17 aa, Artificial Sequence
  Low affinity immunoglobulin epsilon Fc receptor (40-56)
ADLSSFKSQELNERNEA

SEQ ID NO: 7073 - protein, 16 aa, Artificial Sequence
  T-complex protein 1 subunit beta (163-178)
ADSYLDEGFLLDKKIG

SEQ ID NO: 7074 - protein, 9 aa, Artificial Sequence
  Eukaryotic translation initiation factor 6 (130-138)
ADVLKVEVF

SEQ ID NO: 7075 - protein, 9 aa, Artificial Sequence
  Proline-rich protein 12 (390-398)
AEEAGGTRL

SEQ ID NO: 7076 - protein, 9 aa, Artificial Sequence
  Probable ribonuclease ZC3H12D (154-162)
AELERQAVL

SEQ ID NO: 7077 - protein, 10 aa, Artificial Sequence
  A-kinase anchor protein 2 (688-697)
AELRSTASLL

SEQ ID NO: 7078 - protein, 16 aa, Artificial Sequence
  Ragulator complex protein LAMTOR1 (36-51)
AEPNYHSLPSARTDEQ

SEQ ID NO: 7079 - protein, 19 aa, Artificial Sequence
  Low affinity immunoglobulin epsilon Fc receptor (19-37)
AEQQRLKSQDLELSWNLNG

SEQ ID NO: 7080 - protein, 10 aa, Artificial Sequence
  Ribonucleoside-diphosphate reductase subunit M2 B (284-293)
AETTDNVFTL

SEQ ID NO: 7081 - protein, 9 aa, Artificial Sequence
  Zinc finger protein 638 (1263-1271)
AEVEKNETV

SEQ ID NO: 7082 - protein, 15 aa, Artificial Sequence
  Peroxisomal multifunctional enzyme type 2 (19-33)
AGLGRAYALAFAERG

SEQ ID NO: 7083 - protein, 15 aa, Artificial Sequence
  B- and T-lymphocyte attenuator (191-205)
AGREINLVDAHLKSE

SEQ ID NO: 7084 - protein, 17 aa, Artificial Sequence
  B- and T-lymphocyte attenuator (191-207)
AGREINLVDAHLKSEQT

SEQ ID NO: 7085 - protein, 12 aa, Artificial Sequence
  CD44 antigen (8-19)
AGVFHVEKNGRY

SEQ ID NO: 7086 - protein, 10 aa, Artificial Sequence
  Cordon-bleu protein-like 1 (1088-1097)
AIRSGEAAAK

SEQ ID NO: 7087 - protein, 12 aa, Artificial Sequence
  C-C chemokine receptor type 7 (94-105)
AIVQAVSAHRHR

SEQ ID NO: 7088 - protein, 14 aa, Artificial Sequence
  Ragulator complex protein LAMTOR3 (21-34)
AIVVSDRDGVPVIK

SEQ ID NO: 7089 - protein, 15 aa, Artificial Sequence
  IgG receptor FcRn large subunit p51 (131-145)
AKFALNGEEFMNFDL

SEQ ID NO: 7090 - protein, 16 aa, Artificial Sequence
  IgG receptor FcRn large subunit p51 (131-146)
AKFALNGEEFMNFDLK

SEQ ID NO: 7091 - protein, 14 aa, Artificial Sequence
  Glutathione peroxidase 1 (84-97)
ALMTDPKLITWSPV

SEQ ID NO: 7092 - protein, 13 aa, Artificial Sequence
  IgG receptor FcRn large subunit p51 (134-146)
ALNGEEFMNFDLK

SEQ ID NO: 7093 - protein, 9 aa, Artificial Sequence
  Serine/threonine-protein kinase LATS1 (729-737)
ALYATKTLR

SEQ ID NO: 7094 - protein, 14 aa, Artificial Sequence
  E3 ubiquitin-protein ligase CHIP (43-56)
ANLQRAYSLAKEQR

SEQ ID NO: 7095 - protein, 11 aa, Artificial Sequence
  A-kinase anchor protein 2 (298-308)
APASSHERASM

SEQ ID NO: 7096 - protein, 10 aa, Artificial Sequence
  Interferon regulatory factor 9 (199-208)
APFQGDQRSL

SEQ ID NO: 7097 - protein, 10 aa, Artificial Sequence
  T-cell activation Rho GTPase-activating protein (268-277)
APGSVLPRAL

SEQ ID NO: 7098 - protein, 15 aa, Artificial Sequence
  Platelet endothelial cell adhesion molecule (159-173)
APIHFTIEKLELNEK

SEQ ID NO: 7099 - protein, 14 aa, Artificial Sequence
  Alpha-1B-glycoprotein (205-218)
APLEGARFALVRED

SEQ ID NO: 7100 - protein, 9 aa, Artificial Sequence
  TBC1 domain family member 22A (113-121)
APLQRSQSL

SEQ ID NO: 7101 - protein, 9 aa, Artificial Sequence
  Cordon-bleu protein-like 1 (891-899)
APNPAPKEL

SEQ ID NO: 7102 - protein, 8 aa, Artificial Sequence
  Negative elongation factor E (257-264)
APRKGNTL

SEQ ID NO: 7103 - protein, 9 aa, Artificial Sequence
  Cyclin-dependent kinase inhibitor 1C (105-113)
APRPVAVAV

SEQ ID NO: 7104 - protein, 9 aa, Artificial Sequence
  Endoplasmic reticulum resident protein 44 (391-399)
APSEYRYTL

SEQ ID NO: 7105 - protein, 10 aa, Artificial Sequence
  Endoplasmic reticulum resident protein 44 (391-400)
APSEYRYTLL

SEQ ID NO: 7106 - protein, 16 aa, Artificial Sequence
  Lipolysis-stimulated lipoprotein receptor (216-231)
APSTYAHLSPAKTPPP

SEQ ID NO: 7107 - protein, 17 aa, Artificial Sequence
  Lipolysis-stimulated lipoprotein receptor (216-232)
APSTYAHLSPAKTPPPP

SEQ ID NO: 7108 - protein, 18 aa, Artificial Sequence
  Lipolysis-stimulated lipoprotein receptor (216-233)
APSTYAHLSPAKTPPPPA

SEQ ID NO: 7109 - protein, 13 aa, Artificial Sequence
  C-C chemokine receptor type 7 (190-202)
ARNFERNKAIKVI

SEQ ID NO: 7110 - protein, 15 aa, Artificial Sequence
  C-C chemokine receptor type 7 (190-204)
ARNFERNKAIKVIIA

SEQ ID NO: 7111 - protein, 16 aa, Artificial Sequence
  Glucose-6-phosphate isomerase (181-196)
ASKTFTTQETITNAET

SEQ ID NO: 7112 - protein, 15 aa, Artificial Sequence
  Cystatin-C (63-77)
ASNDMYHSRALQVVR

SEQ ID NO: 7113 - protein, 16 aa, Artificial Sequence
  Cystatin-C (63-78)
ASNDMYHSRALQVVRA

SEQ ID NO: 7114 - protein, 9 aa, Artificial Sequence
  A-kinase anchor protein 2 (107-115)
ASRQAPPHI

SEQ ID NO: 7115 - protein, 10 aa, Artificial Sequence
  Exostosin-2 (691-700)
ASVFGTMPLK

SEQ ID NO: 7116 - protein, 10 aa, Artificial Sequence
  Fatty acyl-CoA reductase 2 (227-236)
ATFEKIPFER

SEQ ID NO: 7117 - protein, 15 aa, Artificial Sequence
  Ras-related protein Rab-11A (49-63)
ATRSIQVDGKTIKAQ

SEQ ID NO: 7118 - protein, 16 aa, Artificial Sequence
  Ras-related protein Rab-11A (49-64)
ATRSIQVDGKTIKAQI

SEQ ID NO: 7119 - protein, 9 aa, Artificial Sequence
  Cadherin EGF LAG seven-pass G-type receptor 1 (1076-1084)
ATSAPLVSR

SEQ ID NO: 7120 - protein, 11 aa, Artificial Sequence
  Tumor protein p53-inducible protein 11 (90-100)
AVFDGAQVTSK

SEQ ID NO: 7121 - protein, 9 aa, Artificial Sequence
  Short-chain dehydrogenase/reductase 3 (9-17)
AVGLVLPAK

SEQ ID NO: 7122 - protein, 10 aa, Artificial Sequence
  A-kinase anchor protein 2 (230-239)
AVKKNPGIAA

SEQ ID NO: 7123 - protein, 17 aa, Artificial Sequence
  SLAM family member 6 (46-62)
DADDNVSFRWEALGNTL

SEQ ID NO: 7124 - protein, 14 aa, Artificial Sequence
  Peroxisomal multifunctional enzyme type 2 (88-101)
DAFGRIDVVVNNAG

SEQ ID NO: 7125 - protein, 15 aa, Artificial Sequence
  Lymphocyte antigen 9 (125-139)
DAGSYKAQINQRNFE

SEQ ID NO: 7126 - protein, 17 aa, Artificial Sequence
  Lymphocyte antigen 9 (125-141)
DAGSYKAQINQRNFEVT

SEQ ID NO: 7127 - protein, 8 aa, Artificial Sequence
  Cell division cycle-associated 7-like protein (200-207)
DALLKRTM

SEQ ID NO: 7128 - protein, 9 aa, Artificial Sequence
  Probable ribosome biogenesis protein RLP24 (91-99)
DAMKRVEEI

SEQ ID NO: 7129 - protein, 13 aa, Artificial Sequence
  Platelet endothelial cell adhesion molecule (416-428)
DAQFEVIKGQTIE

SEQ ID NO: 7130 - protein, 15 aa, Artificial Sequence
  Platelet endothelial cell adhesion molecule (416-430)
DAQFEVIKGQTIEVR

SEQ ID NO: 7131 - protein, 12 aa, Artificial Sequence
  Ceruloplasmin (715-726)
DDNIKTYSDHPE

SEQ ID NO: 7132 - protein, 13 aa, Artificial Sequence
  Ceruloplasmin (715-727)
DDNIKTYSDHPEK

SEQ ID NO: 7133 - protein, 14 aa, Artificial Sequence
  SLAM family member 6 (48-61)
DDNVSFRWEALGNT

SEQ ID NO: 7134 - protein, 15 aa, Artificial Sequence
  SLAM family member 6 (48-62)
DDNVSFRWEALGNTL

SEQ ID NO: 7135 - protein, 17 aa, Artificial Sequence
  Ceramide glucosyltransferase (91-107)
DDPAIDVCKKLLGKYPN

SEQ ID NO: 7136 - protein, 9 aa, Artificial Sequence
  Dystrophin (386-394)
DEHLLIQHY

SEQ ID NO: 7137 - protein, 9 aa, Artificial Sequence
  E3 ubiquitin-protein ligase Mdm2 (68-76)
DEKQQHIVY

SEQ ID NO: 7138 - protein, 9 aa, Artificial Sequence
  Dynamin-binding protein (858-866)
DELPKFHQY

SEQ ID NO: 7139 - protein, 9 aa, Artificial Sequence
  Transmembrane emp24 domain-containing protein 4 (48-56)
DETMVIGNY

SEQ ID NO: 7140 - protein, 9 aa, Artificial Sequence
  Uncharacterized protein CXorf21 (47-55)
DETQVRSLY

SEQ ID NO: 7141 - protein, 8 aa, Artificial Sequence
  TBC1 domain family member 22A (223-230)
DEVHQDTY

SEQ ID NO: 7142 - protein, 9 aa, Artificial Sequence
  E3 ubiquitin-protein ligase Mdm2 (273-281)
DEVYQVTVY

SEQ ID NO: 7143 - protein, 14 aa, Artificial Sequence
  MyoD family inhibitor domain-containing protein (67-80)
DGELIRTQPQRLPQ

SEQ ID NO: 7144 - protein, 8 aa, Artificial Sequence
  Obscurin-like protein 1 (299-306)
DGGFVLKV

SEQ ID NO: 7145 - protein, 18 aa, Artificial Sequence
  Beta-1,4-galactosyltransferase 1 (110-127)
DGLNSLTYQVLDVQRYPL

SEQ ID NO: 7146 - protein, 13 aa, Artificial Sequence
  Plasma membrane calcium-transporting ATPase 1 (257-269)
DGSYRIFSKGASE

SEQ ID NO: 7147 - protein, 8 aa, Artificial Sequence
  T-cell activation Rho GTPase-activating protein (29-36)
DIKEHPLL

SEQ ID NO: 7148 - protein, 9 aa, Artificial Sequence
  Probable ribosome biogenesis protein RLP24 (123-131)
DIKEVKQNI

SEQ ID NO: 7149 - protein, 16 aa, Artificial Sequence
  Vesicle-associated membrane protein 3 (27-42)
DIMRVNVDKVLERDQK

SEQ ID NO: 7150 - protein, 17 aa, Artificial Sequence
  Vesicle-associated membrane protein 3 (27-43)
DIMRVNVDKVLERDQKL

SEQ ID NO: 7151 - protein, 13 aa, Artificial Sequence
  Endoplasmin (536-548)
DKIYFMAGSSRKE

SEQ ID NO: 7152 - protein, 16 aa, Artificial Sequence
  Ceramide glucosyltransferase (43-58)
DKQPYSKLPGVSLLKP

SEQ ID NO: 7153 - protein, 17 aa, Artificial Sequence
  Ceramide glucosyltransferase (43-59)
DKQPYSKLPGVSLLKPL

SEQ ID NO: 7154 - protein, 9 aa, Artificial Sequence
  Poly (ADP-ribose) polymerase 3 (217-225)
DLDVKKMPL

SEQ ID NO: 7155 - protein, 15 aa, Artificial Sequence
  Perilipin-3 (369-383)
DLSSSILAQSRERVA

SEQ ID NO: 7156 - protein, 9 aa, Artificial Sequence
  Cytoskeleton-associated protein 4 (188-196)
DMKAKVASL

SEQ ID NO: 7157 - protein, 16 aa, Artificial Sequence
  Phosphoinositide-3-kinase-interacting protein 1 (28-43)
DNGHLYREDQTSPAPG

SEQ ID NO: 7158 - protein, 18 aa, Artificial Sequence
  Phosphoinositide-3-kinase-interacting protein 1 (28-45)
DNGHLYREDQTSPAPGLR

SEQ ID NO: 7159 - protein, 14 aa, Artificial Sequence
  Protein CDV3 homolog (139-152)
DNQYAVLENQKSSH

SEQ ID NO: 7160 - protein, 13 aa, Artificial Sequence
  SLAM family member 6 (49-61)
DNVSFRWEALGNT

SEQ ID NO: 7161 - protein, 14 aa, Artificial Sequence
  SLAM family member 6 (49-62)
DNVSFRWEALGNTL

SEQ ID NO: 7162 - protein, 15 aa, Artificial Sequence
  SLAM family member 6 (49-63)
DNVSFRWEALGNTLS

SEQ ID NO: 7163 - protein, 15 aa, Artificial Sequence
  Golgi apparatus protein 1 (492-506)
DPGADYRIDRALNEA

SEQ ID NO: 7164 - protein, 17 aa, Artificial Sequence
  Peroxiredoxin-1 (107-123)
DPKRTIAQDYGVLKADE

SEQ ID NO: 7165 - protein, 18 aa, Artificial Sequence
  Peroxiredoxin-1 (107-124)
DPKRTIAQDYGVLKADEG

SEQ ID NO: 7166 - protein, 9 aa, Artificial Sequence
  Methyltransferase-like protein 7A (98-106)
DPNPNFEKF

SEQ ID NO: 7167 - protein, 15 aa, Artificial Sequence
  Glucose-6-phosphate isomerase (276-290)
DQHFRTTPLEKNAPV

SEQ ID NO: 7168 - protein, 9 aa, Artificial Sequence
  Perilipin-2 (38-46)
DQYPYLKSV

SEQ ID NO: 7169 - protein, 9 aa, Artificial Sequence
  T-cell activation Rho GTPase-activating protein (165-173)
DSAGPQDAR

SEQ ID NO: 7170 - protein, 14 aa, Artificial Sequence
  Ceruloplasmin (187-200)
DSAVFFEQGTTRIG

SEQ ID NO: 7171 - protein, 13 aa, Artificial Sequence
  T-complex protein 1 subunit beta (164-176)
DSYLDEGFLLDKK

SEQ ID NO: 7172 - protein, 15 aa, Artificial Sequence
  T-complex protein 1 subunit beta (164-178)
DSYLDEGFLLDKKIG

SEQ ID NO: 7173 - protein, 16 aa, Artificial Sequence
  SLAM family member 6 (103-118)
DTGSYRAQISTKTSAK

SEQ ID NO: 7174 - protein, 13 aa, Artificial Sequence
  SLAM family member 6 (193-205)
DTITIYSTINHSK

SEQ ID NO: 7175 - protein, 9 aa, Artificial Sequence
  Interferon regulatory factor 9 (104-112)
DVAEPYKVY

SEQ ID NO: 7176 - protein, 15 aa, Artificial Sequence
  HLA class II histocompatibility antigen, DO beta chain (69-83)
DVGMFVALTKLGQPD

SEQ ID NO: 7177 - protein, 20 aa, Artificial Sequence
  Endoplasmin (783-802)
DVGTDEEEETAKESTAEKDE

SEQ ID NO: 7178 - protein, 10 aa, Artificial Sequence
  Dynamin-binding protein (46-55)
DVTGQFPSSF

SEQ ID NO: 7179 - protein, 16 aa, Artificial Sequence
  Testican-2 (66-81)
EDDYIKSWEDNQQGDE

SEQ ID NO: 7180 - protein, 9 aa, Artificial Sequence
  Elongator complex protein 3 (321-329)
EDPDQDILI

SEQ ID NO: 7181 - protein, 17 aa, Artificial Sequence
  SLAM family member 6 (102-118)
EDTGSYRAQISTKTSAK

SEQ ID NO: 7182 - protein, 15 aa, Artificial Sequence
  Receptor-type tyrosine-protein phosphatase alpha (384-398)
EEFKKLTSIKIQNDK

SEQ ID NO: 7183 - protein, 9 aa, Artificial Sequence
  ATP-binding cassette sub-family A member 6 (1600-1608)
EEIDTTMRW

SEQ ID NO: 7184 - protein, 17 aa, Artificial Sequence
  14-3-3 protein beta/alpha (41-57)
EERNLLSVAYKNVVGAR

SEQ ID NO: 7185 - protein, 14 aa, Artificial Sequence
  Ras GTPase-activating-like protein IQGAP1 (61-74)
EEVITLIRSNQQLE

SEQ ID NO: 7186 - protein, 15 aa, Artificial Sequence
  Ras GTPase-activating-like protein IQGAP1 (61-75)
EEVITLIRSNQQLEN

SEQ ID NO: 7187 - protein, 13 aa, Artificial Sequence
  Glycosyltransferase 8 domain-containing protein 1 (272-284)
EGLYSRTLAGSIT

SEQ ID NO: 7188 - protein, 16 aa, Artificial Sequence
  Glycosyltransferase 8 domain-containing protein 1 (272-287)
EGLYSRTLAGSITTPP

SEQ ID NO: 7189 - protein, 13 aa, Artificial Sequence
  Serine incorporator 3 (399-411)
EGVQYSYSLFHLM

SEQ ID NO: 7190 - protein, 14 aa, Artificial Sequence
  Serine incorporator 3 (399-412)
EGVQYSYSLFHLML

SEQ ID NO: 7191 - protein, 15 aa, Artificial Sequence
  Cystatin-C (47-61)
EGVRRALDFAVGEYN

SEQ ID NO: 7192 - protein, 16 aa, Artificial Sequence
  Cystatin-C (47-62)
EGVRRALDFAVGEYNK

SEQ ID NO: 7193 - protein, 9 aa, Artificial Sequence
  Lysine-specific demethylase 2B (554-562)
EHADDDPSL

SEQ ID NO: 7194 - protein, 9 aa, Artificial Sequence
  Dynamin-binding protein (916-924)
EHSRVLQQL

SEQ ID NO: 7195 - protein, 9 aa, Artificial Sequence
  Endoplasmic reticulum resident protein 44 (277-285)
EIFQNEVAR

SEQ ID NO: 7196 - protein, 15 aa, Artificial Sequence
  Calsyntenin-1 (203-217)
EIITPDVPFTVDKDG

SEQ ID NO: 7197 - protein, 16 aa, Artificial Sequence
  Perilipin-3 (64-79)
EKGVRTLTAAAVSGAQ

SEQ ID NO: 7198 - protein, 17 aa, Artificial Sequence
  Perilipin-3 (64-80)
EKGVRTLTAAAVSGAQP

SEQ ID NO: 7199 - protein, 18 aa, Artificial Sequence
  Perilipin-3 (64-81)
EKGVRTLTAAAVSGAQPI

SEQ ID NO: 7200 - protein, 13 aa, Artificial Sequence
  Glycosyltransferase 8 domain-containing protein 1 (347-359)
EKWYIPDPTGKFN

SEQ ID NO: 7201 - protein, 16 aa, Artificial Sequence
  Testican-2 (316-331)
ELERIQIQEAAKKKPG

SEQ ID NO: 7202 - protein, 14 aa, Artificial Sequence
  ATP synthase subunit alpha, mitochondrial (295-308)
ELFYKGIRPAINVG

SEQ ID NO: 7203 - protein, 13 aa, Artificial Sequence
  Alpha-1B-glycoprotein (176-188)
ELILSDETLPAPE

SEQ ID NO: 7204 - protein, 9 aa, Artificial Sequence
  NACHT, LRR and PYD domains-containing protein 2 (1026-1034)
ELNKLLEEI

SEQ ID NO: 7205 - protein, 9 aa, Artificial Sequence
  Baculoviral IAP repeat-containing protein 5 (95-103)
ELTLGEFLK

SEQ ID NO: 7206 - protein, 15 aa, Artificial Sequence
  SLAM family member 6 (191-205)
ENDTITIYSTINHSK

SEQ ID NO: 7207 - protein, 20 aa, Artificial Sequence
  SLAM family member 6 (191-210)
ENDTITIYSTINHSKESKPT

SEQ ID NO: 7208 - protein, 15 aa, Artificial Sequence
  Alpha-mannosidase 2 (64-78)
ENNEIISNIRDSVIN

SEQ ID NO: 7209 - protein, 8 aa, Artificial Sequence
  Proline-rich protein 12 (830-837)
ENVNKKDY

SEQ ID NO: 7210 - protein, 15 aa, Artificial Sequence
  Low affinity immunoglobulin epsilon Fc receptor (20-34)
EQQRLKSQDLELSWN

SEQ ID NO: 7211 - protein, 9 aa, Artificial Sequence
  RNA polymerase II subunit A C-terminal domain phosphatase (86-94)
ERAGVVREL

SEQ ID NO: 7212 - protein, 13 aa, Artificial Sequence
  Testican-2 (318-330)
ERIQIQEAAKKKP

SEQ ID NO: 7213 - protein, 14 aa, Artificial Sequence
  Testican-2 (318-331)
ERIQIQEAAKKKPG

SEQ ID NO: 7214 - protein, 15 aa, Artificial Sequence
  Testican-2 (318-332)
ERIQIQEAAKKKPGI

SEQ ID NO: 7215 - protein, 16 aa, Artificial Sequence
  14-3-3 protein beta/alpha (42-57)
ERNLLSVAYKNVVGAR

SEQ ID NO: 7216 - protein, 15 aa, Artificial Sequence
  Platelet endothelial cell adhesion molecule (92-106)
ESYFIPEVRIYDSGT

SEQ ID NO: 7217 - protein, 17 aa, Artificial Sequence
  DnaJ homolog subfamily C member 5 (180-196)
ETTQLTADSHPSYHTDG

SEQ ID NO: 7218 - protein, 9 aa, Artificial Sequence
  DNA dC-dU-editing enzyme APOBEC-3D (299-307)
EVAEFLARH

SEQ ID NO: 7219 - protein, 9 aa, Artificial Sequence
  Zinc finger protein 638 (1173-1181)
EVKEEIPLV

SEQ ID NO: 7220 - protein, 16 aa, Artificial Sequence
  Phosphoinositide-3-kinase-interacting protein 1 (127-142)
EVQVFAPANALPARSE

SEQ ID NO: 7221 - protein, 15 aa, Artificial Sequence
  Endoplasmin (359-373)
EVTFKSILFVPTSAP

SEQ ID NO: 7222 - protein, 12 aa, Artificial Sequence
  Fas apoptotic inhibitory molecule 3 (253-264)
EYVSLYHQPAAM

SEQ ID NO: 7223 - protein, 14 aa, Artificial Sequence
  CD44 antigen (7-20)
FAGVFHVEKNGRYS

SEQ ID NO: 7224 - protein, 14 aa, Artificial Sequence
  HLA class II histocompatibility antigen, DM alpha chain (67-80)
FDFSQNTRVPRLPE

SEQ ID NO: 7225 - protein, 23 aa, Artificial Sequence
  Heterogeneous nuclear ribonucleoprotein A1-like 2 (110-132)
FGNYNNQSSNFGPMKGGNFGGRS

SEQ ID NO: 7226 - protein, 23 aa, Artificial Sequence
  Heterogeneous nuclear ribonucleoprotein A1-like 2 (120-142)
FGPMKGGNFGGRSSGPYGGGGQY

SEQ ID NO: 7227 - protein, 9 aa, Artificial Sequence
  T-cell activation Rho GTPase-activating protein (545-553)
FQYAKESYI

SEQ ID NO: 7228 - protein, 9 aa, Artificial Sequence
  Transcription regulator protein BACH2 (345-353)
FSITKSVEL

SEQ ID NO: 7229 - protein, 9 aa, Artificial Sequence
  Poly (ADP-ribose) polymerase 3 (264-272)
FYTVIPHNF

SEQ ID NO: 7230 - protein, 10 aa, Artificial Sequence
  RNA polymerase II subunit A C-terminal domain phosphatase (40-49)
GAAVRIGSVL

SEQ ID NO: 7231 - protein, 14 aa, Artificial Sequence
  Protein unc-13 homolog D (1010-1023)
GADDLEGEAFLPLR

SEQ ID NO: 7232 - protein, 14 aa, Artificial Sequence
  Glycosyltransferase 8 domain-containing protein 1 (79-92)
GAIAAINSIQHNTR

SEQ ID NO: 7233 - protein, 12 aa, Artificial Sequence
  HLA class II histocompatibility antigen, DM alpha chain (89-100)
GDAPAILFDKEF

SEQ ID NO: 7234 - protein, 16 aa, Artificial Sequence
  Ceruloplasmin (102-117)
GDKVYVHLKNLASRPY

SEQ ID NO: 7235 - protein, 17 aa, Artificial Sequence
  Ceruloplasmin (102-118)
GDKVYVHLKNLASRPYT

SEQ ID NO: 7236 - protein, 9 aa, Artificial Sequence
  Zinc finger protein 107 (751-759)
GDYGRAFNL

SEQ ID NO: 7237 - protein, 9 aa, Artificial Sequence
  Cell division cycle-associated 7-like protein (377-385)
GEDVRSALL

SEQ ID NO: 7238 - protein, 9 aa, Artificial Sequence
  A-kinase anchor protein 2 (435-443)
GEFTSARAV

SEQ ID NO: 7239 - protein, 9 aa, Artificial Sequence
  E3 ubiquitin-protein ligase Mdm2 (339-347)
GEISEKAKL

SEQ ID NO: 7240 - protein, 13 aa, Artificial Sequence
  MyoD family inhibitor domain-containing protein (68-80)
GELIRTQPQRLPQ

SEQ ID NO: 7241 - protein, 17 aa, Artificial Sequence
  Transferrin receptor protein 1 (15-31)
GEPLSYTRFSLARQVDG

SEQ ID NO: 7242 - protein, 18 aa, Artificial Sequence
  Heterogeneous nuclear ribonucleoprotein A3 (172-189)
GGGYGSGGGSGGYGSRRF

SEQ ID NO: 7243 - protein, 12 aa, Artificial Sequence
  Heterogeneous nuclear ribonucleoprotein A3 (159-170)
GGSFGGRSSGSP

SEQ ID NO: 7244 - protein, 9 aa, Artificial Sequence
  Probable ATP-dependent RNA helicase DDX46 (366-374)
GIAKTGSGK

SEQ ID NO: 7245 - protein, 12 aa, Artificial Sequence
  Kynureninase (432-443)
GIRVAPVPLYNS

SEQ ID NO: 7246 - protein, 14 aa, Artificial Sequence
  Kynureninase (432-445)
GIRVAPVPLYNSFH

SEQ ID NO: 7247 - protein, 13 aa, Artificial Sequence
  Peroxiredoxin-1 (129-141)
GLFIIDDKGILRQ

SEQ ID NO: 7248 - protein, 15 aa, Artificial Sequence
  Peroxiredoxin-1 (129-143)
GLFIIDDKGILRQIT

SEQ ID NO: 7249 - protein, 13 aa, Artificial Sequence
  Peroxisomal multifunctional enzyme type 2 (20-32)
GLGRAYALAFAER

SEQ ID NO: 7250 - protein, 14 aa, Artificial Sequence
  Peroxisomal multifunctional enzyme type 2 (20-33)
GLGRAYALAFAERG

SEQ ID NO: 7251 - protein, 15 aa, Artificial Sequence
  Ragulator complex protein LAMTOR3 (18-32)
GLHAIVVSDRDGVPV

SEQ ID NO: 7252 - protein, 17 aa, Artificial Sequence
  Ragulator complex protein LAMTOR3 (18-34)
GLHAIVVSDRDGVPVIK

SEQ ID NO: 7253 - protein, 14 aa, Artificial Sequence
  Interleukin-4 receptor subunit alpha (192-205)
GNPAYRSFSNSLSQ

SEQ ID NO: 7254 - protein, 17 aa, Artificial Sequence
  Polypeptide N-acetylgalactosaminyltransferase 1 (404-420)
GNQVFSYTANKEIRTDD

SEQ ID NO: 7255 - protein, 12 aa, Artificial Sequence
  Fibromodulin (4-15)
GNRINEFSISSF

SEQ ID NO: 7256 - protein, 15 aa, Artificial Sequence
  Pericentriolar material 1 protein (1456-1470)
GNTVIHLDQALARMR

SEQ ID NO: 7257 - protein, 14 aa, Artificial Sequence
  CD44 antigen (141-154)
GPITITIVNRDGTR

SEQ ID NO: 7258 - protein, 9 aa, Artificial Sequence
  Probable ribosome biogenesis protein RLP24 (11-19)
GPIYPGHGM

SEQ ID NO: 7259 - protein, 15 aa, Artificial Sequence
  Cation-independent mannose-6-phosphate receptor (972-986)
GPLKFLHQDIDSGQG

SEQ ID NO: 7260 - protein, 17 aa, Artificial Sequence
  Cation-independent mannose-6-phosphate receptor (972-988)
GPLKFLHQDIDSGQGIR

SEQ ID NO: 7261 - protein, 15 aa, Artificial Sequence
  Heterogeneous nuclear ribonucleoprotein A1-like 2 (121-135)
GPMKGGNFGGRSSGP

SEQ ID NO: 7262 - protein, 13 aa, Artificial Sequence
  Protein CDV3 homolog (83-95)
GPPEIYSDTQFPS

SEQ ID NO: 7263 - protein, 15 aa, Artificial Sequence
  Protein CDV3 homolog (83-97)
GPPEIYSDTQFPSLQ

SEQ ID NO: 7264 - protein, 16 aa, Artificial Sequence
  Interleukin-4 receptor subunit alpha (295-310)
GPPGEAGYKAFSSLLA

SEQ ID NO: 7265 - protein, 18 aa, Artificial Sequence
  Interleukin-4 receptor subunit alpha (295-312)
GPPGEAGYKAFSSLLASS

SEQ ID NO: 7266 - protein, 19 aa, Artificial Sequence
  Interleukin-4 receptor subunit alpha (295-313)
GPPGEAGYKAFSSLLASSA

SEQ ID NO: 7267 - protein, 23 aa, Artificial Sequence
  Interleukin-4 receptor subunit alpha (295-317)
GPPGEAGYKAFSSLLASSAVSPE

SEQ ID NO: 7268 - protein, 24 aa, Artificial Sequence
  Interleukin-4 receptor subunit alpha (295-318)
GPPGEAGYKAFSSLLASSAVSPEK

SEQ ID NO: 7269 - protein, 10 aa, Artificial Sequence
  Ubiquitin-like protein 7 (263-272)
GPRPITQSEL

SEQ ID NO: 7270 - protein, 13 aa, Artificial Sequence
  Heterogeneous nuclear ribonucleoprotein A1-like 2 (134-146)
GPYGGGGQYFAKP

SEQ ID NO: 7271 - protein, 16 aa, Artificial Sequence
  60S ribosomal protein L3 (136-151)
GQGYLIKDGKLIKNNA

SEQ ID NO: 7272 - protein, 9 aa, Artificial Sequence
  Glycosylphosphatidylinositol anchor attachment 1 protein (448-456)
GQHVATQHF

SEQ ID NO: 7273 - protein, 9 aa, Artificial Sequence
  AT-rich interactive domain-containing protein 5B (138-146)
GQKEALLKY

SEQ ID NO: 7274 - protein, 13 aa, Artificial Sequence
  ATP synthase subunit alpha, mitochondrial (147-159)
GQKRSTVAQLVKR

SEQ ID NO: 7275 - protein, 10 aa, Artificial Sequence
  A-kinase anchor protein 2 (343-352)
GQSTPRLFSI

SEQ ID NO: 7276 - protein, 9 aa, Artificial Sequence
  Transcription regulator protein BACH2 (68-76)
GQTKNDLVV

SEQ ID NO: 7277 - protein, 14 aa, Artificial Sequence
  B- and T-lymphocyte attenuator (193-206)
GREINLVDAHLKSE

SEQ ID NO: 7278 - protein, 10 aa, Artificial Sequence
  Ras-specific guanine nucleotide-releasing factor 1 (386-395)
GRFKNLREAL

SEQ ID NO: 7279 - protein, 9 aa, Artificial Sequence
  Protein asunder homolog (674-682)
GRLNSVNNR

SEQ ID NO: 7280 - protein, 9 aa, Artificial Sequence
  Probable ribonuclease ZC3H12D (383-391)
GRVPGPLSL

SEQ ID NO: 7281 - protein, 14 aa, Artificial Sequence
  Carbohydrate sulfotransferase 2 (176-189)
GSSFFGELFNQNPE

SEQ ID NO: 7282 - protein, 14 aa, Artificial Sequence
  SLAM family member 6 (105-118)
GSYRAQISTKTSAK

SEQ ID NO: 7283 - protein, 12 aa, Artificial Sequence
  Plasma membrane calcium-transporting ATPase 1 (258-269)
GSYRIFSKGASE

SEQ ID NO: 7284 - protein, 10 aa, Artificial Sequence
  Kelch-like ECH-associated protein 1 (419-428)
GVIDGHIYAV

SEQ ID NO: 7285 - protein, 12 aa, Artificial Sequence
  Serine incorporator 3 (400-411)
GVQYSYSLFHLM

SEQ ID NO: 7286 - protein, 13 aa, Artificial Sequence
  Serine incorporator 3 (400-412)
GVQYSYSLFHLML

SEQ ID NO: 7287 - protein, 16 aa, Artificial Sequence
  Interleukin-4 receptor subunit alpha (301-316)
GYKAFSSLLASSAVSP

SEQ ID NO: 7288 - protein, 17 aa, Artificial Sequence
  Interleukin-4 receptor subunit alpha (301-317)
GYKAFSSLLASSAVSPE

SEQ ID NO: 7289 - protein, 9 aa, Artificial Sequence
  Dystrophin (325-333)
GYLPVQTVL

SEQ ID NO: 7290 - protein, 13 aa, Artificial Sequence
  Ragulator complex protein LAMTOR3 (20-32)
HAIVVSDRDGVPV

SEQ ID NO: 7291 - protein, 9 aa, Artificial Sequence
  HLA class II histocompatibility antigen, DM alpha chain (87-95)
HEIDRYTAI

SEQ ID NO: 7292 - protein, 9 aa, Artificial Sequence
  Elongator complex protein 3 (261-269)
HGNLRELAL

SEQ ID NO: 7293 - protein, 14 aa, Artificial Sequence
  Fibromodulin (137-150)
HGNQITSDKVGRKV

SEQ ID NO: 7294 - protein, 10 aa, Artificial Sequence
  Poly (ADP-ribose) polymerase 3 (457-466)
HHINTDNPSL

SEQ ID NO: 7295 - protein, 9 aa, Artificial Sequence
  DmX-like protein 1 (888-896)
HLKSIPVSL

SEQ ID NO: 7296 - protein, 9 aa, Artificial Sequence
  Cyclin-dependent kinase 14 (229-237)
HPDNVKLFL

SEQ ID NO: 7297 - protein, 14 aa, Artificial Sequence
  Ceramide glucosyltransferase (193-206)
HPRYYISANVTGFK

SEQ ID NO: 7298 - protein, 14 aa, Artificial Sequence
  Beta-1,4-galactosyltransferase 1 (199-212)
HPVLQRQQLDYGIY

SEQ ID NO: 7299 - protein, 9 aa, Artificial Sequence
  Hematopoietic SH2 domain-containing protein (64-72)
HVGYTLSYK

SEQ ID NO: 7300 - protein, 9 aa, Artificial Sequence
  Cytoskeleton-associated protein 4 (129-137)
HVLEEVQQV

SEQ ID NO: 7301 - protein, 15 aa, Artificial Sequence
  Voltage-dependent anion-selective channel protein 2 (221-235)
IAAKYQLDPTASISA

SEQ ID NO: 7302 - protein, 16 aa, Artificial Sequence
  Voltage-dependent anion-selective channel protein 2 (221-236)
IAAKYQLDPTASISAK

SEQ ID NO: 7303 - protein, 14 aa, Artificial Sequence
  14-3-3 protein zeta/delta (61-74)
IAELDTLSEESYKD

SEQ ID NO: 7304 - protein, 15 aa, Artificial Sequence
  14-3-3 protein zeta/delta (61-75)
IAELDTLSEESYKDS

SEQ ID NO: 7305 - protein, 12 aa, Artificial Sequence
  Golgi apparatus protein 1 (362-373)
IAQDYKVSYSLA

SEQ ID NO: 7306 - protein, 13 aa, Artificial Sequence
  Golgi apparatus protein 1 (362-374)
IAQDYKVSYSLAK

SEQ ID NO: 7307 - protein, 9 aa, Artificial Sequence
  Perilipin-2 (313-321)
IARNLTQQL

SEQ ID NO: 7308 - protein, 15 aa, Artificial Sequence
  60S ribosomal protein L3 (216-230)
IDTTSKFGHGRFQTM

SEQ ID NO: 7309 - protein, 19 aa, Artificial Sequence
  60S ribosomal protein L3 (65-83)
IDVIGVTKGKGYKGVTSRW

SEQ ID NO: 7310 - protein, 10 aa, Artificial Sequence
  Plexin-B3 (1741-1750)
IEDPGTLHIW

SEQ ID NO: 7311 - protein, 14 aa, Artificial Sequence
  Polypeptide N-acetylgalactosaminyltransferase 1 (88-101)
IEEIVLVDDASERD

SEQ ID NO: 7312 - protein, 15 aa, Artificial Sequence
  Polypeptide N-acetylgalactosaminyltransferase 1 (88-102)
IEEIVLVDDASERDF

SEQ ID NO: 7313 - protein, 9 aa, Artificial Sequence
  Perilipin-2 (306-314)
IESRTLAIA

SEQ ID NO: 7314 - protein, 15 aa, Artificial Sequence
  Ras-related protein Rab-11A (44-58)
IGVEFATRSIQVDGK

SEQ ID NO: 7315 - protein, 9 aa, Artificial Sequence
  Elongation factor Tu, mitochondrial (171-179)
IGVEHVVVY

SEQ ID NO: 7316 - protein, 14 aa, Artificial Sequence
  Calsyntenin-1 (204-217)
IITPDVPFTVDKDG

SEQ ID NO: 7317 - protein, 16 aa, Artificial Sequence
  Fas apoptotic inhibitory molecule 3 (68-83)
IKAEYKGRVTLKQYPR

SEQ ID NO: 7318 - protein, 8 aa, Artificial Sequence
  Dynamin-binding protein (527-534)
IKVSKQLL

SEQ ID NO: 7319 - protein, 9 aa, Artificial Sequence
  ATP-binding cassette sub-family A member 6 (1270-1278)
ILDEKPVII

SEQ ID NO: 7320 - protein, 9 aa, Artificial Sequence
  DNA dC-dU-editing enzyme APOBEC-3D (26-34)
ILYGRSYTW

SEQ ID NO: 7321 - protein, 15 aa, Artificial Sequence
  Vesicle-associated membrane protein 3 (28-42)
IMRVNVDKVLERDQK

SEQ ID NO: 7322 - protein, 13 aa, Artificial Sequence
  Receptor-type tyrosine-protein phosphatase alpha (79-91)
INRRMADDNKLFR

SEQ ID NO: 7323 - protein, 14 aa, Artificial Sequence
  Protocadherin-9 (157-170)
INSRFPIPSATDPD

SEQ ID NO: 7324 - protein, 16 aa, Artificial Sequence
  Ras GTPase-activating-like protein IQGAP1 (232-247)
IPADTFAALKNPNAML

SEQ ID NO: 7325 - protein, 12 aa, Artificial Sequence
  Platelet endothelial cell adhesion molecule (96-107)
IPEVRIYDSGTY

SEQ ID NO: 7326 - protein, 9 aa, Artificial Sequence
  NACHT, LRR and PYD domains-containing protein 2 (193-201)
IPFSNPRVL

SEQ ID NO: 7327 - protein, 14 aa, Artificial Sequence
  Fibromodulin (308-321)
IPPVNTNLENLYLQ

SEQ ID NO: 7328 - protein, 8 aa, Artificial Sequence
  Eukaryotic translation initiation factor 6 (46-53)
IPVVHASI

SEQ ID NO: 7329 - protein, 9 aa, Artificial Sequence
  Monoglyceride lipase (24-32)
IPYQDLPHL

SEQ ID NO: 7330 - protein, 9 aa, Artificial Sequence
  Methyltransferase-like protein 7A (225-233)
IQAPLSWEL

SEQ ID NO: 7331 - protein, 9 aa, Artificial Sequence
  Cyclin-dependent kinase 14 (264-272)
ISDTGELKL

SEQ ID NO: 7332 - protein, 9 aa, Artificial Sequence
  Probable ATP-dependent RNA helicase DDX46 (331-339)
ISMKILNSL

SEQ ID NO: 7333 - protein, 16 aa, Artificial Sequence
  Low affinity immunoglobulin epsilon Fc receptor (10-25)
ISQELEELRAEQQRLK

SEQ ID NO: 7334 - protein, 14 aa, Artificial Sequence
  Golgi apparatus protein 1 (553-566)
ISRDWKLDPVLYRK

SEQ ID NO: 7335 - protein, 8 aa, Artificial Sequence
  B-lymphocyte antigen CD19 (274-281)
ITARPVLW

SEQ ID NO: 7336 - protein, 9 aa, Artificial Sequence
  Zinc finger protein 107 (139-147)
KAFNWFSTL

SEQ ID NO: 7337 - protein, 15 aa, Artificial Sequence
  Interleukin-4 receptor subunit alpha (303-317)
KAFSSLLASSAVSPE

SEQ ID NO: 7338 - protein, 14 aa, Artificial Sequence
  Platelet endothelial cell adhesion molecule (274-287)
KDKAIVAHNRHGNK

SEQ ID NO: 7339 - protein, 15 aa, Artificial Sequence
  Platelet endothelial cell adhesion molecule (274-288)
KDKAIVAHNRHGNKA

SEQ ID NO: 7340 - protein, 9 aa, Artificial Sequence
  Endoplasmic reticulum resident protein 44 (336-344)
KDVLIPGKL

SEQ ID NO: 7341 - protein, 9 aa, Artificial Sequence
  Cytoskeleton-associated protein 4 (71-79)
KEAADTERL

SEQ ID NO: 7342 - protein, 11 aa, Artificial Sequence
  Uncharacterized protein CXorf21 (31-41)
KEEETNSVATL

SEQ ID NO: 7343 - protein, 8 aa, Artificial Sequence
  Negative elongation factor E (373-380)
KENLVDGF

SEQ ID NO: 7344 - protein, 9 aa, Artificial Sequence
  Cell division cycle-associated 7-like protein (280-288)
KFAEEFYSF

SEQ ID NO: 7345 - protein, 14 aa, Artificial Sequence
  IgG receptor FcRn large subunit p51 (132-145)
KFALNGEEFMNFDL

SEQ ID NO: 7346 - protein, 12 aa, Artificial Sequence
  Heterogeneous nuclear ribonucleoprotein A1-like 2 (124-135)
KGGNFGGRSSGP

SEQ ID NO: 7347 - protein, 13 aa, Artificial Sequence
  Heterogeneous nuclear ribonucleoprotein A3 (158-170)
KGGSFGGRSSGSP

SEQ ID NO: 7348 - protein, 12 aa, Artificial Sequence
  Low affinity immunoglobulin epsilon Fc receptor (101-112)
KGTKQWVHARYA

SEQ ID NO: 7349 - protein, 14 aa, Artificial Sequence
  Perilipin-3 (65-78)
KGVRTLTAAAVSGA

SEQ ID NO: 7350 - protein, 15 aa, Artificial Sequence
  Perilipin-3 (65-79)
KGVRTLTAAAVSGAQ

SEQ ID NO: 7351 - protein, 10 aa, Artificial Sequence
  B-cell linker protein (6-15)
KITVPASQKL

SEQ ID NO: 7352 - protein, 9 aa, Artificial Sequence
  Afadin- and alpha-actinin-binding protein (328-336)
KLDNQVSKV

SEQ ID NO: 7353 - protein, 10 aa, Artificial Sequence
  B-lymphocyte antigen CD19 (150-159)
KLMSPKLYVW

SEQ ID NO: 7354 - protein, 18 aa, Artificial Sequence
  Ragulator complex protein LAMTOR3 (12-29)
KLPSVEGLHAIVVSDRDG

SEQ ID NO: 7355 - protein, 10 aa, Artificial Sequence
  RNA polymerase II subunit A C-terminal domain phosphatase (238-247)
KLYELHVFTF

SEQ ID NO: 7356 - protein, 9 aa, Artificial Sequence
  Ubiquitin-like protein 7 (100-108)
KPEPVDKVA

SEQ ID NO: 7357 - protein, 15 aa, Artificial Sequence
  B- and T-lymphocyte attenuator (252-266)
KPGIVYASLNHSVIG

SEQ ID NO: 7358 - protein, 9 aa, Artificial Sequence
  hematopoietic SH2 domain-containing protein isoform X7 (112-120)
KPIEPRREL

SEQ ID NO: 7359 - protein, 9 aa, Artificial Sequence
  Dynamin-binding protein (183-191)
KPRQSSPQL

SEQ ID NO: 7360 - protein, 9 aa, Artificial Sequence
  AT-rich interactive domain-containing protein 5B (518-526)
KPSEERKTI

SEQ ID NO: 7361 - protein, 9 aa, Artificial Sequence
  Plateletoprotein 4 (394-402)
KPSEKIQVL

SEQ ID NO: 7362 - protein, 9 aa, Artificial Sequence
  Zinc finger protein 638 (538-546)
KPTSARSGL

SEQ ID NO: 7363 - protein, 9 aa, Artificial Sequence
  Dynamin-binding protein (531-539)
KQLLAALEI

SEQ ID NO: 7364 - protein, 9 aa, Artificial Sequence
  AT-rich interactive domain-containing protein 5B (171-179)
KQTPKVLVV

SEQ ID NO: 7365 - protein, 9 aa, Artificial Sequence
  Dystrophin (152-160)
KQVASSTGF

SEQ ID NO: 7366 - protein, 13 aa, Artificial Sequence
  Endoplasmin (72-84)
KSEKFAFQAEVNR

SEQ ID NO: 7367 - protein, 10 aa, Artificial Sequence
  Probable ATP-dependent RNA helicase DDX46 (374-383)
KTIAFLLPMF

SEQ ID NO: 7368 - protein, 9 aa, Artificial Sequence
  T-cell activation Rho GTPase-activating protein (56-64)
KVLSWPFLM

SEQ ID NO: 7369 - protein, 10 aa, Artificial Sequence
  Cyclin-dependent kinase 14 (155-164)
KVNGKLVALK

SEQ ID NO: 7370 - protein, 9 aa, Artificial Sequence
  DmX-like protein 1 (194-202)
KVWYNVENW

SEQ ID NO: 7371 - protein, 10 aa, Artificial Sequence
  Zinc finger protein 638 (730-739)
KYIETTPLTI

SEQ ID NO: 7372 - protein, 14 aa, Artificial Sequence
  Alpha-1B-glycoprotein (204-217)
LAPLEGARFALVRE

SEQ ID NO: 7373 - protein, 15 aa, Artificial Sequence
  Alpha-1B-glycoprotein (204-218)
LAPLEGARFALVRED

SEQ ID NO: 7374 - protein, 15 aa, Artificial Sequence
  Transmembrane protein C16orf54 (117-131)
LEARATAPPAPSAPN

SEQ ID NO: 7375 - protein, 9 aa, Artificial Sequence
  T-cell activation Rho GTPase-activating protein (66-74)
LENDQSLSF

SEQ ID NO: 7376 - protein, 13 aa, Artificial Sequence
  Polypeptide N-acetylgalactosaminyltransferase 1 (355-367)
LENIYPDSQIPRH

SEQ ID NO: 7377 - protein, 14 aa, Artificial Sequence
  Polypeptide N-acetylgalactosaminyltransferase 1 (355-368)
LENIYPDSQIPRHY

SEQ ID NO: 7378 - protein, 9 aa, Artificial Sequence
  Uncharacterized protein CXorf21 (214-222)
LEQKVVELY

SEQ ID NO: 7379 - protein, 10 aa, Artificial Sequence
  Cadherin EGF LAG seven-pass G-type receptor 1 (2401-2410)
LEVEERTKPV

SEQ ID NO: 7380 - protein, 13 aa, Artificial Sequence
  Cation-independent mannose-6-phosphate receptor (2073-2085)
LGDIYFKLFRASG

SEQ ID NO: 7381 - protein, 14 aa, Artificial Sequence
  Ragulator complex protein LAMTOR3 (19-32)
LHAIVVSDRDGVPV

SEQ ID NO: 7382 - protein, 15 aa, Artificial Sequence
  Ragulator complex protein LAMTOR3 (19-33)
LHAIVVSDRDGVPVI

SEQ ID NO: 7383 - protein, 16 aa, Artificial Sequence
  Ragulator complex protein LAMTOR3 (19-34)
LHAIVVSDRDGVPVIK

SEQ ID NO: 7384 - protein, 13 aa, Artificial Sequence
  Golgi apparatus protein 1 (361-373)
LIAQDYKVSYSLA

SEQ ID NO: 7385 - protein, 15 aa, Artificial Sequence
  Ras GTPase-activating-like protein IQGAP1 (347-361)
LKQLLSDKQQKRQSG

SEQ ID NO: 7386 - protein, 16 aa, Artificial Sequence
  Ras GTPase-activating-like protein IQGAP1 (347-362)
LKQLLSDKQQKRQSGQ

SEQ ID NO: 7387 - protein, 10 aa, Artificial Sequence
  NACHT, LRR and PYD domains-containing protein 2 (823-832)
LLDEGAKLLY

SEQ ID NO: 7388 - protein, 13 aa, Artificial Sequence
  Beta-1,4-galactosyltransferase 1 (112-124)
LNSLTYQVLDVQR

SEQ ID NO: 7389 - protein, 15 aa, Artificial Sequence
  Beta-1,4-galactosyltransferase 1 (112-126)
LNSLTYQVLDVQRYP

SEQ ID NO: 7390 - protein, 16 aa, Artificial Sequence
  Beta-1,4-galactosyltransferase 1 (112-127)
LNSLTYQVLDVQRYPL

SEQ ID NO: 7391 - protein, 15 aa, Artificial Sequence
  Fas apoptotic inhibitory molecule 3 (120-134)
LNVHSEYEPSWEEQP

SEQ ID NO: 7392 - protein, 15 aa, Artificial Sequence
  Phosphoinositide-3-kinase-interacting protein 1 (137-151)
LPARSEAAAVQPVIG

SEQ ID NO: 7393 - protein, 9 aa, Artificial Sequence
  DmX-like protein 1 (1557-1565)
LPAYRAQLL

SEQ ID NO: 7394 - protein, 14 aa, Artificial Sequence
  Putative endoplasmin-like protein (219-232)
LPEFDGKRFQNVAK

SEQ ID NO: 7395 - protein, 12 aa, Artificial Sequence
  Cullin-associated NEDD8-dissociated protein 1 (297-308)
LPEFYKTVSPAL

SEQ ID NO: 7396 - protein, 9 aa, Artificial Sequence
  TBC1 domain family member 22A (121-129)
LPHSATVTL

SEQ ID NO: 7397 - protein, 12 aa, Artificial Sequence
  Glycosyltransferase 8 domain-containing protein 1 (157-168)
LPILVPSAKKAI

SEQ ID NO: 7398 - protein, 13 aa, Artificial Sequence
  Glycosyltransferase 8 domain-containing protein 1 (157-169)
LPILVPSAKKAIY

SEQ ID NO: 7399 - protein, 14 aa, Artificial Sequence
  Glycosyltransferase 8 domain-containing protein 1 (157-170)
LPILVPSAKKAIYM

SEQ ID NO: 7400 - protein, 15 aa, Artificial Sequence
  Glycosyltransferase 8 domain-containing protein 1 (157-171)
LPILVPSAKKAIYMD

SEQ ID NO: 7401 - protein, 16 aa, Artificial Sequence
  Glycosyltransferase 8 domain-containing protein 1 (157-172)
LPILVPSAKKAIYMDD

SEQ ID NO: 7402 - protein, 9 aa, Artificial Sequence
  ATP-binding cassette sub-family A member 6 (899-907)
LPQEPRTSL

SEQ ID NO: 7403 - protein, 13 aa, Artificial Sequence
  Beta-1,4-galactosyltransferase 1 (50-62)
LPQLVGVSTPLQG

SEQ ID NO: 7404 - protein, 14 aa, Artificial Sequence
  Beta-1,4-galactosyltransferase 1 (50-63)
LPQLVGVSTPLQGG

SEQ ID NO: 7405 - protein, 15 aa, Artificial Sequence
  Beta-1,4-galactosyltransferase 1 (50-64)
LPQLVGVSTPLQGGS

SEQ ID NO: 7406 - protein, 9 aa, Artificial Sequence
  Proline and serine-rich protein 2 (219-227)
LPRPQGITV

SEQ ID NO: 7407 - protein, 14 aa, Artificial Sequence
  Pro-cathepsin H (48-61)
LPSQAFEYILYNKG

SEQ ID NO: 7408 - protein, 15 aa, Artificial Sequence
  Pro-cathepsin H (48-62)
LPSQAFEYILYNKGI

SEQ ID NO: 7409 - protein, 16 aa, Artificial Sequence
  Pro-cathepsin H (48-63)
LPSQAFEYILYNKGIM

SEQ ID NO: 7410 - protein, 17 aa, Artificial Sequence
  Pro-cathepsin H (48-64)
LPSQAFEYILYNKGIMG

SEQ ID NO: 7411 - protein, 15 aa, Artificial Sequence
  Ragulator complex protein LAMTOR3 (13-27)
LPSVEGLHAIVVSDR

SEQ ID NO: 7412 - protein, 14 aa, Artificial Sequence
  Fas apoptotic inhibitory molecule 3 (32-45)
LPYLFQMPAYASSS

SEQ ID NO: 7413 - protein, 15 aa, Artificial Sequence
  Fas apoptotic inhibitory molecule 3 (32-46)
LPYLFQMPAYASSSK

SEQ ID NO: 7414 - protein, 13 aa, Artificial Sequence
  Fibromodulin (27-39)
LQVLRLDGNEIKR

SEQ ID NO: 7415 - protein, 14 aa, Artificial Sequence
  Fibromodulin (27-40)
LQVLRLDGNEIKRS

SEQ ID NO: 7416 - protein, 15 aa, Artificial Sequence
  Fibromodulin (27-41)
LQVLRLDGNEIKRSA

SEQ ID NO: 7417 - protein, 16 aa, Artificial Sequence
  Fibromodulin (178-193)
LRELHLDHNQISRVPN

SEQ ID NO: 7418 - protein, 9 aa, Artificial Sequence
  DmX-like protein 1 (2001-2009)
LSEQTSVPL

SEQ ID NO: 7419 - protein, 8 aa, Artificial Sequence
  Transcription regulator protein BACH2 (709-716)
LSQEVCRD

SEQ ID NO: 7420 - protein, 12 aa, Artificial Sequence
  Testican-2 (45-56)
LSSISQYSGKIK

SEQ ID NO: 7421 - protein, 8 aa, Artificial Sequence
  Baculoviral IAP repeat-containing protein 5 (96-103)
LTLGEFLK

SEQ ID NO: 7422 - protein, 9 aa, Artificial Sequence
  Baculoviral IAP repeat-containing protein 5 (96-104)
LTLGEFLKL

SEQ ID NO: 7423 - protein, 8 aa, Artificial Sequence
  ATP-binding cassette sub-family A member 6 (1544-1551)
LTYKLPVA

SEQ ID NO: 7424 - protein, 8 aa, Artificial Sequence
  A-kinase anchor protein 2 (561-568)
LVDDPLEY

SEQ ID NO: 7425 - protein, 9 aa, Artificial Sequence
  RNA polymerase II subunit A C-terminal domain phosphatase (239-247)
LYELHVFTF

SEQ ID NO: 7426 - protein, 14 aa, Artificial Sequence
  Fibromodulin (271-284)
LYVRLSHNSLTNNG

SEQ ID NO: 7427 - protein, 15 aa, Artificial Sequence
  60S ribosomal protein L3 (237-251)
MGPLKKDRIAKEEGA

SEQ ID NO: 7428 - protein, 13 aa, Artificial Sequence
  Pro-cathepsin H (222-234)
MNGYFLIERGKNM

SEQ ID NO: 7429 - protein, 9 aa, Artificial Sequence
  Ras-specific guanine nucleotide-releasing factor 1 (773-781)
MSPFSKATL

SEQ ID NO: 7430 - protein, 10 aa, Artificial Sequence
  Perilipin-2 (62-71)
MTSALPIIQK

SEQ ID NO: 7431 - protein, 9 aa, Artificial Sequence
  RUN and FYVE domain-containing protein 1 (291-299)
MYSDVWKQL

SEQ ID NO: 7432 - protein, 15 aa, Artificial Sequence
  Heterogeneous nuclear ribonucleoprotein A1-like 2 (108-122)
NDFGNYNNQSSNFGP

SEQ ID NO: 7433 - protein, 12 aa, Artificial Sequence
  SLAM family member 6 (192-203)
NDTITIYSTINH

SEQ ID NO: 7434 - protein, 13 aa, Artificial Sequence
  SLAM family member 6 (192-204)
NDTITIYSTINHS

SEQ ID NO: 7435 - protein, 14 aa, Artificial Sequence
  SLAM family member 6 (192-205)
NDTITIYSTINHSK

SEQ ID NO: 7436 - protein, 16 aa, Artificial Sequence
  Glutathione peroxidase 1 (100-115)
NDVAWNFEKFLVGPDG

SEQ ID NO: 7437 - protein, 10 aa, Artificial Sequence
  ATP-binding cassette sub-family A member 6 (811-820)
NEMELAHSSF

SEQ ID NO: 7438 - protein, 8 aa, Artificial Sequence
  Ribonucleoside-diphosphate reductase subunit M2 B (50-57)
NENLVERF

SEQ ID NO: 7439 - protein, 12 aa, Artificial Sequence
  C-C chemokine receptor type 7 (192-203)
NFERNKAIKVII

SEQ ID NO: 7440 - protein, 13 aa, Artificial Sequence
  C-C chemokine receptor type 7 (192-204)
NFERNKAIKVIIA

SEQ ID NO: 7441 - protein, 12 aa, Artificial Sequence
  Fas apoptotic inhibitory molecule 3 (66-77)
NFIKAEYKGRVT

SEQ ID NO: 7442 - protein, 14 aa, Artificial Sequence
  Platelet endothelial cell adhesion molecule (187-200)
NFVILEFPVEEQDR

SEQ ID NO: 7443 - protein, 15 aa, Artificial Sequence
  Phosphoinositide-3-kinase-interacting protein 1 (29-43)
NGHLYREDQTSPAPG

SEQ ID NO: 7444 - protein, 16 aa, Artificial Sequence
  Phosphoinositide-3-kinase-interacting protein 1 (29-44)
NGHLYREDQTSPAPGL

SEQ ID NO: 7445 - protein, 17 aa, Artificial Sequence
  Phosphoinositide-3-kinase-interacting protein 1 (29-45)
NGHLYREDQTSPAPGLR

SEQ ID NO: 7446 - protein, 14 aa, Artificial Sequence
  CD44 antigen (16-29)
NGRYSISRTEAADL

SEQ ID NO: 7447 - protein, 12 aa, Artificial Sequence
  Pro-cathepsin H (223-234)
NGYFLIERGKNM

SEQ ID NO: 7448 - protein, 10 aa, Artificial Sequence
  Thymidylate synthase (260-269)
NHIEPLKIQL

SEQ ID NO: 7449 - protein, 16 aa, Artificial Sequence
  B- and T-lymphocyte attenuator (251-266)
NKPGIVYASLNHSVIG

SEQ ID NO: 7450 - protein, 13 aa, Artificial Sequence
  E3 ubiquitin-protein ligase CHIP (44-56)
NLQRAYSLAKEQR

SEQ ID NO: 7451 - protein, 14 aa, Artificial Sequence
  Alpha-mannosidase 2 (65-78)
NNEIISNIRDSVIN

SEQ ID NO: 7452 - protein, 13 aa, Artificial Sequence
  Neurofibromin (66-78)
NNMRIFGEAAEKN

SEQ ID NO: 7453 - protein, 13 aa, Artificial Sequence
  Interleukin-4 receptor subunit alpha (193-205)
NPAYRSFSNSLSQ

SEQ ID NO: 7454 - protein, 17 aa, Artificial Sequence
  Transferrin receptor protein 1 (215-231)
NPGGYVAYSKAATVTGK

SEQ ID NO: 7455 - protein, 11 aa, Artificial Sequence
  Uncharacterized protein CXorf21 (203-213)
NPISNAVLNEY

SEQ ID NO: 7456 - protein, 17 aa, Artificial Sequence
  Kynureninase (429-445)
NPNGIRVAPVPLYNSFH

SEQ ID NO: 7457 - protein, 16 aa, Artificial Sequence
  MyoD family inhibitor domain-containing protein (64-79)
NPSDGELIRTQPQRLP

SEQ ID NO: 7458 - protein, 17 aa, Artificial Sequence
  MyoD family inhibitor domain-containing protein (64-80)
NPSDGELIRTQPQRLPQ

SEQ ID NO: 7459 - protein, 18 aa, Artificial Sequence
  MyoD family inhibitor domain-containing protein (64-81)
NPSDGELIRTQPQRLPQL

SEQ ID NO: 7460 - protein, 13 aa, Artificial Sequence
  Polypeptide N-acetylgalactosaminyltransferase 1 (405-417)
NQVFSYTANKEIR

SEQ ID NO: 7461 - protein, 14 aa, Artificial Sequence
  Polypeptide N-acetylgalactosaminyltransferase 1 (405-418)
NQVFSYTANKEIRT

SEQ ID NO: 7462 - protein, 16 aa, Artificial Sequence
  Polypeptide N-acetylgalactosaminyltransferase 1 (405-420)
NQVFSYTANKEIRTDD

SEQ ID NO: 7463 - protein, 9 aa, Artificial Sequence
  Cyclin-dependent kinase 14 (406-414)
NRLSAQAAL

SEQ ID NO: 7464 - protein, 12 aa, Artificial Sequence
  Transferrin receptor protein 1 (198-209)
NSVIIVDKNGRL

SEQ ID NO: 7465 - protein, 13 aa, Artificial Sequence
  Transferrin receptor protein 1 (198-210)
NSVIIVDKNGRLV

SEQ ID NO: 7466 - protein, 14 aa, Artificial Sequence
  Transferrin receptor protein 1 (198-211)
NSVIIVDKNGRLVY

SEQ ID NO: 7467 - protein, 14 aa, Artificial Sequence
  Glucose-6-phosphate isomerase (108-121)
NTPILVDGKDVMPE

SEQ ID NO: 7468 - protein, 15 aa, Artificial Sequence
  Glucose-6-phosphate isomerase (108-122)
NTPILVDGKDVMPEV

SEQ ID NO: 7469 - protein, 16 aa, Artificial Sequence
  Glucose-6-phosphate isomerase (108-123)
NTPILVDGKDVMPEVN

SEQ ID NO: 7470 - protein, 14 aa, Artificial Sequence
  Pericentriolar material 1 protein (1457-1470)
NTVIHLDQALARMR

SEQ ID NO: 7471 - protein, 15 aa, Artificial Sequence
  Pericentriolar material 1 protein (1457-1471)
NTVIHLDQALARMRE

SEQ ID NO: 7472 - protein, 13 aa, Artificial Sequence
  SLAM family member 6 (50-62)
NVSFRWEALGNTL

SEQ ID NO: 7473 - protein, 17 aa, Artificial Sequence
  Peroxiredoxin-1 (108-124)
PKRTIAQDYGVLKADEG

SEQ ID NO: 7474 - protein, 13 aa, Artificial Sequence
  Calsyntenin-1 (57-69)
PPLIALDKDAPLR

SEQ ID NO: 7475 - protein, 13 aa, Artificial Sequence
  Pro-cathepsin H (49-61)
PSQAFEYILYNKG

SEQ ID NO: 7476 - protein, 14 aa, Artificial Sequence
  Pro-cathepsin H (49-62)
PSQAFEYILYNKGI

SEQ ID NO: 7477 - protein, 15 aa, Artificial Sequence
  Pro-cathepsin H (49-63)
PSQAFEYILYNKGIM

SEQ ID NO: 7478 - protein, 15 aa, Artificial Sequence
  Low affinity immunoglobulin epsilon Fc receptor (39-53)
QADLSSFKSQELNER

SEQ ID NO: 7479 - protein, 11 aa, Artificial Sequence
  Ras-specific guanine nucleotide-releasing factor 1 (993-1003)
QEDPGDNQITL

SEQ ID NO: 7480 - protein, 10 aa, Artificial Sequence
  ATP synthase F(0) complex subunit C1, mitochondrial (106-115)
QLFSYAILGF

SEQ ID NO: 7481 - protein, 9 aa, Artificial Sequence
  Transmembrane emp24 domain-containing protein 4 (162-170)
QLLDQVEQI

SEQ ID NO: 7482 - protein, 13 aa, Artificial Sequence
  Glutathione peroxidase 1 (12-24)
QSVYAFSARPLAG

SEQ ID NO: 7483 - protein, 17 aa, Artificial Sequence
  Glutathione peroxidase 1 (12-28)
QSVYAFSARPLAGGEPV

SEQ ID NO: 7484 - protein, 15 aa, Artificial Sequence
  Lipolysis-stimulated lipoprotein receptor (423-437)
RDDLYDQDDSRDFPR

SEQ ID NO: 7485 - protein, 11 aa, Artificial Sequence
  Dystrophin (314-324)
RDFGPASQHFL

SEQ ID NO: 7486 - protein, 9 aa, Artificial Sequence
  Transcription regulator protein BACH2 (715-723)
RDIQSPEQI

SEQ ID NO: 7487 - protein, 8 aa, Artificial Sequence
  Elongation factor Tu, mitochondrial (53-60)
RDKPHVNV

SEQ ID NO: 7488 - protein, 11 aa, Artificial Sequence
  TRAF3-interacting JNK-activating modulator (92-102)
RDLQMNQALRF

SEQ ID NO: 7489 - protein, 8 aa, Artificial Sequence
  Probable ATP-dependent RNA helicase DDX46 (658-665)
RDSIINDF

SEQ ID NO: 7490 - protein, 9 aa, Artificial Sequence
  Eukaryotic translation initiation factor 6 (237-245)
RDSLIDSLT

SEQ ID NO: 7491 - protein, 11 aa, Artificial Sequence
  Cadherin EGF LAG seven-pass G-type receptor 1 (380-390)
RDSPINANLRY

SEQ ID NO: 7492 - protein, 9 aa, Artificial Sequence
  Transcription regulator protein BACH2 (258-266)
REDNSSNSL

SEQ ID NO: 7493 - protein, 10 aa, Artificial Sequence
  ATP-binding cassette sub-family A member 6 (1183-1192)
REFPEANFEL

SEQ ID NO: 7494 - protein, 16 aa, Artificial Sequence
  Alpha-1B-glycoprotein (123-138)
RGEKELLVPRSSTSPD

SEQ ID NO: 7495 - protein, 13 aa, Artificial Sequence
  Peroxiredoxin-1 (128-140)
RGLFIIDDKGILR

SEQ ID NO: 7496 - protein, 14 aa, Artificial Sequence
  Peroxiredoxin-1 (128-141)
RGLFIIDDKGILRQ

SEQ ID NO: 7497 - protein, 16 aa, Artificial Sequence
  Peroxiredoxin-1 (128-143)
RGLFIIDDKGILRQIT

SEQ ID NO: 7498 - protein, 9 aa, Artificial Sequence
  DNA dC-dU-editing enzyme APOBEC-3D (306-314)
RHSNVNLTI

SEQ ID NO: 7499 - protein, 10 aa, Artificial Sequence
  Zinc finger protein 107 (152-161)
RIHTGEKPYK

SEQ ID NO: 7500 - protein, 10 aa, Artificial Sequence
  Fibromodulin (324-333)
RINEFSISSF

SEQ ID NO: 7501 - protein, 9 aa, Artificial Sequence
  Cytoskeleton-associated protein 4 (199-207)
RISEVLQKL

SEQ ID NO: 7502 - protein, 14 aa, Artificial Sequence
  Leukosialin (349-362)
RKSRQGSLAMEELK

SEQ ID NO: 7503 - protein, 16 aa, Artificial Sequence
  Beta-1,4-galactosyltransferase 1 (49-64)
RLPQLVGVSTPLQGGS

SEQ ID NO: 7504 - protein, 12 aa, Artificial Sequence
  Proline-rich protein 12 (1113-1124)
RPAGEPYNRKTL

SEQ ID NO: 7505 - protein, 8 aa, Artificial Sequence
  Cadherin EGF LAG seven-pass G-type receptor 1 (2237-2244)
RPFVIVTA

SEQ ID NO: 7506 - protein, 9 aa, Artificial Sequence
  Cadherin EGF LAG seven-pass G-type receptor 1 (2367-2375)
RPIINTPMV

SEQ ID NO: 7507 - protein, 9 aa, Artificial Sequence
  A-kinase anchor protein 2 (800-808)
RPKNLMQTL

SEQ ID NO: 7508 - protein, 8 aa, Artificial Sequence
  B-lymphocyte antigen CD20 (222-229)
RPKSNIVL

SEQ ID NO: 7509 - protein, 9 aa, Artificial Sequence
  Arrestin domain-containing protein 4 (148-156)
RPKVPDQSV

SEQ ID NO: 7510 - protein, 9 aa, Artificial Sequence
  A-kinase anchor protein 2 (109-117)
RQAPPHIEL

SEQ ID NO: 7511 - protein, 14 aa, Artificial Sequence
  Golgi apparatus protein 1 (358-371)
RQKLIAQDYKVSYS

SEQ ID NO: 7512 - protein, 15 aa, Artificial Sequence
  Golgi apparatus protein 1 (358-372)
RQKLIAQDYKVSYSL

SEQ ID NO: 7513 - protein, 16 aa, Artificial Sequence
  Golgi apparatus protein 1 (358-373)
RQKLIAQDYKVSYSLA

SEQ ID NO: 7514 - protein, 17 aa, Artificial Sequence
  Golgi apparatus protein 1 (358-374)
RQKLIAQDYKVSYSLAK

SEQ ID NO: 7515 - protein, 9 aa, Artificial Sequence
  Dystrophin (178-186)
RQLGEVASF

SEQ ID NO: 7516 - protein, 8 aa, Artificial Sequence
  Cordon-bleu protein-like 1 (1082-1089)
RQSLLTAI

SEQ ID NO: 7517 - protein, 9 aa, Artificial Sequence
  Dynamin-binding protein (661-669)
RRKDLVLKY

SEQ ID NO: 7518 - protein, 15 aa, Artificial Sequence
  Leukosialin (348-362)
RRKSRQGSLAMEELK

SEQ ID NO: 7519 - protein, 12 aa, Artificial Sequence
  Ras-related protein Rab-11A (51-62)
RSIQVDGKTIKA

SEQ ID NO: 7520 - protein, 13 aa, Artificial Sequence
  Ras-related protein Rab-11A (51-63)
RSIQVDGKTIKAQ

SEQ ID NO: 7521 - protein, 14 aa, Artificial Sequence
  Ras-related protein Rab-11A (51-64)
RSIQVDGKTIKAQI

SEQ ID NO: 7522 - protein, 11 aa, Artificial Sequence
  TP53-target gene 5 protein (40-50)
RTVLKNLSLLK

SEQ ID NO: 7523 - protein, 14 aa, Artificial Sequence
  Golgi apparatus protein 1 (995-1008)
SALDYRLDPQLQLH

SEQ ID NO: 7524 - protein, 11 aa, Artificial Sequence
  AN1-type zinc finger protein 5 (63-73)
SASVQRADTSL

SEQ ID NO: 7525 - protein, 14 aa, Artificial Sequence
  IgG receptor FcRn large subunit p51 (253-266)
SDGSFHASSSLTVK

SEQ ID NO: 7526 - protein, 14 aa, Artificial Sequence
  Plasma membrane calcium-transporting ATPase 1 (256-269)
SDGSYRIFSKGASE

SEQ ID NO: 7527 - protein, 9 aa, Artificial Sequence
  Probable ribonuclease ZC3H12D (505-513)
SDLARLILL

SEQ ID NO: 7528 - protein, 15 aa, Artificial Sequence
  ATP synthase subunit alpha, mitochondrial (348-362)
SDLDAATQQLLSRGV

SEQ ID NO: 7529 - protein, 9 aa, Artificial Sequence
  TRAF3-interacting JNK-activating modulator (138-146)
SEAEKLTLV

SEQ ID NO: 7530 - protein, 10 aa, Artificial Sequence
  Lysine-specific demethylase 2B (477-486)
SEESVKSTTL

SEQ ID NO: 7531 - protein, 9 aa, Artificial Sequence
  Elongator complex protein 3 (338-346)
SEETFRFEL

SEQ ID NO: 7532 - protein, 9 aa, Artificial Sequence
  Zinc finger protein 638 (865-873)
SEIKTSIEV

SEQ ID NO: 7533 - protein, 9 aa, Artificial Sequence
  Ribonucleoside-diphosphate reductase subunit M2 B (275-283)
SEYQRFAVM

SEQ ID NO: 7534 - protein, 19 aa, Artificial Sequence
  DnaJ homolog subfamily C member 5 (12-30)
SGESLYHVLGLDKNATSDD

SEQ ID NO: 7535 - protein, 14 aa, Artificial Sequence
  Heterogeneous nuclear ribonucleoprotein A1-like 2 (133-146)
SGPYGGGGQYFAKP

SEQ ID NO: 7536 - protein, 25 aa, Artificial Sequence
  Heterogeneous nuclear ribonucleoprotein A3 (147-171)
SGQQQSNYGPMKGGSFGGRSSGSPY

SEQ ID NO: 7537 - protein, 23 aa, Artificial Sequence
  Heterogeneous nuclear ribonucleoprotein A3 (167-189)
SGSPYGGGYGSGGGSGGYGSRRF

SEQ ID NO: 7538 - protein, 15 aa, Artificial Sequence
  Carbohydrate sulfotransferase 2 (175-189)
SGSSFFGELFNQNPE

SEQ ID NO: 7539 - protein, 13 aa, Artificial Sequence
  Ceramide glucosyltransferase (192-204)
SHPRYYISANVTG

SEQ ID NO: 7540 - protein, 15 aa, Artificial Sequence
  Ceramide glucosyltransferase (192-206)
SHPRYYISANVTGFK

SEQ ID NO: 7541 - protein, 9 aa, Artificial Sequence
  Hematopoietic SH2 domain-containing protein (61-69)
SHSHVGYTL

SEQ ID NO: 7542 - protein, 15 aa, Artificial Sequence
  Serine incorporator 3 (252-266)
SIISIHPKIQEHQPR

SEQ ID NO: 7543 - protein, 8 aa, Artificial Sequence
  Uncharacterized protein CXorf21 (192-199)
SIKEKSSL

SEQ ID NO: 7544 - protein, 9 aa, Artificial Sequence
  Protein asunder homolog (394-402)
SILEDPPSI

SEQ ID NO: 7545 - protein, 14 aa, Artificial Sequence
  Golgi apparatus protein 1 (1057-1070)
SKADIFVDPVLHTA

SEQ ID NO: 7546 - protein, 12 aa, Artificial Sequence
  Perilipin-2 (369-380)
SLLTSSKGQLQK

SEQ ID NO: 7547 - protein, 9 aa, Artificial Sequence
  DmX-like protein 1 (607-615)
SLNQWLVSF

SEQ ID NO: 7548 - protein, 9 aa, Artificial Sequence
  DmX-like protein 1 (1285-1293)
SMTSLAQKI

SEQ ID NO: 7549 - protein, 14 aa, Artificial Sequence
  Cystatin-C (64-77)
SNDMYHSRALQVVR

SEQ ID NO: 7550 - protein, 14 aa, Artificial Sequence
  Vitamin D-binding protein (234-247)
SNLIKLAQKVPTAD

SEQ ID NO: 7551 - protein, 15 aa, Artificial Sequence
  Glucose-6-phosphate isomerase (107-121)
SNTPILVDGKDVMPE

SEQ ID NO: 7552 - protein, 17 aa, Artificial Sequence
  Glucose-6-phosphate isomerase (107-123)
SNTPILVDGKDVMPEVN

SEQ ID NO: 7553 - protein, 9 aa, Artificial Sequence
  NACHT, LRR and PYD domains-containing protein 2 (739-747)
SPADAHRNL

SEQ ID NO: 7554 - protein, 12 aa, Artificial Sequence
  Calcium and integrin-binding protein 1 (80-91)
SPAKDSLSFEDF

SEQ ID NO: 7555 - protein, 15 aa, Artificial Sequence
  Calcium and integrin-binding protein 1 (80-94)
SPAKDSLSFEDFLDL

SEQ ID NO: 7556 - protein, 8 aa, Artificial Sequence
  Tumor necrosis factor receptor superfamily member 13C (50-57)
SPAPRTAL

SEQ ID NO: 7557 - protein, 9 aa, Artificial Sequence
  Cordon-bleu protein-like 1 (911-919)
SPEQTLSPL

SEQ ID NO: 7558 - protein, 15 aa, Artificial Sequence
  Transferrin receptor protein 1 (695-709)
SPFRHVFWGSGSHTL

SEQ ID NO: 7559 - protein, 8 aa, Artificial Sequence
  Ras-specific guanine nucleotide-releasing factor 1 (774-781)
SPFSKATL

SEQ ID NO: 7560 - protein, 14 aa, Artificial Sequence
  Beta-1,4-galactosyltransferase 1 (174-187)
SPHKVAIIIPFRNR

SEQ ID NO: 7561 - protein, 16 aa, Artificial Sequence
  Beta-1,4-galactosyltransferase 1 (174-189)
SPHKVAIIIPFRNRQE

SEQ ID NO: 7562 - protein, 17 aa, Artificial Sequence
  Beta-1,4-galactosyltransferase 1 (174-190)
SPHKVAIIIPFRNRQEH

SEQ ID NO: 7563 - protein, 13 aa, Artificial Sequence
  Phosphate-regulating neutral endopeptidase (424-436)
SPPQFRVNGAISN

SEQ ID NO: 7564 - protein, 15 aa, Artificial Sequence
  Phosphate-regulating neutral endopeptidase (424-438)
SPPQFRVNGAISNFE

SEQ ID NO: 7565 - protein, 16 aa, Artificial Sequence
  Phosphate-regulating neutral endopeptidase (424-439)
SPPQFRVNGAISNFEE

SEQ ID NO: 7566 - protein, 17 aa, Artificial Sequence
  Phosphate-regulating neutral endopeptidase (424-440)
SPPQFRVNGAISNFEEF

SEQ ID NO: 7567 - protein, 9 aa, Artificial Sequence
  Zinc finger protein 296 (218-226)
SPRASGSGL

SEQ ID NO: 7568 - protein, 10 aa, Artificial Sequence
  Lysine-specific demethylase 2B (832-841)
SPRPPLGSSL

SEQ ID NO: 7569 - protein, 15 aa, Artificial Sequence
  Golgi apparatus protein 1 (1141-1155)
SPSKNYILSVISGSI

SEQ ID NO: 7570 - protein, 8 aa, Artificial Sequence
  T-cell activation Rho GTPase-activating protein (149-156)
SPSRQPQV

SEQ ID NO: 7571 - protein, 18 aa, Artificial Sequence
  SLAM family member 6 (167-184)
SPTNNTVYASVTHSNRET

SEQ ID NO: 7572 - protein, 10 aa, Artificial Sequence
  Cadherin EGF LAG seven-pass G-type receptor 1 (2960-2969)
SPTSSRTSSL

SEQ ID NO: 7573 - protein, 14 aa, Artificial Sequence
  Alpha-mannosidase 2 (670-683)
SPTVQVFSASGKPV

SEQ ID NO: 7574 - protein, 11 aa, Artificial Sequence
  ATP synthase F(0) complex subunit C1, mitochondrial (32-42)
SPVNSSKQPSY

SEQ ID NO: 7575 - protein, 8 aa, Artificial Sequence
  Lysine-specific demethylase 2B (842-849)
SPWWRSSL

SEQ ID NO: 7576 - protein, 21 aa, Artificial Sequence
  Heterogeneous nuclear ribonucleoprotein A3 (169-189)
SPYGGGYGSGGGSGGYGSRRF

SEQ ID NO: 7577 - protein, 9 aa, Artificial Sequence
  Melanoma antigen preferentially expressed in tumors (406-414)
SQLTTLSFY

SEQ ID NO: 7578 - protein, 15 aa, Artificial Sequence
  Platelet endothelial cell adhesion molecule (409-423)
SQPRISYDAQFEVIK

SEQ ID NO: 7579 - protein, 16 aa, Artificial Sequence
  Platelet endothelial cell adhesion molecule (409-424)
SQPRISYDAQFEVIKG

SEQ ID NO: 7580 - protein, 9 aa, Artificial Sequence
  Tumor protein p53-inducible protein 11 (14-22)
SQTDLVSRL

SEQ ID NO: 7581 - protein, 15 aa, Artificial Sequence
  Interleukin-4 receptor subunit alpha (90-104)
SRDDFQEGREGIVAR

SEQ ID NO: 7582 - protein, 9 aa, Artificial Sequence
  T-cell activation Rho GTPase-activating protein (308-316)
SRHQSFTTK

SEQ ID NO: 7583 - protein, 9 aa, Artificial Sequence
  T-cell activation Rho GTPase-activating protein (5-13)
SSHNASKTL

SEQ ID NO: 7584 - protein, 15 aa, Artificial Sequence
  Ragulator complex protein LAMTOR1 (55-69)
SSILAKTASNIIDVS

SEQ ID NO: 7585 - protein, 13 aa, Artificial Sequence
  Serine incorporator 3 (351-363)
SSIRTSTNSQVDK

SEQ ID NO: 7586 - protein, 16 aa, Artificial Sequence
  Alpha-mannosidase 2 (669-684)
SSPTVQVFSASGKPVE

SEQ ID NO: 7587 - protein, 9 aa, Artificial Sequence
  DmX-like protein 1 (1271-1279)
SSSGLHPPK

SEQ ID NO: 7588 - protein, 13 aa, Artificial Sequence
  Interleukin-4 receptor subunit alpha (490-502)
SSSSFHPAPGNAQ

SEQ ID NO: 7589 - protein, 9 aa, Artificial Sequence
  Interleukin-1 beta (84-92)
SVDPKNYPK

SEQ ID NO: 7590 - protein, 13 aa, Artificial Sequence
  15 kDa selenoprotein (150-162)
SVEEFLSEKLERI

SEQ ID NO: 7591 - protein, 12 aa, Artificial Sequence
  Transferrin receptor protein 1 (199-210)
SVIIVDKNGRLV

SEQ ID NO: 7592 - protein, 9 aa, Artificial Sequence
  AT-rich interactive domain-containing protein 5B (278-286)
SVIQHVQSF

SEQ ID NO: 7593 - protein, 10 aa, Artificial Sequence
  Probable ATP-dependent RNA helicase DDX46 (198-207)
SVKGGGGNEK

SEQ ID NO: 7594 - protein, 14 aa, Artificial Sequence
  Plasma membrane calcium-transporting ATPase 1 (110-123)
SVKKMMKDNNLVRH

SEQ ID NO: 7595 - protein, 9 aa, Artificial Sequence
  Zinc finger protein 638 (619-627)
SVKPTSATK

SEQ ID NO: 7596 - protein, 11 aa, Artificial Sequence
  Interleukin-17 receptor A (789-799)
SVQSDQGYISR

SEQ ID NO: 7597 - protein, 15 aa, Artificial Sequence
  Low affinity immunoglobulin epsilon Fc receptor (32-46)
SWNLNGLQADLSSFK

SEQ ID NO: 7598 - protein, 15 aa, Artificial Sequence
  Receptor-type tyrosine-protein phosphatase alpha (182-196)
TATIVMVTNLKERKE

SEQ ID NO: 7599 - protein, 10 aa, Artificial Sequence
  Dystrophin (30-39)
TEAETTANVL

SEQ ID NO: 7600 - protein, 8 aa, Artificial Sequence
  Transcription regulator protein BACH2 (559-566)
TEHQEPGL

SEQ ID NO: 7601 - protein, 9 aa, Artificial Sequence
  Cordon-bleu protein-like 1 (804-812)
TEHQVPSSV

SEQ ID NO: 7602 - protein, 11 aa, Artificial Sequence
  Uncharacterized protein CXorf21 (281-291)
TEITEISTPSL

SEQ ID NO: 7603 - protein, 9 aa, Artificial Sequence
  Ribonucleoside-diphosphate reductase subunit M2 B (128-136)
TFGERVVAF

SEQ ID NO: 7604 - protein, 15 aa, Artificial Sequence
  Cation-independent mannose-6-phosphate receptor (1446-1460)
TGHLFDLSSLSGRAG

SEQ ID NO: 7605 - protein, 14 aa, Artificial Sequence
  Low affinity immunoglobulin epsilon Fc receptor (139-152)
TGSWIGLRNLDLKG

SEQ ID NO: 7606 - protein, 15 aa, Artificial Sequence
  SLAM family member 6 (104-118)
TGSYRAQISTKTSAK

SEQ ID NO: 7607 - protein, 9 aa, Artificial Sequence
  ATP-binding cassette sub-family A member 6 (728-736)
THHIPDAKL

SEQ ID NO: 7608 - protein, 9 aa, Artificial Sequence
  Transcription regulator protein BACH2 (70-78)
TKNDLVVSL

SEQ ID NO: 7609 - protein, 8 aa, Artificial Sequence
  Baculoviral IAP repeat-containing protein 5 (97-104)
TLGEFLKL

SEQ ID NO: 7610 - protein, 13 aa, Artificial Sequence
  Fas apoptotic inhibitory molecule 3 (65-77)
TNFIKAEYKGRVT

SEQ ID NO: 7611 - protein, 14 aa, Artificial Sequence
  Calsyntenin-1 (140-153)
TNVKKSHKATVHIQ

SEQ ID NO: 7612 - protein, 9 aa, Artificial Sequence
  Interferon regulatory factor 9 (382-390)
TPEQQAAIL

SEQ ID NO: 7613 - protein, 9 aa, Artificial Sequence
  Cyclin-dependent kinase 14 (174-182)
TPFTAIREA

SEQ ID NO: 7614 - protein, 9 aa, Artificial Sequence
  AT-rich interactive domain-containing protein 5B (36-44)
TPIERIPYL

SEQ ID NO: 7615 - protein, 12 aa, Artificial Sequence
  Glucose-6-phosphate isomerase (109-120)
TPILVDGKDVMP

SEQ ID NO: 7616 - protein, 13 aa, Artificial Sequence
  Glucose-6-phosphate isomerase (109-121)
TPILVDGKDVMPE

SEQ ID NO: 7617 - protein, 14 aa, Artificial Sequence
  Glucose-6-phosphate isomerase (109-122)
TPILVDGKDVMPEV

SEQ ID NO: 7618 - protein, 15 aa, Artificial Sequence
  Glucose-6-phosphate isomerase (109-123)
TPILVDGKDVMPEVN

SEQ ID NO: 7619 - protein, 9 aa, Artificial Sequence
  Probable ribonuclease ZC3H12D (145-153)
TPIREQHVL

SEQ ID NO: 7620 - protein, 16 aa, Artificial Sequence
  Protein CDV3 homolog (80-95)
TPQGPPEIYSDTQFPS

SEQ ID NO: 7621 - protein, 18 aa, Artificial Sequence
  Protein CDV3 homolog (80-97)
TPQGPPEIYSDTQFPSLQ

SEQ ID NO: 7622 - protein, 20 aa, Artificial Sequence
  Protein CDV3 homolog (80-99)
TPQGPPEIYSDTQFPSLQST

SEQ ID NO: 7623 - protein, 18 aa, Artificial Sequence
  SLAM family member 6 (188-205)
TPRENDTITIYSTINHSK

SEQ ID NO: 7624 - protein, 23 aa, Artificial Sequence
  SLAM family member 6 (188-210)
TPRENDTITIYSTINHSKESKPT

SEQ ID NO: 7625 - protein, 9 aa, Artificial Sequence
  Protein asunder homolog (320-328)
TPRTNNIEL

SEQ ID NO: 7626 - protein, 15 aa, Artificial Sequence
  E3 ubiquitin-protein ligase CHIP (246-260)
TPSGITYDRKDIEEH

SEQ ID NO: 7627 - protein, 12 aa, Artificial Sequence
  Putative heat shock 70 kDa protein 7 (40-51)
TPSYVAFTDTER

SEQ ID NO: 7628 - protein, 13 aa, Artificial Sequence
  Putative heat shock 70 kDa protein 7 (40-52)
TPSYVAFTDTERL

SEQ ID NO: 7629 - protein, 9 aa, Artificial Sequence
  Zinc finger protein 107 (512-520)
TRHKIVHTK

SEQ ID NO: 7630 - protein, 14 aa, Artificial Sequence
  Cytochrome b ascorbate-dependent protein 3 (187-200)
TRPYHSLPSEAVFA

SEQ ID NO: 7631 - protein, 15 aa, Artificial Sequence
  Cytochrome b ascorbate-dependent protein 3 (187-201)
TRPYHSLPSEAVFAN

SEQ ID NO: 7632 - protein, 14 aa, Artificial Sequence
  Ras-related protein Rab-11A (50-63)
TRSIQVDGKTIKAQ

SEQ ID NO: 7633 - protein, 14 aa, Artificial Sequence
  Ceramide glucosyltransferase (191-204)
TSHPRYYISANVTG

SEQ ID NO: 7634 - protein, 16 aa, Artificial Sequence
  Ceramide glucosyltransferase (191-206)
TSHPRYYISANVTGFK

SEQ ID NO: 7635 - protein, 16 aa, Artificial Sequence
  B- and T-lymphocyte attenuator (128-143)
TTLYVTDVKSASERPS

SEQ ID NO: 7636 - protein, 14 aa, Artificial Sequence
  Fas apoptotic inhibitory molecule 3 (64-77)
TTNFIKAEYKGRVT

SEQ ID NO: 7637 - protein, 14 aa, Artificial Sequence
  DnaJ homolog subfamily C member 5 (181-194)
TTQLTADSHPSYHT

SEQ ID NO: 7638 - protein, 15 aa, Artificial Sequence
  DnaJ homolog subfamily C member 5 (181-195)
TTQLTADSHPSYHTD

SEQ ID NO: 7639 - protein, 16 aa, Artificial Sequence
  DnaJ homolog subfamily C member 5 (181-196)
TTQLTADSHPSYHTDG

SEQ ID NO: 7640 - protein, 9 aa, Artificial Sequence
  Cordon-bleu protein-like 1 (732-740)
TTYKIVPPK

SEQ ID NO: 7641 - protein, 11 aa, Artificial Sequence
  Eukaryotic translation initiation factor 6 (141-151)
TVADQVLVGSY

SEQ ID NO: 7642 - protein, 9 aa, Artificial Sequence
  ATP-binding cassette sub-family A member 6 (572-580)
TVKENLSLF

SEQ ID NO: 7643 - protein, 12 aa, Artificial Sequence
  C-C chemokine receptor type 7 (93-104)
VAIVQAVSAHRH

SEQ ID NO: 7644 - protein, 13 aa, Artificial Sequence
  C-C chemokine receptor type 7 (93-105)
VAIVQAVSAHRHR

SEQ ID NO: 7645 - protein, 14 aa, Artificial Sequence
  C-C chemokine receptor type 7 (93-106)
VAIVQAVSAHRHRA

SEQ ID NO: 7646 - protein, 15 aa, Artificial Sequence
  C-C chemokine receptor type 7 (93-107)
VAIVQAVSAHRHRAR

SEQ ID NO: 7647 - protein, 12 aa, Artificial Sequence
  Interleukin-4 receptor subunit alpha (102-113)
VARLTESLFLDL

SEQ ID NO: 7648 - protein, 14 aa, Artificial Sequence
  Interleukin-4 receptor subunit alpha (102-115)
VARLTESLFLDLLG

SEQ ID NO: 7649 - protein, 12 aa, Artificial Sequence
  Cytochrome b ascorbate-dependent protein 3 (99-110)
VAVFTFHNHGRT

SEQ ID NO: 7650 - protein, 13 aa, Artificial Sequence
  Cytochrome b ascorbate-dependent protein 3 (99-111)
VAVFTFHNHGRTA

SEQ ID NO: 7651 - protein, 15 aa, Artificial Sequence
  Cytochrome b ascorbate-dependent protein 3 (99-113)
VAVFTFHNHGRTANL

SEQ ID NO: 7652 - protein, 13 aa, Artificial Sequence
  Vesicle-associated membrane protein 1 (52-64)
VDKVLERDQKLSE

SEQ ID NO: 7653 - protein, 15 aa, Artificial Sequence
  Vesicle-associated membrane protein 3 (33-47)
VDKVLERDQKLSELD

SEQ ID NO: 7654 - protein, 16 aa, Artificial Sequence
  Vesicle-associated membrane protein 3 (33-48)
VDKVLERDQKLSELDD

SEQ ID NO: 7655 - protein, 17 aa, Artificial Sequence
  Vesicle-associated membrane protein 1 (52-68)
VDKVLERDQKLSELDDR

SEQ ID NO: 7656 - protein, 15 aa, Artificial Sequence
  T-complex protein 1 subunit beta (408-422)
VDNIIKAAPRKRVPD

SEQ ID NO: 7657 - protein, 12 aa, Artificial Sequence
  15 kDa selenoprotein (151-162)
VEEFLSEKLERI

SEQ ID NO: 7658 - protein, 15 aa, Artificial Sequence
  Glycosyltransferase 8 domain-containing protein 1 (270-284)
VEEGLYSRTLAGSIT

SEQ ID NO: 7659 - protein, 10 aa, Artificial Sequence
  B-lymphocyte antigen CD19 (115-124)
VEGSGELFRW

SEQ ID NO: 7660 - protein, 9 aa, Artificial Sequence
  Interferon regulatory factor 9 (320-328)
VELFRTAYF

SEQ ID NO: 7661 - protein, 13 aa, Artificial Sequence
  Transferrin receptor protein 1 (681-693)
VEYHFLSPYVSPK

SEQ ID NO: 7662 - protein, 14 aa, Artificial Sequence
  Transferrin receptor protein 1 (681-694)
VEYHFLSPYVSPKE

SEQ ID NO: 7663 - protein, 15 aa, Artificial Sequence
  Phosphoinositide-3-kinase-interacting protein 1 (130-144)
VFAPANALPARSEAA

SEQ ID NO: 7664 - protein, 9 aa, Artificial Sequence
  HLA class II histocompatibility antigen, DM alpha chain (12-20)
VFTLKPLEF

SEQ ID NO: 7665 - protein, 13 aa, Artificial Sequence
  Cystatin-C (57-69)
VGEYNKASNDMYH

SEQ ID NO: 7666 - protein, 15 aa, Artificial Sequence
  Phosphate-regulating neutral endopeptidase (131-145)
VGKMFVDVYFQEDKK

SEQ ID NO: 7667 - protein, 16 aa, Artificial Sequence
  Phosphate-regulating neutral endopeptidase (131-146)
VGKMFVDVYFQEDKKE

SEQ ID NO: 7668 - protein, 14 aa, Artificial Sequence
  HLA class II histocompatibility antigen, DO beta chain (70-83)
VGMFVALTKLGQPD

SEQ ID NO: 7669 - protein, 17 aa, Artificial Sequence
  Perilipin-3 (406-422)
VGPFAPGITEKAPEEKK

SEQ ID NO: 7670 - protein, 14 aa, Artificial Sequence
  Cullin-associated NEDD8-dissociated protein 1 (747-760)
VGQFIQDVKNSRST

SEQ ID NO: 7671 - protein, 15 aa, Artificial Sequence
  Cullin-associated NEDD8-dissociated protein 1 (747-761)
VGQFIQDVKNSRSTD

SEQ ID NO: 7672 - protein, 12 aa, Artificial Sequence
  Ceruloplasmin (107-118)
VHLKNLASRPYT

SEQ ID NO: 7673 - protein, 15 aa, Artificial Sequence
  Polypeptide N-acetylgalactosaminyltransferase 1 (76-90)
VHSVINRSPRHMIEE

SEQ ID NO: 7674 - protein, 13 aa, Artificial Sequence
  Interleukin-4 receptor subunit alpha (189-201)
VIAGNPAYRSFSN

SEQ ID NO: 7675 - protein, 10 aa, Artificial Sequence
  Methyltransferase-like protein 7A (45-54)
VIYNEQMASK

SEQ ID NO: 7676 - protein, 13 aa, Artificial Sequence
  Plasma membrane calcium-transporting ATPase 1 (111-123)
VKKMMKDNNLVRH

SEQ ID NO: 7677 - protein, 14 aa, Artificial Sequence
  Vesicle-associated membrane protein 1 (55-68)
VLERDQKLSELDDR

SEQ ID NO: 7678 - protein, 8 aa, Artificial Sequence
  ATP-binding cassette sub-family A member 6 (320-327)
VLLKKAVL

SEQ ID NO: 7679 - protein, 9 aa, Artificial Sequence
  Methyltransferase-like protein 7A (163-171)
VLRPGGAFY

SEQ ID NO: 7680 - protein, 12 aa, Artificial Sequence
  Serine incorporator 3 (91-102)
VLVGYKAVYRIS

SEQ ID NO: 7681 - protein, 9 aa, Artificial Sequence
  Ras GTPase-activating protein nGAP (848-856)
VMLDVPIRL

SEQ ID NO: 7682 - protein, 10 aa, Artificial Sequence
  B-cell linker protein (9-18)
VPASQKLRQL

SEQ ID NO: 7683 - protein, 9 aa, Artificial Sequence
  Endoplasmic reticulum resident protein 44 (242-250)
VPLVREITF

SEQ ID NO: 7684 - protein, 9 aa, Artificial Sequence
  BRCA2 and CDKN1A-interacting protein (285-293)
VPMTPLRTV

SEQ ID NO: 7685 - protein, 19 aa, Artificial Sequence
  Interleukin-4 receptor subunit alpha (241-259)
VPQPEPETWEQILRRNVLQ

SEQ ID NO: 7686 - protein, 16 aa, Artificial Sequence
  Cation-independent mannose-6-phosphate receptor (1001-1016)
VPSPVDCQVTDLAGNE

SEQ ID NO: 7687 - protein, 14 aa, Artificial Sequence
  Fibromodulin (103-116)
VPSRMKYVYFQNNQ

SEQ ID NO: 7688 - protein, 16 aa, Artificial Sequence
  Fibromodulin (103-118)
VPSRMKYVYFQNNQIT

SEQ ID NO: 7689 - protein, 17 aa, Artificial Sequence
  Fibromodulin (103-119)
VPSRMKYVYFQNNQITS

SEQ ID NO: 7690 - protein, 13 aa, Artificial Sequence
  Ragulator complex protein LAMTOR3 (30-42)
VPVIKVANDNAPE

SEQ ID NO: 7691 - protein, 9 aa, Artificial Sequence
  Beta-1,4-galactosyltransferase 1 (117-125)
VPVPHTTAL

SEQ ID NO: 7692 - protein, 9 aa, Artificial Sequence
  Plateletoprotein 4 (96-104)
VPYPVTTTV

SEQ ID NO: 7693 - protein, 14 aa, Artificial Sequence
  Protocadherin-9 (176-189)
VQHYELLNGQSVFG

SEQ ID NO: 7694 - protein, 15 aa, Artificial Sequence
  Phosphoinositide-3-kinase-interacting protein 1 (128-142)
VQVFAPANALPARSE

SEQ ID NO: 7695 - protein, 13 aa, Artificial Sequence
  Cystatin-C (76-88)
VRARKQIVAGVNY

SEQ ID NO: 7696 - protein, 9 aa, Artificial Sequence
  Perilipin-2 (218-226)
VRLGSLSTK

SEQ ID NO: 7697 - protein, 18 aa, Artificial Sequence
  Cystatin-C (49-66)
VRRALDFAVGEYNKASND

SEQ ID NO: 7698 - protein, 12 aa, Artificial Sequence
  SLAM family member 6 (51-62)
VSFRWEALGNTL

SEQ ID NO: 7699 - protein, 14 aa, Artificial Sequence
  Rab GTPase-activating protein 1 (17-30)
VSTLNSEDFVLVSR

SEQ ID NO: 7700 - protein, 15 aa, Artificial Sequence
  Rab GTPase-activating protein 1 (17-31)
VSTLNSEDFVLVSRQ

SEQ ID NO: 7701 - protein, 16 aa, Artificial Sequence
  Rab GTPase-activating protein 1 (17-32)
VSTLNSEDFVLVSRQG

SEQ ID NO: 7702 - protein, 13 aa, Artificial Sequence
  HLA class II histocompatibility antigen, DM alpha chain (200-212)
VTHEIDRYTAIAY

SEQ ID NO: 7703 - protein, 17 aa, Artificial Sequence
  Fas apoptotic inhibitory molecule 3 (118-134)
VTLNVHSEYEPSWEEQP

SEQ ID NO: 7704 - protein, 9 aa, Artificial Sequence
  Zinc finger protein 296 (209-217)
VVGPAAEAK

SEQ ID NO: 7705 - protein, 14 aa, Artificial Sequence
  Cullin-associated NEDD8-dissociated protein 1 (746-759)
VVGQFIQDVKNSRS

SEQ ID NO: 7706 - protein, 15 aa, Artificial Sequence
  Cullin-associated NEDD8-dissociated protein 1 (746-760)
VVGQFIQDVKNSRST

SEQ ID NO: 7707 - protein, 16 aa, Artificial Sequence
  Cullin-associated NEDD8-dissociated protein 1 (746-761)
VVGQFIQDVKNSRSTD

SEQ ID NO: 7708 - protein, 17 aa, Artificial Sequence
  Cullin-associated NEDD8-dissociated protein 1 (746-762)
VVGQFIQDVKNSRSTDS

SEQ ID NO: 7709 - protein, 13 aa, Artificial Sequence
  Cystatin-C (75-87)
VVRARKQIVAGVN

SEQ ID NO: 7710 - protein, 14 aa, Artificial Sequence
  Cystatin-C (75-88)
VVRARKQIVAGVNY

SEQ ID NO: 7711 - protein, 10 aa, Artificial Sequence
  Negative elongation factor E (371-380)
VYKENLVDGF

SEQ ID NO: 7712 - protein, 10 aa, Artificial Sequence
  Lysine-specific demethylase 2B (316-325)
VYTPVDSLVF

SEQ ID NO: 7713 - protein, 13 aa, Artificial Sequence
  Ceruloplasmin (105-117)
VYVHLKNLASRPY

SEQ ID NO: 7714 - protein, 14 aa, Artificial Sequence
  Ceruloplasmin (105-118)
VYVHLKNLASRPYT

SEQ ID NO: 7715 - protein, 16 aa, Artificial Sequence
  Ceruloplasmin (105-120)
VYVHLKNLASRPYTFH

SEQ ID NO: 7716 - protein, 14 aa, Artificial Sequence
  Glycosyltransferase 8 domain-containing protein 1 (346-359)
WEKWYIPDPTGKFN

SEQ ID NO: 7717 - protein, 12 aa, Artificial Sequence
  Fibromodulin (133-144)
WIALHGNQITSD

SEQ ID NO: 7718 - protein, 13 aa, Artificial Sequence
  Fibromodulin (133-145)
WIALHGNQITSDK

SEQ ID NO: 7719 - protein, 12 aa, Artificial Sequence
  Glutathione peroxidase 1 (104-115)
WNFEKFLVGPDG

SEQ ID NO: 7720 - protein, 14 aa, Artificial Sequence
  Platelet endothelial cell adhesion molecule (415-428)
YDAQFEVIKGQTIE

SEQ ID NO: 7721 - protein, 12 aa, Artificial Sequence
  Vitamin D-binding protein (84-95)
YDTRTSALSAKS

SEQ ID NO: 7722 - protein, 19 aa, Artificial Sequence
  Heterogeneous nuclear ribonucleoprotein A3 (171-189)
YGGGYGSGGGSGGYGSRRF

SEQ ID NO: 7723 - protein, 14 aa, Artificial Sequence
  Interleukin-4 receptor subunit alpha (302-315)
YKAFSSLLASSAVS

SEQ ID NO: 7724 - protein, 15 aa, Artificial Sequence
  Interleukin-4 receptor subunit alpha (302-316)
YKAFSSLLASSAVSP

SEQ ID NO: 7725 - protein, 16 aa, Artificial Sequence
  Interleukin-4 receptor subunit alpha (302-317)
YKAFSSLLASSAVSPE

SEQ ID NO: 7726 - protein, 12 aa, Artificial Sequence
  Glycosyltransferase 8 domain-containing protein 1 (123-134)
YKIVNFDPKLLE

SEQ ID NO: 7727 - protein, 13 aa, Artificial Sequence
  Glycosyltransferase 8 domain-containing protein 1 (123-135)
YKIVNFDPKLLEG

SEQ ID NO: 7728 - protein, 15 aa, Artificial Sequence
  Glycosyltransferase 8 domain-containing protein 1 (123-137)
YKIVNFDPKLLEGKV

SEQ ID NO: 7729 - protein, 13 aa, Artificial Sequence
  Ragulator complex protein LAMTOR3 (68-80)
YNTYQVVQFNRLP

SEQ ID NO: 7730 - protein, 14 aa, Artificial Sequence
  Ragulator complex protein LAMTOR3 (68-81)
YNTYQVVQFNRLPL

SEQ ID NO: 7731 - protein, 15 aa, Artificial Sequence
  Ragulator complex protein LAMTOR3 (68-82)
YNTYQVVQFNRLPLV

SEQ ID NO: 7732 - protein, 16 aa, Artificial Sequence
  Ragulator complex protein LAMTOR3 (68-83)
YNTYQVVQFNRLPLVV

SEQ ID NO: 7733 - protein, 9 aa, Artificial Sequence
  Zinc finger protein 638 (459-467)
YPNKGVGQA

SEQ ID NO: 7734 - protein, 19 aa, Artificial Sequence
  Fas apoptotic inhibitory molecule 3 (81-99)
YPRKNLFLVEVTQLTESDS

SEQ ID NO: 7735 - protein, 20 aa, Artificial Sequence
  Fas apoptotic inhibitory molecule 3 (81-100)
YPRKNLFLVEVTQLTESDSG

SEQ ID NO: 7736 - protein, 9 aa, Artificial Sequence
  Beta-1,4-galactosyltransferase 1 (117-125)
YQVLDVQRY

SEQ ID NO: 7737 - protein, 14 aa, Artificial Sequence
  Serine incorporator 3 (350-363)
YSSIRTSTNSQVDK

SEQ ID NO: 7738 - protein, 9 aa, Artificial Sequence
  E3 ubiquitin-protein ligase Mdm2 (48-56)
YTMKEVLFY

SEQ ID NO: 7739 - protein, 12 aa, Artificial Sequence
  Ceruloplasmin (106-117)
YVHLKNLASRPY

SEQ ID NO: 7740 - protein, 13 aa, Artificial Sequence
  Ceruloplasmin (106-118)
YVHLKNLASRPYT

SEQ ID NO: 7741 - protein, 15 aa, Artificial Sequence
  Ceruloplasmin (106-120)
YVHLKNLASRPYTFH

SEQ ID NO: 7742 - protein, 8 aa, Artificial Sequence
  HLA class II histocompatibility antigen, DM alpha chain (116-123)
YWVPRNAL

SEQ ID NO: 7743 - protein, 14 aa, Artificial Sequence
  Ragulator complex protein LAMTOR3 (67-80)
YYNTYQVVQFNRLP

SEQ ID NO: 7744 - protein, 15 aa, Artificial Sequence
  Ragulator complex protein LAMTOR3 (67-81)
YYNTYQVVQFNRLPL

SEQ ID NO: 7745 - protein, 16 aa, Artificial Sequence
  Ragulator complex protein LAMTOR3 (67-82)
YYNTYQVVQFNRLPLV

SEQ ID NO: 7746 - protein, 10 aa, Artificial Sequence
  Melanoma-associated antigen C2 (191-200)
LLFGLALIEV

SEQ ID NO: 7747 - protein, 14 aa, Artificial Sequence
  C-C motif chemokine 3 (59-72)
KPGVIFLTKRSRQV

SEQ ID NO: 7748 - protein, 5 aa, Artificial Sequence
  Ig gamma-1 chain C region (91-95)
SAVYY

SEQ ID NO: 7749 - protein, 9 aa, Artificial Sequence
  Serum albumin (444-452)
TPTLVEVSR

SEQ ID NO: 7750 - protein, 12 aa, Artificial Sequence
  DNA topoisomerase 2-alpha (978-989)
AEAERVGLHKVF

SEQ ID NO: 7751 - protein, 12 aa, Artificial Sequence
  Basement membrane-specific heparan sulfate proteoglycan core protein (1484-1495)
ALADLDELLIRA

SEQ ID NO: 7752 - protein, 12 aa, Artificial Sequence
  Protein phosphatase 1M (122-133)
ALFDGHGGPAAA

SEQ ID NO: 7753 - protein, 13 aa, Artificial Sequence
  Sequestosome-1 (53-65)
ALFPALRPGGFQA

SEQ ID NO: 7754 - protein, 12 aa, Artificial Sequence
  UPF0585 protein C16orf13 (153-164)
ALLEDLGKASGL

SEQ ID NO: 7755 - protein, 13 aa, Artificial Sequence
  Signal transducer and activator of transcription 1-alpha/beta (589-601)
ALLKDQQPGTFLL

SEQ ID NO: 7756 - protein, 17 aa, Artificial Sequence
  Glyceraldehyde-3-phosphate dehydrogenase (202-218)
ALQNIIPASTGAAKAVG

SEQ ID NO: 7757 - protein, 12 aa, Artificial Sequence
  Guanine nucleotide-binding protein G(I)/G(S)/G(T) subunit beta-1 (74-85)
ALWDIETGQQTT

SEQ ID NO: 7758 - protein, 12 aa, Artificial Sequence
  26S protease regulatory subunit 7 (76-87)
ALWDLAADKQTL

SEQ ID NO: 7759 - protein, 12 aa, Artificial Sequence
  Peroxisomal multifunctional enzyme type 2 (193-204)
APNAGSRMTQTV

SEQ ID NO: 7760 - protein, 13 aa, Artificial Sequence
  60S ribosomal protein L13 (47-59)
APRPASGPIRPIV

SEQ ID NO: 7761 - protein, 13 aa, Artificial Sequence
  HLA class I histocompatibility antigen, A-23 alpha chain (5-17)
APRTLVLLLSGAL

SEQ ID NO: 7762 - protein, 16 aa, Artificial Sequence
  HLA class II histocompatibility antigen, DR alpha chain (51-66)
AQGALANIAVDKANLE

SEQ ID NO: 7763 - protein, 12 aa, Artificial Sequence
  Actin, cytoplasmic 2 (19-30)
ATAASSSSLEKS

SEQ ID NO: 7764 - protein, 16 aa, Artificial Sequence
  Annexin A2 (52-67)
DEVTIVNILTNRSNAQ

SEQ ID NO: 7765 - protein, 13 aa, Artificial Sequence
  Interferon-induced transmembrane protein 1 (71-83)
DVTGAQAYASTAK

SEQ ID NO: 7766 - protein, 13 aa, Artificial Sequence
  HLA class II histocompatibility antigen, DR alpha chain (50-62)
EAQGALANIAVDK

SEQ ID NO: 7767 - protein, 17 aa, Artificial Sequence
  HLA class I histocompatibility antigen, Cw-7 alpha chain (152-168)
EDLRSWTAADTAAQITQ

SEQ ID NO: 7768 - protein, 16 aa, Artificial Sequence
  Myosin-9 (1232-1247)
EEVDGKADGAEAKPAE

SEQ ID NO: 7769 - protein, 17 aa, Artificial Sequence
  Heat shock cognate 71 kDa protein (444-460)
EGERAMTKDNNLLGKFE

SEQ ID NO: 7770 - protein, 16 aa, Artificial Sequence
  Actin, cytoplasmic 2 (15-30)
EQEMATAASSSSLEKS

SEQ ID NO: 7771 - protein, 12 aa, Artificial Sequence
  Zinc finger protein ZPR1 (349-360)
FIMDDPAGNSYL

SEQ ID NO: 7772 - protein, 12 aa, Artificial Sequence
  Sorting nexin-14 (234-245)
FLADPDTVNHLL

SEQ ID NO: 7773 - protein, 12 aa, Artificial Sequence
  Cytochrome c oxidase assembly factor 3 homolog, mitochondrial (84-95)
FLDELEDEAKAA

SEQ ID NO: 7774 - protein, 12 aa, Artificial Sequence
  Heterogeneous nuclear ribonucleoprotein U (198-209)
FLWAGGRASYGV

SEQ ID NO: 7775 - protein, 12 aa, Artificial Sequence
  Arf-GAP with Rho-GAP domain, ANK repeat and PH domain-containing protein 1 (1183-1194)
FTADPLSLLRNV

SEQ ID NO: 7776 - protein, 12 aa, Artificial Sequence
  Nucleolin (630-641)
GEIDGNKVTLDW

SEQ ID NO: 7777 - protein, 16 aa, Artificial Sequence
  Heat shock cognate 71 kDa protein (445-460)
GERAMTKDNNLLGKFE

SEQ ID NO: 7778 - protein, 17 aa, Artificial Sequence
  Keratin, type I cytoskeletal 9 (15-31)
GGGGGGGLGSGGSIRSS

SEQ ID NO: 7779 - protein, 12 aa, Artificial Sequence
  Putative RNA-binding protein 15 (1399-1410)
GLAPAEVVVATV

SEQ ID NO: 7780 - protein, 12 aa, Artificial Sequence
  ERI1 exoribonuclease 3 (154-165)
GLLDPNVKSIFV

SEQ ID NO: 7781 - protein, 13 aa, Artificial Sequence
  Anion exchange protein 2 (714-726)
GLLGEKTQDLIGV

SEQ ID NO: 7782 - protein, 16 aa, Artificial Sequence
  Phosphoglycerate kinase 1 (338-353)
GPVGVFEWEAFARGTK

SEQ ID NO: 7783 - protein, 17 aa, Artificial Sequence
  Phosphoglycerate kinase 1 (338-354)
GPVGVFEWEAFARGTKA

SEQ ID NO: 7784 - protein, 15 aa, Artificial Sequence
  Calmodulin (135-149)
GQVNYEEFVQMMTAK

SEQ ID NO: 7785 - protein, 19 aa, Artificial Sequence
  Keratin, type II cytoskeletal 1 (560-578)
GSGGGSYGSGGGGGGHGSY

SEQ ID NO: 7786 - protein, 16 aa, Artificial Sequence
  HLA class I histocompatibility antigen, B-39 alpha chain (25-40)
GSHSMRYFYTSVSRPG

SEQ ID NO: 7787 - protein, 13 aa, Artificial Sequence
  Tumor susceptibility gene 101 protein (219-231)
GTISEDTIRASLI

SEQ ID NO: 7788 - protein, 12 aa, Artificial Sequence
  A-kinase anchor protein 1, mitochondrial (608-619)
IIWEIEVPKHLV

SEQ ID NO: 7789 - protein, 12 aa, Artificial Sequence
  Cirhin (454-465)
ILFSEDSTKLFV

SEQ ID NO: 7790 - protein, 12 aa, Artificial Sequence
  4-hydroxyphenylpyruvate dioxygenase-like protein (312-323)
ILLDGDKGKFLL

SEQ ID NO: 7791 - protein, 13 aa, Artificial Sequence
  Nucleosome-remodeling factor subunit BPTF (1571-1583)
KIIPENDIKSLTV

SEQ ID NO: 7792 - protein, 13 aa, Artificial Sequence
  Centrin-3 (108-120)
KLFDDDDSGKISL

SEQ ID NO: 7793 - protein, 12 aa, Artificial Sequence
  Uridine-cytidine kinase 2 (2-13)
KLFVDTDADTRL

SEQ ID NO: 7794 - protein, 12 aa, Artificial Sequence
  Retinoic acid receptor RXR-gamma (441-452)
KLIGDTPIDTFL

SEQ ID NO: 7795 - protein, 13 aa, Artificial Sequence
  40S ribosomal protein S17 (107-119)
KLLDFGSLSNLQV

SEQ ID NO: 7796 - protein, 12 aa, Artificial Sequence
  Golgin subfamily A member 4 (849-860)
KLLDLETERILL

SEQ ID NO: 7797 - protein, 12 aa, Artificial Sequence
  Utrophin (226-237)
KLLDPEDVAVQL

SEQ ID NO: 7798 - protein, 12 aa, Artificial Sequence
  Prelamin-A/C (297-308)
KLLEGEEERLRL

SEQ ID NO: 7799 - protein, 12 aa, Artificial Sequence
  Vimentin (236-247)
KLLEGEESRISL

SEQ ID NO: 7800 - protein, 14 aa, Artificial Sequence
  V-type proton ATPase subunit H (396-409)
KLLEVSDDPQVLAV

SEQ ID NO: 7801 - protein, 13 aa, Artificial Sequence
  Methionine aminopeptidase 1 (15-27)
KLLSSEDIEGMRL

SEQ ID NO: 7802 - protein, 12 aa, Artificial Sequence
  Isovaleryl-CoA dehydrogenase, mitochondrial (398-409)
KLYEIGAGTSEV

SEQ ID NO: 7803 - protein, 12 aa, Artificial Sequence
  Eukaryotic translation initiation factor 3 subunit C-like protein (765-776)
KVWDLFPEADKV

SEQ ID NO: 7804 - protein, 15 aa, Artificial Sequence
  HLA class I histocompatibility antigen, Cw-7 alpha chain (154-168)
LRSWTAADTAAQITQ

SEQ ID NO: 7805 - protein, 14 aa, Artificial Sequence
  Mitochondrial import receptor subunit TOM5 homolog (38-51)
LRVTPFILKKLDSI

SEQ ID NO: 7806 - protein, 13 aa, Artificial Sequence
  Beta-2-microglobulin (89-101)
LSQPKIVKWDRDM

SEQ ID NO: 7807 - protein, 13 aa, Artificial Sequence
  Actin, cytoplasmic 2 (18-30)
MATAASSSSLEKS

SEQ ID NO: 7808 - protein, 19 aa, Artificial Sequence
  HLA class I histocompatibility antigen, Cw-7 alpha chain (151-169)
NEDLRSWTAADTAAQITQR

SEQ ID NO: 7809 - protein, 12 aa, Artificial Sequence
  Alkyldihydroxyacetonephosphate synthase, peroxisomal (324-335)
NIYGNIEDLVVH

SEQ ID NO: 7810 - protein, 12 aa, Artificial Sequence
  Poly(U)-binding-splicing factor PUF60 (270-281)
NLFDLGGQYLRV

SEQ ID NO: 7811 - protein, 12 aa, Artificial Sequence
  Inosine-5'-monophosphate dehydrogenase 2 (312-323)
NLIDAGVDALRV

SEQ ID NO: 7812 - protein, 12 aa, Artificial Sequence
  Cyclin-dependent kinase 1 (133-144)
NLLIDDKGTIKL

SEQ ID NO: 7813 - protein, 14 aa, Artificial Sequence
  Protein ERGIC-53 (162-175)
NPAIVIIGNNGQIH

SEQ ID NO: 7814 - protein, 17 aa, Artificial Sequence
  Heat shock 70 kDa protein 1-like (170-186)
NVLRIINEPTAAAIAYG

SEQ ID NO: 7815 - protein, 17 aa, Artificial Sequence
  Hsp90 co-chaperone Cdc37 (362-378)
PLLEAVPKTGDEKDVSV

SEQ ID NO: 7816 - protein, 12 aa, Artificial Sequence
  Nucleolar RNA helicase 2 (109-120)
QEIPVEQKEGAF

SEQ ID NO: 7817 - protein, 12 aa, Artificial Sequence
  Signal recognition particle 54 kDa protein (385-396)
QELDSTDGAKVF

SEQ ID NO: 7818 - protein, 16 aa, Artificial Sequence
  Septin-2 (381-396)
QMQGGDGDGGALGHHV

SEQ ID NO: 7819 - protein, 12 aa, Artificial Sequence
  Polyadenylate-binding protein 4 (179-190)
REAELGAKAKEF

SEQ ID NO: 7820 - protein, 12 aa, Artificial Sequence
  Polyadenylate-binding protein 3 (179-190)
REAELGARAKEF

SEQ ID NO: 7821 - protein, 12 aa, Artificial Sequence
  Bromodomain adjacent to zinc finger domain protein 2B (1684-1695)
RIIDPEDLKALL

SEQ ID NO: 7822 - protein, 12 aa, Artificial Sequence
  Nucleolar complex protein 2 homolog (10-21)
RLAELTVDEFLA

SEQ ID NO: 7823 - protein, 12 aa, Artificial Sequence
  Protein unc-45 homolog A (202-213)
RLLDMGETDLML

SEQ ID NO: 7824 - protein, 12 aa, Artificial Sequence
  Iron-sulfur cluster assembly 2 homolog, mitochondrial (59-70)
RLLEITEGSEFL

SEQ ID NO: 7825 - protein, 12 aa, Artificial Sequence
  Cytoskeleton-associated protein 5 (1718-1729)
RLLPDTINSINL

SEQ ID NO: 7826 - protein, 13 aa, Artificial Sequence
  ATP-dependent RNA helicase DHX36 (643-655)
RLMDPPSNEAVLL

SEQ ID NO: 7827 - protein, 12 aa, Artificial Sequence
  Multidrug resistance protein 1 (378-389)
RLYDPTEGMVSV

SEQ ID NO: 7828 - protein, 14 aa, Artificial Sequence
  WD repeat-containing protein 11 (918-931)
RLYGDESELHFWTV

SEQ ID NO: 7829 - protein, 12 aa, Artificial Sequence
  Transmembrane emp24 domain-containing protein 9 (11-22)
RPRPGTGLGRVM

SEQ ID NO: 7830 - protein, 12 aa, Artificial Sequence
  Serine-rich coiled-coil domain-containing protein 2 (24-35)
RPYAAGGKKLAL

SEQ ID NO: 7831 - protein, 12 aa, Artificial Sequence
  Anaphase-promoting complex subunit 2 (163-174)
RVLDPSMVILEV

SEQ ID NO: 7832 - protein, 14 aa, Artificial Sequence
  HLA class I histocompatibility antigen, A-23 alpha chain (352-365)
SAQGSDVSLTACKV

SEQ ID NO: 7833 - protein, 12 aa, Artificial Sequence
  Protein KRI1 homolog (456-467)
SEQEELRDKRAY

SEQ ID NO: 7834 - protein, 16 aa, Artificial Sequence
  Keratin, type I cytoskeletal 9 (13-28)
SGGGGGGGLGSGGSIR

SEQ ID NO: 7835 - protein, 12 aa, Artificial Sequence
  Stress-70 protein, mitochondrial (253-264)
SILEIQKGVFEV

SEQ ID NO: 7836 - protein, 12 aa, Artificial Sequence
  Centrosomal protein of 192 kDa (19-30)
SLFGNSGILENV

SEQ ID NO: 7837 - protein, 12 aa, Artificial Sequence
  DNA-dependent protein kinase catalytic subunit (3305-3316)
SLLDENNVSSYL

SEQ ID NO: 7838 - protein, 12 aa, Artificial Sequence
  Zinc finger protein 829 (85-96)
SLLEQGKEPWMV

SEQ ID NO: 7839 - protein, 14 aa, Artificial Sequence
  Renin receptor (241-254)
SLYGGNAVVELVTV

SEQ ID NO: 7840 - protein, 13 aa, Artificial Sequence
  Protein kinase C-binding protein 1 (470-482)
SPASTKTGQAGSL

SEQ ID NO: 7841 - protein, 14 aa, Artificial Sequence
  AT-rich interactive domain-containing protein 1A (233-246)
SPRGGTPGSGAAAA

SEQ ID NO: 7842 - protein, 12 aa, Artificial Sequence
  E3 ubiquitin-protein ligase TRIP12 (1954-1965)
SPRLPVGGFRSL

SEQ ID NO: 7843 - protein, 12 aa, Artificial Sequence
  Msx2-interacting protein (1024-1035)
SPRPSGPGPSSF

SEQ ID NO: 7844 - protein, 12 aa, Artificial Sequence
  Long-chain-fatty-acid-CoA ligase 1 (687-698)
SQIDDLYSTIKV

SEQ ID NO: 7845 - protein, 18 aa, Artificial Sequence
  Keratin, type I cytoskeletal 9 (12-29)
SRSGGGGGGGLGSGGSIR

SEQ ID NO: 7846 - protein, 20 aa, Artificial Sequence
  Keratin, type I cytoskeletal 9 (12-31)
SRSGGGGGGGLGSGGSIRSS

SEQ ID NO: 7847 - protein, 21 aa, Artificial Sequence
  Keratin, type I cytoskeletal 9 (12-32)
SRSGGGGGGGLGSGGSIRSSY

SEQ ID NO: 7848 - protein, 20 aa, Artificial Sequence
  Cytochrome c oxidase subunit 6A1, mitochondrial (2-21)
SSGAHGEEGSARMWKTLTFF

SEQ ID NO: 7849 - protein, 14 aa, Artificial Sequence
  Glyceraldehyde-3-phosphate dehydrogenase (2-15)
STFDAGAGIALNDH

SEQ ID NO: 7850 - protein, 12 aa, Artificial Sequence
  HLA class I histocompatibility antigen, B-15 alpha chain (158-169)
TAADTAAQITQR

SEQ ID NO: 7851 - protein, 12 aa, Artificial Sequence
  Intercellular adhesion molecule 3 (536-547)
TEAMGEEPSRAE

SEQ ID NO: 7852 - protein, 12 aa, Artificial Sequence
  Ragulator complex protein LAMTOR5 (36-47)
TLSDEHAGVISV

SEQ ID NO: 7853 - protein, 12 aa, Artificial Sequence
  Treacle protein (102-113)
TPRLASTNSSVL

SEQ ID NO: 7854 - protein, 12 aa, Artificial Sequence
  Neuropilin-2 (234-245)
TPSELRSSTGIL

SEQ ID NO: 7855 - protein, 22 aa, Artificial Sequence
  Cytochrome c oxidase subunit 7A2, mitochondrial (62-83)
TVGGTAYAIYELAVASFPKKQE

SEQ ID NO: 7856 - protein, 17 aa, Artificial Sequence
  HLA class I histocompatibility antigen, Cw-5 alpha chain (52-68)
VDDTQFVQFDSDAASPR

SEQ ID NO: 7857 - protein, 17 aa, Artificial Sequence
  HLA class I histocompatibility antigen, alpha chain E (49-65)
VDDTQFVRFDNDAASPR

SEQ ID NO: 7858 - protein, 19 aa, Artificial Sequence
  HLA class I histocompatibility antigen, B-55 alpha chain (52-70)
VDDTQFVRFDSDAASPREE

SEQ ID NO: 7859 - protein, 20 aa, Artificial Sequence
  HLA class I histocompatibility antigen, B-55 alpha chain (52-71)
VDDTQFVRFDSDAASPREEP

SEQ ID NO: 7860 - protein, 13 aa, Artificial Sequence
  butyrophilin subfamily 3 member A3 secreted isoform (174-186)
VILDPDTANAILL

SEQ ID NO: 7861 - protein, 13 aa, Artificial Sequence
  Dihydropyrimidinase-related protein 2 (374-386)
VIWDPDSVKTISA

SEQ ID NO: 7862 - protein, 12 aa, Artificial Sequence
  Exocyst complex component 4 (203-214)
VLAEINKEIEGV

SEQ ID NO: 7863 - protein, 12 aa, Artificial Sequence
  Deoxyuridine 5'-triphosphate nucleotidohydrolase, mitochondrial (112-123)
VLFNFGKEKFEV

SEQ ID NO: 7864 - protein, 14 aa, Artificial Sequence
  Translocon-associated protein subunit alpha (19-32)
VLFRGGPRGLLAVA

SEQ ID NO: 7865 - protein, 16 aa, Artificial Sequence
  Heat shock 70 kDa protein 1-like (171-186)
VLRIINEPTAAAIAYG

SEQ ID NO: 7866 - protein, 13 aa, Artificial Sequence
  G2/mitotic-specific cyclin-B1 (388-400)
VMVNQGLTKHMTV

SEQ ID NO: 7867 - protein, 13 aa, Artificial Sequence
  Endoplasmic reticulum resident protein 29 (5-17)
VPRAAFLSPLLPL

SEQ ID NO: 7868 - protein, 12 aa, Artificial Sequence
  Lysosomal alpha-glucosidase (38-49)
VPRELSGSSPVL

SEQ ID NO: 7869 - protein, 14 aa, Artificial Sequence
  HLA class I histocompatibility antigen, B-15 alpha chain (241-254)
WQRDGEDQTQDTEL

SEQ ID NO: 7870 - protein, 13 aa, Artificial Sequence
  V-type proton ATPase subunit S1 (77-89)
YLDPALELGPRNV

SEQ ID NO: 7871 - protein, 12 aa, Artificial Sequence
  Armadillo repeat-containing protein 8 (306-317)
YLIEPDVELQRI

SEQ ID NO: 7872 - protein, 12 aa, Artificial Sequence
  F-actin-capping protein subunit beta (120-131)
YLWDLDHGFAGV

SEQ ID NO: 7873 - protein, 12 aa, Artificial Sequence
  40S ribosomal protein S8 (188-199)
YVLEGKELEFYL

SEQ ID NO: 7874 - protein, 15 aa, Artificial Sequence
  DnaJ homolog subfamily C member 3 (3-17)
APGSVTSRLGSVFPF

SEQ ID NO: 7875 - protein, 9 aa, Artificial Sequence
  Pre-rRNA-processing protein TSR1 homolog (480-488)
ARIFQFQNF

SEQ ID NO: 7876 - protein, 9 aa, Artificial Sequence
  Protein FAM98B (250-258)
ARIYQPKRY

SEQ ID NO: 7877 - protein, 9 aa, Artificial Sequence
  Acyl-CoA desaturase (130-138)
ARLPLRLFL

SEQ ID NO: 7878 - protein, 9 aa, Artificial Sequence
  Serine/arginine-rich splicing factor 3 (42-50)
ARNPPGFAF

SEQ ID NO: 7879 - protein, 11 aa, Artificial Sequence
  ATP synthase F(0) complex subunit C1, mitochondrial (62-72)
ARNPSLKQQLF

SEQ ID NO: 7880 - protein, 9 aa, Artificial Sequence
  40S ribosomal protein S28 (12-20)
ARVTKVLGR

SEQ ID NO: 7881 - protein, 9 aa, Artificial Sequence
  Rab GDP dissociation inhibitor alpha (217-225)
ARYGKSPYL

SEQ ID NO: 7882 - protein, 9 aa, Artificial Sequence
  Vacuolar fusion protein CCZ1 homolog (167-175)
ERLEKFFHR

SEQ ID NO: 7883 - protein, 9 aa, Artificial Sequence
  Mitochondrial import receptor subunit TOM5 homolog (2-10)
FRIEGLAPK

SEQ ID NO: 7884 - protein, 11 aa, Artificial Sequence
  Lysosome-associated membraneoprotein 2 (4-14)
FRLFPVPGSGL

SEQ ID NO: 7885 - protein, 10 aa, Artificial Sequence
  60S ribosomal protein L28 (38-47)
FRYNGLIHRK

SEQ ID NO: 7886 - protein, 10 aa, Artificial Sequence
  Menin (410-419)
GRFEGQVRQK

SEQ ID NO: 7887 - protein, 12 aa, Artificial Sequence
  Myelin basic protein (43-54)
GRFFGGDRGAPK

SEQ ID NO: 7888 - protein, 9 aa, Artificial Sequence
  Rho guanine nucleotide exchange factor 2 (459-467)
GRFKDVLVL

SEQ ID NO: 7889 - protein, 9 aa, Artificial Sequence
  Protein OS-9 (125-133)
GRHIQQYHM

SEQ ID NO: 7890 - protein, 9 aa, Artificial Sequence
  26S protease regulatory subunit 4 (345-353)
GRIDRKIEF

SEQ ID NO: 7891 - protein, 9 aa, Artificial Sequence
  Uncharacterized protein C1orf131 (262-270)
GRIGQVGKF

SEQ ID NO: 7892 - protein, 9 aa, Artificial Sequence
  Glyceraldehyde-3-phosphate dehydrogenase (12-20)
GRIGRLVTR

SEQ ID NO: 7893 - protein, 9 aa, Artificial Sequence
  Induced myeloid leukemia cell differentiation protein Mcl-1 (109-117)
GRIVTLISF

SEQ ID NO: 7894 - protein, 11 aa, Artificial Sequence
  60S ribosomal protein L13a (139-149)
GRLAHEVGWKY

SEQ ID NO: 7895 - protein, 9 aa, Artificial Sequence
  Protein MON2 homolog (593-601)
GRLGLVTSR

SEQ ID NO: 7896 - protein, 9 aa, Artificial Sequence
  Protein transport protein Sec23B (152-160)
GRMVQVHEL

SEQ ID NO: 7897 - protein, 9 aa, Artificial Sequence
  Major facilitator superfamily domain-containing protein 10 (356-364)
GRSLPVLGL

SEQ ID NO: 7898 - protein, 9 aa, Artificial Sequence
  Unconventional myosin-Ic (676-684)
GRTKIFIRF

SEQ ID NO: 7899 - protein, 9 aa, Artificial Sequence
  Protein CNPPD1 (197-205)
GRWRGWYTY

SEQ ID NO: 7900 - protein, 9 aa, Artificial Sequence
  E3 ubiquitin-protein ligase MYCBP2 (3264-3272)
GRYAGGQGY

SEQ ID NO: 7901 - protein, 9 aa, Artificial Sequence
  NEDD4 family-interacting protein 1 (145-153)
GRYGAISGF

SEQ ID NO: 7902 - protein, 11 aa, Artificial Sequence
  NEDD4 family-interacting protein 1 (145-155)
GRYGAISGFGL

SEQ ID NO: 7903 - protein, 9 aa, Artificial Sequence
  Inositol hexakisphosphate kinase 2 (296-304)
GRYLRRELL

SEQ ID NO: 7904 - protein, 9 aa, Artificial Sequence
  Translocon-associated protein subunit delta (84-92)
GRYQVSWSL

SEQ ID NO: 7905 - protein, 9 aa, Artificial Sequence
  Cleavage and polyadenylation specificity factor subunit 5 (89-97)
HRLPHVLLL

SEQ ID NO: 7906 - protein, 9 aa, Artificial Sequence
  Zinc finger protein 281 (55-63)
HRLPPVTSF

SEQ ID NO: 7907 - protein, 10 aa, Artificial Sequence
  Calpain-1 catalytic subunit (132-141)
HRVVPHGQSF

SEQ ID NO: 7908 - protein, 10 aa, Artificial Sequence
  X-ray repair cross-complementing protein 6 (338-347)
KRFDDPGLML

SEQ ID NO: 7909 - protein, 10 aa, Artificial Sequence
  Copine-1 (190-199)
KRFSVPVQHF

SEQ ID NO: 7910 - protein, 9 aa, Artificial Sequence
  Ornithine decarboxylase antizyme 1 (58-66)
KRINWRTVL

SEQ ID NO: 7911 - protein, 9 aa, Artificial Sequence
  Bax inhibitor 1 (129-137)
KRLGLLAGF

SEQ ID NO: 7912 - protein, 9 aa, Artificial Sequence
  Pre-rRNA-processing protein TSR1 homolog (726-734)
KRVFPKWTY

SEQ ID NO: 7913 - protein, 10 aa, Artificial Sequence
  Pre-mRNA-processing-splicing factor 8 (85-94)
KRVYLGALKY

SEQ ID NO: 7914 - protein, 10 aa, Artificial Sequence
  ER degradation-enhancing alpha-mannosidase-like protein 1 (467-476)
KRYGALPERY

SEQ ID NO: 7915 - protein, 9 aa, Artificial Sequence
  Mitochondrial import receptor subunit TOM5 homolog (38-46)
LRVTPFILK

SEQ ID NO: 7916 - protein, 9 aa, Artificial Sequence
  Interferon alpha-inducible protein 6 (1-9)
MRQKAVSLF

SEQ ID NO: 7917 - protein, 10 aa, Artificial Sequence
  Interferon alpha-inducible protein 6 (1-10)
MRQKAVSLFL

SEQ ID NO: 7918 - protein, 9 aa, Artificial Sequence
  Double-strand-break repair protein rad21 homolog (383-391)
NRLLKLFTR

SEQ ID NO: 7919 - protein, 9 aa, Artificial Sequence
  ER degradation-enhancing alpha-mannosidase-like protein 1 (35-43)
QRFPLSFGF

SEQ ID NO: 7920 - protein, 9 aa, Artificial Sequence
  B-cell receptor-associated protein 31 (100-108)
QRNLYIAGF

SEQ ID NO: 7921 - protein, 11 aa, Artificial Sequence
  Chondroitin sulfate glucuronyltransferase (434-444)
RRFDPARGMEY

SEQ ID NO: 7922 - protein, 9 aa, Artificial Sequence
  Nuclear envelope integral membrane protein 1 (157-165)
RRFDPKLFL

SEQ ID NO: 7923 - protein, 9 aa, Artificial Sequence
  ER membrane protein complex subunit 4 (13-21)
RRFKWAIEL

SEQ ID NO: 7924 - protein, 9 aa, Artificial Sequence
  Ras GTPase-activating protein-binding protein 1 (106-114)
RRFMQTFVL

SEQ ID NO: 7925 - protein, 9 aa, Artificial Sequence
  Cullin-7 (439-447)
RRFRPRSEF

SEQ ID NO: 7926 - protein, 9 aa, Artificial Sequence
  Ubiquitin carboxyl-terminal hydrolase 22 (367-375)
RRFTRPEHL

SEQ ID NO: 7927 - protein, 9 aa, Artificial Sequence
  Cytochrome c oxidase subunit 7C, mitochondrial (7-15)
RRFTTSVVR

SEQ ID NO: 7928 - protein, 11 aa, Artificial Sequence
  40S ribosomal protein S30 (114-124)
RRFVNVVPTFG

SEQ ID NO: 7929 - protein, 9 aa, Artificial Sequence
  Acyl-CoA desaturase (174-182)
RRGFFFSHV

SEQ ID NO: 7930 - protein, 9 aa, Artificial Sequence
  Store-operated calcium entry-associated regulatory factor (56-64)
RRLDPIPQL

SEQ ID NO: 7931 - protein, 10 aa, Artificial Sequence
  Melanoma-associated antigen F1 (195-204)
RRLGVQPSKY

SEQ ID NO: 7932 - protein, 9 aa, Artificial Sequence
  Transformation/transcription domain-associated protein (2920-2928)
RRLPHVVSH

SEQ ID NO: 7933 - protein, 9 aa, Artificial Sequence
  Heat shock protein HSP 90-beta (375-383)
RRLSELLRY

SEQ ID NO: 7934 - protein, 9 aa, Artificial Sequence
  DNA-directed RNA polymerase II subunit RPB1 (1052-1060)
RRMAEEFRL

SEQ ID NO: 7935 - protein, 10 aa, Artificial Sequence
  Signal-induced proliferation-associated 1-like protein 2 (954-963)
RRNGLGQLGF

SEQ ID NO: 7936 - protein, 9 aa, Artificial Sequence
  NADH dehydrogenase (ubiquinone) 1 subunit C2 (4-12)
RRNPEPLRF

SEQ ID NO: 7937 - protein, 10 aa, Artificial Sequence
  Elongation factor 2 (341-350)
RRWLPAGDAL

SEQ ID NO: 7938 - protein, 9 aa, Artificial Sequence
  Eukaryotic initiation factor 4A-I (168-176)
RRYLSPKYI

SEQ ID NO: 7939 - protein, 9 aa, Artificial Sequence
  60S ribosomal protein L17 (61-69)
RRYNGGVGR

SEQ ID NO: 7940 - protein, 10 aa, Artificial Sequence
  Eukaryotic translation initiation factor 3 subunit L (327-336)
RRYQDAIRVF

SEQ ID NO: 7941 - protein, 9 aa, Artificial Sequence
  Charged multivesicular body protein 2a (70-78)
RRYVRKFVL

SEQ ID NO: 7942 - protein, 9 aa, Artificial Sequence
  Histone H2A type 1-A (20-28)
SRAGLQFPV

SEQ ID NO: 7943 - protein, 9 aa, Artificial Sequence
  Pre-mRNA cleavage complex 2 protein Pcf11 (1103-1111)
SRFDIPLGL

SEQ ID NO: 7944 - protein, 9 aa, Artificial Sequence
  Pericentrin (1289-1297)
SRFEKEFSF

SEQ ID NO: 7945 - protein, 9 aa, Artificial Sequence
  Myosin-7 (242-250)
SRFGKFIRI

SEQ ID NO: 7946 - protein, 9 aa, Artificial Sequence
  Pre-mRNA-processing-splicing factor 8 (538-546)
SRFGNAFHL

SEQ ID NO: 7947 - protein, 11 aa, Artificial Sequence
  EH domain-containing protein 4 (129-139)
SRFGNAFLNRF

SEQ ID NO: 7948 - protein, 9 aa, Artificial Sequence
  DNA replication licensing factor MCM7 (227-235)
SRFIKFQEM

SEQ ID NO: 7949 - protein, 9 aa, Artificial Sequence
  ATP-dependent RNA helicase DDX3X (591-599)
SRFSGGFGA

SEQ ID NO: 7950 - protein, 10 aa, Artificial Sequence
  NADH dehydrogenase (ubiquinone) 1 beta subcomplex subunit 5, mitochondrial (60-69)
SRFYDRRFLK

SEQ ID NO: 7951 - protein, 9 aa, Artificial Sequence
  Hypoxia-inducible factor 1-alpha (268-276)
SRHSLDMKF

SEQ ID NO: 7952 - protein, 11 aa, Artificial Sequence
  Ubiquitin fusion degradation protein 1 homolog (57-67)
SRLNITYPMLF

SEQ ID NO: 7953 - protein, 9 aa, Artificial Sequence
  Protein diaphanous homolog 3 (854-862)
SRNAQTFGF

SEQ ID NO: 7954 - protein, 9 aa, Artificial Sequence
  Cytochrome b-c1 complex subunit 8 (9-17)
TRMRHVISY

SEQ ID NO: 7955 - protein, 9 aa, Artificial Sequence
  WD repeat-containing protein 36 (383-391)
VRLPPITKF

SEQ ID NO: 7956 - protein, 14 aa, Artificial Sequence
  POTE ankyrin domain family member F (791-804)
YNELRVAPEEHPVL

SEQ ID NO: 7957 - protein, 9 aa, Artificial Sequence
  Dystonin (7305-7313)
YRFFLGNQF

SEQ ID NO: 7958 - protein, 9 aa, Artificial Sequence
  BTB/POZ domain-containing protein KCTD20 (192-200)
GRSEVIYNY

SEQ ID NO: 7959 - protein, 9 aa, Artificial Sequence
  Filamin-B (2069-2077)
GRVKESITR

SEQ ID NO: 7960 - protein, 9 aa, Artificial Sequence
  Intron-binding protein aquarius (896-904)
GRVNYVLAR

SEQ ID NO: 7961 - protein, 11 aa, Artificial Sequence
  Integrin-linked protein kinase (149-159)
GRWQGNDIVVK

SEQ ID NO: 7962 - protein, 9 aa, Artificial Sequence
  Serine/threonine-protein kinase 38 (446-454)
KRFEGLTAR

SEQ ID NO: 7963 - protein, 9 aa, Artificial Sequence
  39S ribosomal protein L43, mitochondrial (27-35)
QRLSFSVSR

SEQ ID NO: 7964 - protein, 9 aa, Artificial Sequence
  Protein diaphanous homolog 1 (967-975)
SRNAGAFGF

SEQ ID NO: 7965 - protein, 10 aa, Artificial Sequence
  WD repeat-containing protein 1 (55-64)
VRFSPDGNRF

SEQ ID NO: 7966 - protein, 13 aa, Artificial Sequence
  Elongation factor 1-beta (213-225)
YVQSMDVAAFNKI

SEQ ID NO: 7967 - protein, 9 aa, Artificial Sequence
  T-complex protein 1 subunit zeta (2-10)
AAVKTLNPK

SEQ ID NO: 7968 - protein, 11 aa, Artificial Sequence
  40S ribosomal protein S21 (73-83)
AKADGIVSKNF

SEQ ID NO: 7969 - protein, 11 aa, Artificial Sequence
  Alpha-enolase (13-23)
DSRGNPTVEVD

SEQ ID NO: 7970 - protein, 9 aa, Artificial Sequence
  Triosephosphate isomerase (159-167)
FVDIINAKQ

SEQ ID NO: 7971 - protein, 9 aa, Artificial Sequence
  60S ribosomal protein L37 (76-84)
HGFREGTTP

SEQ ID NO: 7972 - protein, 9 aa, Artificial Sequence
  Store-operated calcium entry-associated regulatory factor (103-111)
IAYKFGKTV

SEQ ID NO: 7973 - protein, 9 aa, Artificial Sequence
  Ubiquitin-60S ribosomal protein L40 (48-56)
IIEPSLRQL

SEQ ID NO: 7974 - protein, 9 aa, Artificial Sequence
  Eukaryotic translation initiation factor 4 gamma 1 (1452-1460)
IIFETPLRV

SEQ ID NO: 7975 - protein, 9 aa, Artificial Sequence
  Vacuolar protein sorting-associated protein 4A (144-152)
ILPIKFPHL

SEQ ID NO: 7976 - protein, 10 aa, Artificial Sequence
  40S ribosomal protein S21 (74-83)
KADGIVSKNF

SEQ ID NO: 7977 - protein, 9 aa, Artificial Sequence
  COMM domain-containing protein 3 (187-195)
KSLERATQL

SEQ ID NO: 7978 - protein, 9 aa, Artificial Sequence
  POTE ankyrin domain family member E (805-813)
LTEAPLNPK

SEQ ID NO: 7979 - protein, 9 aa, Artificial Sequence
  DNA-dependent protein kinase catalytic subunit (1340-1348)
RIMEFTTTL

SEQ ID NO: 7980 - protein, 11 aa, Artificial Sequence
  TAR DNA-binding protein 43 (248-258)
SMDSKSSGWGM

SEQ ID NO: 7981 - protein, 11 aa, Artificial Sequence
  Vimentin (2-12)
STRSVSSSSYR

SEQ ID NO: 7982 - protein, 14 aa, Artificial Sequence
  Vimentin (446-459)
TVETRDGQVINETS

SEQ ID NO: 7983 - protein, 10 aa, Artificial Sequence
  60S ribosomal protein L31 (106-115)
VTYVPVTTFK

SEQ ID NO: 7984 - protein, 9 aa, Artificial Sequence
  Hemoglobin subunit delta (34-42)
VVYPWTQRF

SEQ ID NO: 7985 - protein, 9 aa, Artificial Sequence
  Guanine nucleotide-binding protein subunit beta-2-like 1 (192-200)
TGYLNTVTV

SEQ ID NO: 7986 - protein, 8 aa, Artificial Sequence
  Ubiquitin-conjugating enzyme E2 D2 (59-66)
YPFKPPKV

SEQ ID NO: 7987 - protein, 19 aa, Artificial Sequence
  Histone H2B type 2-E (83-101)
AKHAVSEGTKAVTKYTSSK

SEQ ID NO: 7988 - protein, 10 aa, Artificial Sequence
  HLA class II histocompatibility antigen, DP beta 1 chain (9-18)
APRTVALTAL

SEQ ID NO: 7989 - protein, 9 aa, Artificial Sequence
  SWI/SNF-related matrix-associated actin-dependent regulator of chromatin subfamily E member 1 (114-122)
AYHNSPAYL

SEQ ID NO: 7990 - protein, 9 aa, Artificial Sequence
  Chloride intracellular channel protein 4 (243-251)
AYSDVAKRL

SEQ ID NO: 7991 - protein, 9 aa, Artificial Sequence
  CDK5 regulatory subunit-associated protein 1 (381-389)
AYVELVHHI

SEQ ID NO: 7992 - protein, 10 aa, Artificial Sequence
  Exocyst complex component 2 (85-94)
AYVKGGLSTF

SEQ ID NO: 7993 - protein, 9 aa, Artificial Sequence
  60S ribosomal protein L23a (148-156)
DVANKIGII

SEQ ID NO: 7994 - protein, 9 aa, Artificial Sequence
  Spectrin beta chain, non-erythrocytic 1 (1643-1651)
DYAETVHQL

SEQ ID NO: 7995 - protein, 9 aa, Artificial Sequence
  Nuclear export mediator factor NEMF (234-242)
DYMKTTSNF

SEQ ID NO: 7996 - protein, 9 aa, Artificial Sequence
  Formin-binding protein 1 (189-197)
DYSSILQKF

SEQ ID NO: 7997 - protein, 9 aa, Artificial Sequence
  Myosin light polypeptide 6 (94-102)
DYVEGLRVF

SEQ ID NO: 7998 - protein, 9 aa, Artificial Sequence
  Sterol regulatory element-binding protein 2 (839-847)
EYLKLLHSF

SEQ ID NO: 7999 - protein, 9 aa, Artificial Sequence
  Clathrin heavy chain 1 (1605-1613)
EYLTKVDKL

SEQ ID NO: 8000 - protein, 10 aa, Artificial Sequence
  Tubulin beta chain (158-167)
EYPDRIMNTF

SEQ ID NO: 8001 - protein, 9 aa, Artificial Sequence
  Histone deacetylase 1 (86-94)
EYSKQMQRF

SEQ ID NO: 8002 - protein, 9 aa, Artificial Sequence
  DNA repair protein RAD50 (1281-1289)
EYVEKFYRI

SEQ ID NO: 8003 - protein, 10 aa, Artificial Sequence
  V-type proton ATPase catalytic subunit A (463-472)
EYYDKHFTEF

SEQ ID NO: 8004 - protein, 9 aa, Artificial Sequence
  Exostosin-2 (609-617)
FYHKYFNYL

SEQ ID NO: 8005 - protein, 9 aa, Artificial Sequence
  Late secretory pathway protein AVL9 homolog (280-288)
FYISPVNKL

SEQ ID NO: 8006 - protein, 11 aa, Artificial Sequence
  60S ribosomal protein L7 (81-91)
FYVPAEPKLAF

SEQ ID NO: 8007 - protein, 16 aa, Artificial Sequence
  Elongation factor 1-beta (2-17)
GFGDLKSPAGLQVLND

SEQ ID NO: 8008 - protein, 12 aa, Artificial Sequence
  60S ribosomal protein L5 (2-13)
GFVKVVKNKAYF

SEQ ID NO: 8009 - protein, 9 aa, Artificial Sequence
  Poly(A) RNA polymerase GLD2 (252-260)
GYIERPQLI

SEQ ID NO: 8010 - protein, 9 aa, Artificial Sequence
  Mannose-1-phosphate guanyltransferase alpha (166-174)
HYVEKPSTF

SEQ ID NO: 8011 - protein, 9 aa, Artificial Sequence
  Little elongation complex subunit 2 (341-349)
IFHEVPLKF

SEQ ID NO: 8012 - protein, 11 aa, Artificial Sequence
  Modulator of apoptosis 1 (92-102)
IFKPPDPDNTF

SEQ ID NO: 8013 - protein, 10 aa, Artificial Sequence
  DNA replication licensing factor MCM7 (276-285)
IFLPILRTGF

SEQ ID NO: 8014 - protein, 9 aa, Artificial Sequence
  Putative eukaryotic translation initiation factor 2 subunit 3-like protein (314-322)
IFSKIVSLF

SEQ ID NO: 8015 - protein, 9 aa, Artificial Sequence
  X-ray repair cross-complementing protein 5 (134-142)
IFTDLSSRF

SEQ ID NO: 8016 - protein, 9 aa, Artificial Sequence
  A-kinase anchor protein 11 (638-646)
IFTNTVARF

SEQ ID NO: 8017 - protein, 9 aa, Artificial Sequence
  Zinc finger protein 24 (103-111)
ILPKELQTW

SEQ ID NO: 8018 - protein, 10 aa, Artificial Sequence
  DNA polymerase epsilon catalytic subunit A (1791-1800)
IYADNQVMHF

SEQ ID NO: 8019 - protein, 9 aa, Artificial Sequence
  G1/S-specific cyclin-E2 (202-210)
IYAPKLQEF

SEQ ID NO: 8020 - protein, 9 aa, Artificial Sequence
  A-kinase anchor protein 1, mitochondrial (683-691)
IYAPPLPSL

SEQ ID NO: 8021 - protein, 9 aa, Artificial Sequence
  Signal peptidase complex subunit 1 (37-45)
IYGYVAEQF

SEQ ID NO: 8022 - protein, 10 aa, Artificial Sequence
  Lon protease homolog, mitochondrial (188-197)
IYHTGTFAQI

SEQ ID NO: 8023 - protein, 9 aa, Artificial Sequence
  Heterogeneous nuclear ribonucleoprotein L (145-153)
IYIAGHPAF

SEQ ID NO: 8024 - protein, 9 aa, Artificial Sequence
  Tuftelin-interacting protein 11 (168-176)
IYIDRGVVF

SEQ ID NO: 8025 - protein, 12 aa, Artificial Sequence
  Clathrin heavy chain 1 (882-893)
IYIDSNNNPERF

SEQ ID NO: 8026 - protein, 9 aa, Artificial Sequence
  Deoxynucleotidyltransferase terminal-interacting protein 1 (232-240)
IYIKHPHLF

SEQ ID NO: 8027 - protein, 9 aa, Artificial Sequence
  Retinoblastoma-like protein 2 (1012-1020)
IYIKQIKTF

SEQ ID NO: 8028 - protein, 10 aa, Artificial Sequence
  Activator of 90 kDa heat shock protein ATPase homolog 1 (74-83)
IYISTLKTEF

SEQ ID NO: 8029 - protein, 11 aa, Artificial Sequence
  Ras-related GTP-binding protein C (99-109)
IYKDDISNSSF

SEQ ID NO: 8030 - protein, 9 aa, Artificial Sequence
  Leucine-rich PPR motif-containing protein, mitochondrial (1129-1137)
IYKPVTDFF

SEQ ID NO: 8031 - protein, 10 aa, Artificial Sequence
  DNA-directed RNA polymerases I, II, and III subunit RPABC3 (11-20)
IYPVDLGDKF

SEQ ID NO: 8032 - protein, 10 aa, Artificial Sequence
  Cullin-4B (362-371)
IYQDSFEQRF

SEQ ID NO: 8033 - protein, 9 aa, Artificial Sequence
  Transmembrane protein 209 (509-517)
IYQRHVYNL

SEQ ID NO: 8034 - protein, 9 aa, Artificial Sequence
  Coatomer subunit beta' (535-543)
IYTSSVNRL

SEQ ID NO: 8035 - protein, 9 aa, Artificial Sequence
  Retinoblastoma-like protein 1 (804-812)
IYVGRVKSF

SEQ ID NO: 8036 - protein, 9 aa, Artificial Sequence
  Vam6/Vps39-like protein (97-105)
IYVHDLLTF

SEQ ID NO: 8037 - protein, 11 aa, Artificial Sequence
  DDB1- and CUL4-associated factor 8 (337-347)
IYVNPANTHQF

SEQ ID NO: 8038 - protein, 9 aa, Artificial Sequence
  60S ribosomal protein L3 (361-369)
KFIDTTSKF

SEQ ID NO: 8039 - protein, 9 aa, Artificial Sequence
  Zyxin (193-201)
KFTPVASKF

SEQ ID NO: 8040 - protein, 9 aa, Artificial Sequence
  Protein SDA1 homolog (8-16)
KLPSNLPQL

SEQ ID NO: 8041 - protein, 9 aa, Artificial Sequence
  Protein sel-1 homolog 1 (504-512)
KQALKYFNL

SEQ ID NO: 8042 - protein, 9 aa, Artificial Sequence
  Muscleblind-like protein 3 (180-188)
KYFHPPAHL

SEQ ID NO: 8043 - protein, 9 aa, Artificial Sequence
  Nardilysin (660-668)
KYIATDFTL

SEQ ID NO: 8044 - protein, 9 aa, Artificial Sequence
  U6 snRNA-associated Sm-like protein LSm7 (17-25)
KYIDKTIRV

SEQ ID NO: 8045 - protein, 10 aa, Artificial Sequence
  RuvB-like 1 (285-294)
KYIDQGIAEL

SEQ ID NO: 8046 - protein, 9 aa, Artificial Sequence
  Short transient receptor potential channel 4-associated protein (594-602)
KYINTDAKF

SEQ ID NO: 8047 - protein, 9 aa, Artificial Sequence
  Interferon-induced GTP-binding protein Mx2 (223-231)
KYIQRQQTI

SEQ ID NO: 8048 - protein, 9 aa, Artificial Sequence
  Centromere protein F (1270-1278)
KYISGPHEL

SEQ ID NO: 8049 - protein, 9 aa, Artificial Sequence
  Calcium-binding protein 39-like (247-255)
KYISKPENL

SEQ ID NO: 8050 - protein, 9 aa, Artificial Sequence
  Small subunit processome component 20 homolog (1425-1433)
KYITDVVKL

SEQ ID NO: 8051 - protein, 10 aa, Artificial Sequence
  Poly(A)-specific ribonuclease PARN (21-30)
KYITKSFNFY

SEQ ID NO: 8052 - protein, 11 aa, Artificial Sequence
  Elongation of very long chain fatty acids protein 5 (200-210)
KYITQGQLLQF

SEQ ID NO: 8053 - protein, 9 aa, Artificial Sequence
  Phosphate carrier protein, mitochondrial (97-105)
KYKGIFNGF

SEQ ID NO: 8054 - protein, 11 aa, Artificial Sequence
  S-adenosylmethionine synthase isoform type-2 (234-244)
KYLDEDTIYHL

SEQ ID NO: 8055 - protein, 9 aa, Artificial Sequence
  Mitochondrial-processing peptidase subunit alpha (106-114)
KYLSGIAHF

SEQ ID NO: 8056 - protein, 9 aa, Artificial Sequence
  DNA ligase 1 (566-574)
KYPDIISRI

SEQ ID NO: 8057 - protein, 9 aa, Artificial Sequence
  Gamma-aminobutyric acid receptor-associated protein-like 1 (24-32)
KYPDRVPVI

SEQ ID NO: 8058 - protein, 9 aa, Artificial Sequence
  Rho guanine nucleotide exchange factor 2 (366-374)
KYPLLISRI

SEQ ID NO: 8059 - protein, 8 aa, Artificial Sequence
  ATP-dependent RNA helicase A (169-176)
KYPSPFFV

SEQ ID NO: 8060 - protein, 9 aa, Artificial Sequence
  Translocating chain-associated membrane protein 1 (245-253)
KYQKGFSLW

SEQ ID NO: 8061 - protein, 9 aa, Artificial Sequence
  NADH dehydrogenase (ubiquinone) iron-sulfur protein 5 (91-99)
KYTPPPHHI

SEQ ID NO: 8062 - protein, 9 aa, Artificial Sequence
  Heme oxygenase 2 (124-132)
KYVERIHYI

SEQ ID NO: 8063 - protein, 9 aa, Artificial Sequence
  WD repeat-containing protein 35 (371-379)
KYVKGLISI

SEQ ID NO: 8064 - protein, 9 aa, Artificial Sequence
  Zinc finger protein 195 (148-156)
KYVKIFDNF

SEQ ID NO: 8065 - protein, 10 aa, Artificial Sequence
  NADH dehydrogenase (ubiquinone) 1 alpha subcomplex subunit 12 (47-56)
KYYEDNKQFF

SEQ ID NO: 8066 - protein, 15 aa, Artificial Sequence
  Phosphoglycerate kinase 1 (403-417)
LEGKVLPGVDALSNI

SEQ ID NO: 8067 - protein, 8 aa, Artificial Sequence
  Superkiller viralicidic activity 2-like 2 (586-593)
LEKSFYQF

SEQ ID NO: 8068 - protein, 11 aa, Artificial Sequence
  Gamma-interferon-inducible lysosomal thiol reductase (15-25)
LLLDVPTAAVQ

SEQ ID NO: 8069 - protein, 15 aa, Artificial Sequence
  Polypyrimidine tract-binding protein 1 (359-373)
LVSNLNPERVTPQSL

SEQ ID NO: 8070 - protein, 10 aa, Artificial Sequence
  Translocon-associated protein subunit delta (66-75)
LYADVGGKQF

SEQ ID NO: 8071 - protein, 9 aa, Artificial Sequence
  Nuclear factor erythroid 2-related factor 3 (413-421)
LYHDIFSRL

SEQ ID NO: 8072 - protein, 9 aa, Artificial Sequence
  Rho GTPase-activating protein 1 (181-189)
LYIVHPTMF

SEQ ID NO: 8073 - protein, 10 aa, Artificial Sequence
  60S ribosomal protein L19 (104-113)
LYLKVKGNVF

SEQ ID NO: 8074 - protein, 11 aa, Artificial Sequence
  Signal transducer and activator of transcription 1-alpha/beta (667-677)
LYPNIDKDHAF

SEQ ID NO: 8075 - protein, 9 aa, Artificial Sequence
  BTB/POZ domain-containing protein KCTD20 (142-150)
LYSSKLYRF

SEQ ID NO: 8076 - protein, 9 aa, Artificial Sequence
  Alpha-taxilin (389-397)
LYTEKFEEF

SEQ ID NO: 8077 - protein, 9 aa, Artificial Sequence
  40S ribosomal protein S29 (6-14)
LYWSHPRKF

SEQ ID NO: 8078 - protein, 14 aa, Artificial Sequence
  Calmodulin (125-138)
MIREADIDGDGQVN

SEQ ID NO: 8079 - protein, 9 aa, Artificial Sequence
  Tubulin alpha-1C chain (172-180)
NYARGHYTI

SEQ ID NO: 8080 - protein, 9 aa, Artificial Sequence
  Sorting nexin-4 (257-265)
NYGRVFSEW

SEQ ID NO: 8081 - protein, 9 aa, Artificial Sequence
  Abl interactor 1 (434-442)
NYIEKVVAI

SEQ ID NO: 8082 - protein, 9 aa, Artificial Sequence
  Unconventional myosin-Id (229-237)
NYIHVGAQL

SEQ ID NO: 8083 - protein, 9 aa, Artificial Sequence
  CTD small phosphatase-like protein 2 (385-393)
NYIKDLNIL

SEQ ID NO: 8084 - protein, 9 aa, Artificial Sequence
  CWF19-like protein 1 (409-417)
NYKSHHLQL

SEQ ID NO: 8085 - protein, 9 aa, Artificial Sequence
  Polyadenylate-binding protein-interacting protein 1 (111-119)
NYLSHHLTI

SEQ ID NO: 8086 - protein, 9 aa, Artificial Sequence
  Methionine-tRNA ligase, cytoplasmic (152-160)
NYTLVSHLI

SEQ ID NO: 8087 - protein, 9 aa, Artificial Sequence
  Ribosomal RNA processing protein 1 homolog B (648-656)
PFLPKPLFF

SEQ ID NO: 8088 - protein, 9 aa, Artificial Sequence
  Ribosome biogenesis protein BRX1 homolog (200-208)
PFVDHVFTF

SEQ ID NO: 8089 - protein, 12 aa, Artificial Sequence
  40S ribosomal protein S19 (2-13)
PGVTVKDVNQQE

SEQ ID NO: 8090 - protein, 17 aa, Artificial Sequence
  Nuclease-sensitive element-binding protein 1 (304-320)
PPAENSSAPEAEQGGAE

SEQ ID NO: 8091 - protein, 9 aa, Artificial Sequence
  Protein AATF (255-263)
PQPDVFPLF

SEQ ID NO: 8092 - protein, 10 aa, Artificial Sequence
  pre-mRNA 3' end processing protein WDR33 (495-504)
PYAKPIPAQF

SEQ ID NO: 8093 - protein, 9 aa, Artificial Sequence
  Fatty acid desaturase 2 (227-235)
PYNHQHEYF

SEQ ID NO: 8094 - protein, 9 aa, Artificial Sequence
  Methionine-tRNA ligase, cytoplasmic (273-281)
PYVNNVPHL

SEQ ID NO: 8095 - protein, 9 aa, Artificial Sequence
  Surfeit locus protein 4 (23-31)
QYLPHVARL

SEQ ID NO: 8096 - protein, 11 aa, Artificial Sequence
  Moesin (48-58)
QYQDTKGFSTW

SEQ ID NO: 8097 - protein, 9 aa, Artificial Sequence
  Protein BIVM-ERCC5 (1290-1298)
QYVDFHNQL

SEQ ID NO: 8098 - protein, 10 aa, Artificial Sequence
  Elongation factor 1-gamma (245-254)
RFPEELTQTF

SEQ ID NO: 8099 - protein, 9 aa, Artificial Sequence
  60S ribosomal protein L17 (82-90)
RWPKKSAEF

SEQ ID NO: 8100 - protein, 10 aa, Artificial Sequence
  Elongation factor 2 (264-273)
RYFDPANGKF

SEQ ID NO: 8101 - protein, 9 aa, Artificial Sequence
  Casein kinase II subunit alpha (195-203)
RYFKGPELL

SEQ ID NO: 8102 - protein, 9 aa, Artificial Sequence
  Interferon-induced helicase C domain-containing protein 1 (806-814)
RYGLVTNEI

SEQ ID NO: 8103 - protein, 9 aa, Artificial Sequence
  Pre-mRNA-processing-splicing factor 8 (1090-1098)
RYIDRIHIF

SEQ ID NO: 8104 - protein, 11 aa, Artificial Sequence
  Alpha-enolase (99-109)
RYISPDQLADL

SEQ ID NO: 8105 - protein, 10 aa, Artificial Sequence
  E3 ubiquitin-protein ligase MGRN1 (24-33)
RYPPKSGNYF

SEQ ID NO: 8106 - protein, 9 aa, Artificial Sequence
  Mitotic checkpoint protein BUB3 (274-282)
RYPTSIASL

SEQ ID NO: 8107 - protein, 11 aa, Artificial Sequence
  Mitotic checkpoint protein BUB3 (274-284)
RYPTSIASLAF

SEQ ID NO: 8108 - protein, 9 aa, Artificial Sequence
  Tyrosine-protein kinase BAZ1B (609-617)
RYQDIIHSI

SEQ ID NO: 8109 - protein, 9 aa, Artificial Sequence
  Histone H3.1 (54-62)
RYQKSTELL

SEQ ID NO: 8110 - protein, 9 aa, Artificial Sequence
  Thioredoxin-related transmembrane protein 2 (198-206)
RYTDVSTRY

SEQ ID NO: 8111 - protein, 10 aa, Artificial Sequence
  Suppressor of fused homolog (146-155)
RYVFQSENTF

SEQ ID NO: 8112 - protein, 9 aa, Artificial Sequence
  WD repeat-containing protein 36 (350-358)
SFSTVHEKF

SEQ ID NO: 8113 - protein, 9 aa, Artificial Sequence
  Astrocytic phosphoprotein PEA-15 (61-69)
SYIEHIFEI

SEQ ID NO: 8114 - protein, 9 aa, Artificial Sequence
  Protein ELYS (236-244)
SYISRTNQL

SEQ ID NO: 8115 - protein, 9 aa, Artificial Sequence
  Solute carrier family 23 member 2 (617-625)
SYLPISPTF

SEQ ID NO: 8116 - protein, 9 aa, Artificial Sequence
  Splicing factor 3B subunit 5 (42-50)
SYMGHFDLL

SEQ ID NO: 8117 - protein, 9 aa, Artificial Sequence
  Lymphokine-activated killer T-cell-originated protein kinase (300-308)
SYQKVIELF

SEQ ID NO: 8118 - protein, 9 aa, Artificial Sequence
  Heterogeneous nuclear ribonucleoprotein F (193-201)
SYSDPPLKF

SEQ ID NO: 8119 - protein, 8 aa, Artificial Sequence
  Signal transducer and activator of transcription 2 (259-266)
TAGAKLLF

SEQ ID NO: 8120 - protein, 9 aa, Artificial Sequence
  Zinc finger protein 280C (189-197)
TFSDVEAHF

SEQ ID NO: 8121 - protein, 9 aa, Artificial Sequence
  NADH dehydrogenase (ubiquinone) 1 subunit C2 (107-115)
TYGEIFEKF

SEQ ID NO: 8122 - protein, 9 aa, Artificial Sequence
  Peroxisomal acyl-coenzyme A oxidase 3 (142-150)
TYIQKIFRM

SEQ ID NO: 8123 - protein, 9 aa, Artificial Sequence
  Oxidative stress-induced growth inhibitor 2 (326-334)
TYITSVSRL

SEQ ID NO: 8124 - protein, 9 aa, Artificial Sequence
  Ubiquitin carboxyl-terminal hydrolase 7 (1092-1100)
TYLEKAIKI

SEQ ID NO: 8125 - protein, 9 aa, Artificial Sequence
  Iron-responsive element-binding protein 2 (410-418)
TYLKAVKLF

SEQ ID NO: 8126 - protein, 10 aa, Artificial Sequence
  Cellular tumor antigen p53 (125-134)
TYSPALNKMF

SEQ ID NO: 8127 - protein, 10 aa, Artificial Sequence
  StAR-related lipid transfer protein 7, mitochondrial (95-104)
TYTDVTPRQF

SEQ ID NO: 8128 - protein, 11 aa, Artificial Sequence
  StAR-related lipid transfer protein 7, mitochondrial (95-105)
TYTDVTPRQFF

SEQ ID NO: 8129 - protein, 9 aa, Artificial Sequence
  Nesprin-2 (590-598)
TYVENLRLL

SEQ ID NO: 8130 - protein, 9 aa, Artificial Sequence
  Choline/ethanolaminephosphotransferase 1 (200-208)
TYVSGTLRF

SEQ ID NO: 8131 - protein, 11 aa, Artificial Sequence
  Bifunctional glutamate/proline-tRNA ligase (557-567)
VFIEGADAETF

SEQ ID NO: 8132 - protein, 9 aa, Artificial Sequence
  F-actin-capping protein subunit alpha-2 (30-38)
VFNDVRLLL

SEQ ID NO: 8133 - protein, 9 aa, Artificial Sequence
  Nucleolysin TIAR (236-244)
VFPEKGYSF

SEQ ID NO: 8134 - protein, 9 aa, Artificial Sequence
  3-hydroxy-3-methylglutaryl-coenzyme A reductase (105-113)
VFSTVVIHF

SEQ ID NO: 8135 - protein, 11 aa, Artificial Sequence
  H/ACA ribonucleoprotein complex subunit 3 (54-64)
VLMTQQPRPVL

SEQ ID NO: 8136 - protein, 9 aa, Artificial Sequence
  40S ribosomal protein S26 (63-71)
VLPKLYVKL

SEQ ID NO: 8137 - protein, 12 aa, Artificial Sequence
  60S ribosomal protein L31 (106-117)
VTYVPVTTFKNL

SEQ ID NO: 8138 - protein, 9 aa, Artificial Sequence
  Mitochondrial folate transporter/carrier (299-307)
VYENVSHFL

SEQ ID NO: 8139 - protein, 9 aa, Artificial Sequence
  Protein-lysine N-methyltransferase METTL10 (41-49)
VYERELQTF

SEQ ID NO: 8140 - protein, 13 aa, Artificial Sequence
  Nuclear pore complex protein Nup153 (381-393)
VYFKPSLTPSGEF

SEQ ID NO: 8141 - protein, 9 aa, Artificial Sequence
  Cytochrome c oxidase subunit 4 isoform 1, mitochondrial (125-133)
VYGPLPQSF

SEQ ID NO: 8142 - protein, 9 aa, Artificial Sequence
  26S proteasome non-ATPase regulatory subunit 8 (131-139)
VYIKHPVSL

SEQ ID NO: 8143 - protein, 10 aa, Artificial Sequence
  DNA replication licensing factor MCM3 (192-201)
VYKDHQTITI

SEQ ID NO: 8144 - protein, 10 aa, Artificial Sequence
  Afadin (161-170)
VYKDMPETSF

SEQ ID NO: 8145 - protein, 9 aa, Artificial Sequence
  Guanine nucleotide-binding protein-like 3-like protein (293-301)
VYLDKFIRL

SEQ ID NO: 8146 - protein, 9 aa, Artificial Sequence
  Rho-related BTB domain-containing protein 1 (526-534)
VYLPNINKI

SEQ ID NO: 8147 - protein, 10 aa, Artificial Sequence
  Pre-mRNA-splicing factor SPF27 (137-146)
VYNENLVHMI

SEQ ID NO: 8148 - protein, 9 aa, Artificial Sequence
  Splicing factor 3B subunit 3 (519-527)
VYPDGIRHI

SEQ ID NO: 8149 - protein, 10 aa, Artificial Sequence
  Proteasome-associated protein ECM29 homolog (682-691)
VYPEKLATKF

SEQ ID NO: 8150 - protein, 9 aa, Artificial Sequence
  AP-5 complex subunit zeta-1 (388-396)
VYQHLFTRI

SEQ ID NO: 8151 - protein, 11 aa, Artificial Sequence
  Serine/arginine-rich splicing factor 1 (152-162)
VYRDGTGVVEF

SEQ ID NO: 8152 - protein, 9 aa, Artificial Sequence
  Dynamin-2 (124-132)
VYSPHVLNL

SEQ ID NO: 8153 - protein, 11 aa, Artificial Sequence
  Dynamin-2 (124-134)
VYSPHVLNLTL

SEQ ID NO: 8154 - protein, 11 aa, Artificial Sequence
  E3 ubiquitin-protein ligase UBR5 (1809-1819)
VYSQIPAAVKL

SEQ ID NO: 8155 - protein, 11 aa, Artificial Sequence
  Ribosome biogenesis protein BMS1 homolog (352-362)
VYVDLGGSHVF

SEQ ID NO: 8156 - protein, 9 aa, Artificial Sequence
  BRCA1-associated protein (237-245)
VYVERAEVL

SEQ ID NO: 8157 - protein, 9 aa, Artificial Sequence
  AP-3 complex subunit mu-1 (274-282)
VYVKHSISF

SEQ ID NO: 8158 - protein, 9 aa, Artificial Sequence
  Lipopolysaccharide-induced tumor necrosis factor-alpha factor (79-87)
VYVQHPITF

SEQ ID NO: 8159 - protein, 9 aa, Artificial Sequence
  AP-3 complex subunit delta-1 (521-529)
VYVQNVVKL

SEQ ID NO: 8160 - protein, 9 aa, Artificial Sequence
  Signal transducer and activator of transcription 2 (828-836)
VYVSRPSHF

SEQ ID NO: 8161 - protein, 9 aa, Artificial Sequence
  TraB domain-containing protein (75-83)
VYVVGTAHF

SEQ ID NO: 8162 - protein, 8 aa, Artificial Sequence
  Dystonin (673-680)
YAEKLHRL

SEQ ID NO: 8163 - protein, 8 aa, Artificial Sequence
  Histone deacetylase 1 (87-94)
YSKQMQRF

SEQ ID NO: 8164 - protein, 10 aa, Artificial Sequence
  Activator of 90 kDa heat shock protein ATPase homolog 1 (246-255)
YYFEGIKQTF

SEQ ID NO: 8165 - protein, 10 aa, Artificial Sequence
  Phosphatidylinositol 4-kinase alpha (328-337)
YYMKDLPTSF

SEQ ID NO: 8166 - protein, 9 aa, Artificial Sequence
  Eukaryotic translation initiation factor 3 subunit A (275-283)
YYNKVSTVF

SEQ ID NO: 8167 - protein, 10 aa, Artificial Sequence
  Eukaryotic translation initiation factor 4 gamma 1 (169-178)
YYPAQGVQQF

SEQ ID NO: 8168 - protein, 9 aa, Artificial Sequence
  40S ribosomal protein S17 (20-28)
YYTRLGNDF

SEQ ID NO: 8169 - protein, 9 aa, Artificial Sequence
  Transmembrane protein 43 (102-110)
GRFFLSSGL

SEQ ID NO: 8170 - protein, 10 aa, Artificial Sequence
  Microsomal glutathione S-transferase 3 (82-91)
HPRIASGLGL

SEQ ID NO: 8171 - protein, 9 aa, Artificial Sequence
  Non-specific lipid-transfer protein (373-381)
KIGGIFAFK

SEQ ID NO: 8172 - protein, 8 aa, Artificial Sequence
  Cyclin-dependent kinase 11B (590-597)
YRAPELLL

SEQ ID NO: 8173 - protein, 9 aa, Artificial Sequence
  Spectrin beta chain, non-erythrocytic 1 (1663-1671)
HPESERISM

SEQ ID NO: 8174 - protein, 9 aa, Artificial Sequence
  Mitochondrial import receptor subunit TOM7 homolog (44-52)
MPEPTVLSL

SEQ ID NO: 8175 - protein, 9 aa, Artificial Sequence
  Histidine triad nucleotide-binding protein 1 (8-16)
SPQAPTHFL

SEQ ID NO: 8176 - protein, 9 aa, Artificial Sequence
  Prolyl endopeptidase (534-542)
AEYLIKEGY

SEQ ID NO: 8177 - protein, 10 aa, Artificial Sequence
  Tuftelin-interacting protein 11 (216-225)
EEFQKELSQW

SEQ ID NO: 8178 - protein, 10 aa, Artificial Sequence
  Protein unc-93 homolog B1 (315-324)
EEIDLRSVGW

SEQ ID NO: 8179 - protein, 9 aa, Artificial Sequence
  Spatacsin (901-909)
GEFQTQHSY

SEQ ID NO: 8180 - protein, 10 aa, Artificial Sequence
  HLA class I histocompatibility antigen, alpha chain E (109-118)
SEAGSHTLQW

SEQ ID NO: 8181 - protein, 9 aa, Artificial Sequence
  Vacuolar protein sorting-associated protein 41 homolog (103-111)
SEDGKVQVF

SEQ ID NO: 8182 - protein, 12 aa, Artificial Sequence
  Plastin-3 (65-76)
SELSSEGTQHSY

SEQ ID NO: 8183 - protein, 7 aa, Artificial Sequence
  GTPase-activating protein and VPS9 domain-containing protein 1 (36-42)
AFSILFK

SEQ ID NO: 8184 - protein, 11 aa, Artificial Sequence
  40S ribosomal protein S3 (42-52)
AIAQAESLRYK

SEQ ID NO: 8185 - protein, 9 aa, Artificial Sequence
  26S proteasome non-ATPase regulatory subunit 4 (282-290)
AIRNAMGSL

SEQ ID NO: 8186 - protein, 11 aa, Artificial Sequence
  Exportin-2 (374-384)
AIYLVTSLASK

SEQ ID NO: 8187 - protein, 9 aa, Artificial Sequence
  DNA-dependent protein kinase catalytic subunit (28-36)
ALAGHQLIR

SEQ ID NO: 8188 - protein, 9 aa, Artificial Sequence
  Coatomer subunit beta (905-913)
ALANVSIEK

SEQ ID NO: 8189 - protein, 10 aa, Artificial Sequence
  Protein SDE2 homolog (346-355)
ALFAKPLKGK

SEQ ID NO: 8190 - protein, 9 aa, Artificial Sequence
  Cytochrome c oxidase subunit 2 (41-49)
ALFLTLTTK

SEQ ID NO: 8191 - protein, 9 aa, Artificial Sequence
  ADP-ribosylation factor 5 (7-15)
ALFSRIFGK

SEQ ID NO: 8192 - protein, 9 aa, Artificial Sequence
  Similar to 60S ribosomal protein L7 (172-180)
ALIARSLGK

SEQ ID NO: 8193 - protein, 10 aa, Artificial Sequence
  Regulation of nuclear pre-mRNA domain-containing protein 2 (166-175)
ALIEELLLYK

SEQ ID NO: 8194 - protein, 11 aa, Artificial Sequence
  Mitochondrial import receptor subunit TOM5 homolog (36-46)
ALLRVTPFILK

SEQ ID NO: 8195 - protein, 9 aa, Artificial Sequence
  ADP/ATP translocase 3 (38-46)
ALNFAFKDK

SEQ ID NO: 8196 - protein, 14 aa, Artificial Sequence
  Heat shock protein HSP 90-beta (536-549)
ALRDNSTMGYMMAK

SEQ ID NO: 8197 - protein, 11 aa, Artificial Sequence
  Vimentin (43-53)
ALRPSTSRSLY

SEQ ID NO: 8198 - protein, 12 aa, Artificial Sequence
  60S ribosomal protein L36 (2-13)
ALRYPMAVGLNK

SEQ ID NO: 8199 - protein, 9 aa, Artificial Sequence
  Heterogeneous nuclear ribonucleoprotein U-like protein 1 (367-375)
ALYPHVLVK

SEQ ID NO: 8200 - protein, 10 aa, Artificial Sequence
  60S ribosomal protein L6 (61-70)
AMYSRKAMYK

SEQ ID NO: 8201 - protein, 9 aa, Artificial Sequence
  HCG15392, isoform CRA_b (43-51)
APAPPKAEA

SEQ ID NO: 8202 - protein, 11 aa, Artificial Sequence
  Myotrophin (63-73)
APDKHHITPLL

SEQ ID NO: 8203 - protein, 8 aa, Artificial Sequence
  Actin, cytoplasmic 1 (14-21)
APEEHPVL

SEQ ID NO: 8204 - protein, 9 aa, Artificial Sequence
  CCR4-NOT transcription complex subunit 1 (239-247)
APFLRNVEL

SEQ ID NO: 8205 - protein, 10 aa, Artificial Sequence
  Protein PRRC2A (692-701)
APQAPPPPPK

SEQ ID NO: 8206 - protein, 11 aa, Artificial Sequence
  60S ribosomal protein L13 (47-57)
APRPASGPIRP

SEQ ID NO: 8207 - protein, 10 aa, Artificial Sequence
  NSFL1 cofactor p47 (66-75)
APSDNRVTSF

SEQ ID NO: 8208 - protein, 9 aa, Artificial Sequence
  60S ribosomal protein L13 (2-10)
APSRNGMVL

SEQ ID NO: 8209 - protein, 16 aa, Artificial Sequence
  Heat shock protein HSP 90-beta (534-549)
AQALRDNSTMGYMMAK

SEQ ID NO: 8210 - protein, 8 aa, Artificial Sequence
  DNA-directed RNA polymerase II subunit RPB2 (365-372)
ARGPIQIL

SEQ ID NO: 8211 - protein, 8 aa, Artificial Sequence
  Interferon regulatory factor 2-binding protein 1 (263-270)
ARPPGYEF

SEQ ID NO: 8212 - protein, 9 aa, Artificial Sequence
  Serine/threonine-protein kinase 4 (270-278)
ATATQLLQH

SEQ ID NO: 8213 - protein, 9 aa, Artificial Sequence
  DNA-dependent protein kinase catalytic subunit (4080-4088)
ATDPNILGR

SEQ ID NO: 8214 - protein, 10 aa, Artificial Sequence
  S-formylglutathione hydrolase (124-133)
ATEDPWKTNY

SEQ ID NO: 8215 - protein, 9 aa, Artificial Sequence
  Probable ATP-dependent RNA helicase DDX6 (267-275)
ATFPLSVQK

SEQ ID NO: 8216 - protein, 10 aa, Artificial Sequence
  General transcription factor II-I repeat domain-containing protein 2B (163-172)
ATLKWILENK

SEQ ID NO: 8217 - protein, 10 aa, Artificial Sequence
  Phosphatidylinositol-binding clathrin assembly protein (29-38)
ATTHEIMGPK

SEQ ID NO: 8218 - protein, 11 aa, Artificial Sequence
  Tubulin alpha-1C chain (340-350)
ATYAPVISAEK

SEQ ID NO: 8219 - protein, 11 aa, Artificial Sequence
  E3 ubiquitin/ISG15 ligase TRIM25 (592-602)
AVADKVHLMYK

SEQ ID NO: 8220 - protein, 12 aa, Artificial Sequence
  Omega-amidase NIT2 (98-109)
AVFGPDGTLLAK

SEQ ID NO: 8221 - protein, 9 aa, Artificial Sequence
  Farnesyl pyrophosphate synthase (332-340)
AVFLGLARK

SEQ ID NO: 8222 - protein, 11 aa, Artificial Sequence
  COP9 signalosome complex subunit 8 (4-14)
AVMAESAFSFK

SEQ ID NO: 8223 - protein, 11 aa, Artificial Sequence
  Asparagine-tRNA ligase, cytoplasmic (180-190)
AVYGMLNLTPK

SEQ ID NO: 8224 - protein, 11 aa, Artificial Sequence
  Ras GTPase-activating protein-binding protein 2 (54-64)
AVYGQNDIHHK

SEQ ID NO: 8225 - protein, 10 aa, Artificial Sequence
  ATP-dependent RNA helicase DHX8 (1045-1054)
AVYNSWKNNK

SEQ ID NO: 8226 - protein, 11 aa, Artificial Sequence
  E3 ubiquitin/ISG15 ligase TRIM25 (55-65)
AVYQARPQLHK

SEQ ID NO: 8227 - protein, 11 aa, Artificial Sequence
  DNA damage-binding protein 1 (869-879)
AVYSMVEFNGK

SEQ ID NO: 8228 - protein, 9 aa, Artificial Sequence
  Glucose-6-phosphate 1-dehydrogenase (246-254)
AVYTKMMTK

SEQ ID NO: 8229 - protein, 10 aa, Artificial Sequence
  Glucose-6-phosphate 1-dehydrogenase (246-255)
AVYTKMMTKK

SEQ ID NO: 8230 - protein, 9 aa, Artificial Sequence
  COP9 signalosome complex subunit 3 (239-247)
AYHELAQVY

SEQ ID NO: 8231 - protein, 30 aa, Artificial Sequence
  60 kDa heat shock protein, mitochondrial (315-344)
DMAIATGGAVFGEEGLTLNLEDVQPHDLGK

SEQ ID NO: 8232 - protein, 8 aa, Artificial Sequence
  Protein FAM136A (11-18)
EAVESMVK

SEQ ID NO: 8233 - protein, 9 aa, Artificial Sequence
  60S ribosomal protein L4 (213-221)
EDNGIIKAF

SEQ ID NO: 8234 - protein, 11 aa, Artificial Sequence
  Basic leucine zipper and W2 domain-containing protein 2 (51-61)
FLDSTGSRLDY

SEQ ID NO: 8235 - protein, 10 aa, Artificial Sequence
  Rab GDP dissociation inhibitor beta (29-38)
FVYKGGKIYK

SEQ ID NO: 8236 - protein, 9 aa, Artificial Sequence
  Protein PRRC2C (2390-2398)
FYMDTSHLF

SEQ ID NO: 8237 - protein, 8 aa, Artificial Sequence
  Probable ATP-dependent RNA helicase DDX5 (58-65)
FYQEHPDL

SEQ ID NO: 8238 - protein, 12 aa, Artificial Sequence
  Peroxisomal multifunctional enzyme type 2 (235-246)
GLFEVGAGWIGK

SEQ ID NO: 8239 - protein, 9 aa, Artificial Sequence
  RNA cytidine acetyltransferase (821-829)
GLFNRIIRK

SEQ ID NO: 8240 - protein, 12 aa, Artificial Sequence
  Transgelin-2 (142-153)
GLFSGDPNWFPK

SEQ ID NO: 8241 - protein, 9 aa, Artificial Sequence
  Heterogeneous nuclear ribonucleoprotein Q (269-277)
GLTDVILYH

SEQ ID NO: 8242 - protein, 9 aa, Artificial Sequence
  Malignant T-cell-amplified sequence 1 (174-182)
GLWHMKTYK

SEQ ID NO: 8243 - protein, 10 aa, Artificial Sequence
  Synaptic vesicle membrane protein VAT-1 homolog (282-291)
GMANLLTGPK

SEQ ID NO: 8244 - protein, 9 aa, Artificial Sequence
  Reticulocalbin-2 (4-12)
GPRTAALGL

SEQ ID NO: 8245 - protein, 10 aa, Artificial Sequence
  Superkiller viralicidic activity 2-like 2 (368-377)
GTKGPSNVFK

SEQ ID NO: 8246 - protein, 10 aa, Artificial Sequence
  Calnexin (78-87)
GTLSGWILSK

SEQ ID NO: 8247 - protein, 9 aa, Artificial Sequence
  Parafibromin (313-321)
GTYHGMTLK

SEQ ID NO: 8248 - protein, 9 aa, Artificial Sequence
  Transcription factor 12 (417-425)
HAVGPSTSL

SEQ ID NO: 8249 - protein, 10 aa, Artificial Sequence
  GMP synthase (glutamine-hydrolyzing) (436-445)
HPFPGPGLAI

SEQ ID NO: 8250 - protein, 9 aa, Artificial Sequence
  Superkiller viralicidic activity 2-like 2 (807-815)
HPLHNDPNL

SEQ ID NO: 8251 - protein, 9 aa, Artificial Sequence
  Staphylococcal nuclease domain-containing protein 1 (254-262)
HPNGNITEL

SEQ ID NO: 8252 - protein, 11 aa, Artificial Sequence
  Extended synaptotagmin-1 (652-662)
HVLEAQDLIAK

SEQ ID NO: 8253 - protein, 9 aa, Artificial Sequence
  Pre-mRNA-processing factor 19 (442-450)
IFDQSGTYL

SEQ ID NO: 8254 - protein, 10 aa, Artificial Sequence
  Heterogeneous nuclear ribonucleoprotein C-like 1 (20-29)
IGNLNTLVVK

SEQ ID NO: 8255 - protein, 9 aa, Artificial Sequence
  Catenin alpha-1 (90-98)
ILQKNVPIL

SEQ ID NO: 8256 - protein, 9 aa, Artificial Sequence
  60S ribosomal protein L10a (82-90)
IPHMDIEAL

SEQ ID NO: 8257 - protein, 11 aa, Artificial Sequence
  Spectrin beta chain, non-erythrocytic 1 (2247-2257)
IPYHSEVPVSL

SEQ ID NO: 8258 - protein, 9 aa, Artificial Sequence
  Bifunctional glutamate/proline-tRNA ligase (415-423)
IRKPYIWEY

SEQ ID NO: 8259 - protein, 9 aa, Artificial Sequence
  Histone deacetylase 1 (79-87)
IRPDNMSEY

SEQ ID NO: 8260 - protein, 9 aa, Artificial Sequence
  DNA replication licensing factor MCM5 (289-297)
IRSSYIRVL

SEQ ID NO: 8261 - protein, 10 aa, Artificial Sequence
  Spectrin beta chain, non-erythrocytic 4 (145-154)
IVDGNHRLTL

SEQ ID NO: 8262 - protein, 9 aa, Artificial Sequence
  Cytochrome c oxidase subunit 2 (209-217)
IVLELIPLK

SEQ ID NO: 8263 - protein, 9 aa, Artificial Sequence
  Mitotic checkpoint protein BUB3 (234-242)
IYPVNAISF

SEQ ID NO: 8264 - protein, 9 aa, Artificial Sequence
  Non-POU domain-containing octamer-binding protein (10-18)
KAGEVFIHK

SEQ ID NO: 8265 - protein, 15 aa, Artificial Sequence
  ATP synthase-coupling factor 6, mitochondrial (94-108)
KFEDPKFEVIEKPQA

SEQ ID NO: 8266 - protein, 9 aa, Artificial Sequence
  60S ribosomal protein L10 (156-164)
KFKFPGRQK

SEQ ID NO: 8267 - protein, 9 aa, Artificial Sequence
  Coatomer subunit beta' (413-421)
KIFKNFKEK

SEQ ID NO: 8268 - protein, 9 aa, Artificial Sequence
  Elongation factor 2 (571-579)
KKSDPVVSY

SEQ ID NO: 8269 - protein, 9 aa, Artificial Sequence
  Apoptosis inhibitor 5 (238-246)
KLFDKLLEY

SEQ ID NO: 8270 - protein, 11 aa, Artificial Sequence
  COX assembly mitochondrial protein 2 homolog (69-79)
KLFNPPEESEK

SEQ ID NO: 8271 - protein, 9 aa, Artificial Sequence
  116 kDa U5 small nuclear ribonucleoprotein component (713-721)
KLGEFFQTK

SEQ ID NO: 8272 - protein, 9 aa, Artificial Sequence
  40S ribosomal protein S5 (86-94)
KLMTVRIVK

SEQ ID NO: 8273 - protein, 9 aa, Artificial Sequence
  60S ribosomal protein L23a (115-123)
KLYDIDVAK

SEQ ID NO: 8274 - protein, 13 aa, Artificial Sequence
  ATP-citrate synthase (650-662)
KLYRPGSVAYVSR

SEQ ID NO: 8275 - protein, 10 aa, Artificial Sequence
  Signal recognition particle 54 kDa protein (433-442)
KMGGIKGLFK

SEQ ID NO: 8276 - protein, 9 aa, Artificial Sequence
  Charged multivesicular body protein 5 (9-17)
KPKAPPPSL

SEQ ID NO: 8277 - protein, 22 aa, Artificial Sequence
  60 kDa heat shock protein, mitochondrial (153-174)
KPLVIIAEDVDGEALSTLVLNR

SEQ ID NO: 8278 - protein, 9 aa, Artificial Sequence
  Lysine-specific histone demethylase 1A (200-208)
KPVSLGQAL

SEQ ID NO: 8279 - protein, 13 aa, Artificial Sequence
  Histone H4 (80-92)
KTVTAMDVVYALK

SEQ ID NO: 8280 - protein, 12 aa, Artificial Sequence
  High mobility group protein B1 (76-87)
KTYIPPKGETKK

SEQ ID NO: 8281 - protein, 9 aa, Artificial Sequence
  GMP synthase (glutamine-hydrolyzing) (112-120)
KVFGGTVHK

SEQ ID NO: 8282 - protein, 9 aa, Artificial Sequence
  Splicing factor 3B subunit 1 (554-562)
KVIDRILYK

SEQ ID NO: 8283 - protein, 9 aa, Artificial Sequence
  SRSF protein kinase 1 (4-12)
KVLALQARK

SEQ ID NO: 8284 - protein, 11 aa, Artificial Sequence
  RANBP2-like and GRIP domain-containing protein 2 (608-618)
KVLPLLKIIKK

SEQ ID NO: 8285 - protein, 11 aa, Artificial Sequence
  Cytochrome c oxidase subunit 4 isoform 1, mitochondrial (149-159)
KVNPIQGLASK

SEQ ID NO: 8286 - protein, 9 aa, Artificial Sequence
  PC4 and SFRS1-interacting protein (228-236)
KVSQVIMEK

SEQ ID NO: 8287 - protein, 10 aa, Artificial Sequence
  Rab GDP dissociation inhibitor alpha (103-112)
KVVEGSFVYK

SEQ ID NO: 8288 - protein, 9 aa, Artificial Sequence
  Lymphocyte cytosolic protein 2 (468-476)
KVYNIQIRY

SEQ ID NO: 8289 - protein, 9 aa, Artificial Sequence
  ATP-dependent RNA helicase A (169-177)
KYPSPFFVF

SEQ ID NO: 8290 - protein, 19 aa, Artificial Sequence
  Vimentin (79-97)
LLQDSVDFSLADAINTEFK

SEQ ID NO: 8291 - protein, 9 aa, Artificial Sequence
  Actin, gamma-enteric smooth muscle (200-208)
LPDGQVITI

SEQ ID NO: 8292 - protein, 9 aa, Artificial Sequence
  Polypyrimidine tract-binding protein 3 (123-131)
LPFGKVTNL

SEQ ID NO: 8293 - protein, 9 aa, Artificial Sequence
  Histone deacetylase 1 (373-381)
LPHAPGVQM

SEQ ID NO: 8294 - protein, 10 aa, Artificial Sequence
  Eukaryotic translation initiation factor 4B (90-99)
LPKSPPYTAF

SEQ ID NO: 8295 - protein, 9 aa, Artificial Sequence
  DNA polymerase epsilon subunit 3 (10-18)
LPNAVITRI

SEQ ID NO: 8296 - protein, 10 aa, Artificial Sequence
  Sorting nexin-1 (270-279)
LPRAVGTQTL

SEQ ID NO: 8297 - protein, 9 aa, Artificial Sequence
  T-complex protein 1 subunit theta (260-268)
LPRLTPPVL

SEQ ID NO: 8298 - protein, 9 aa, Artificial Sequence
  Phosphate carrier protein, mitochondrial (340-348)
LPRPPPPEM

SEQ ID NO: 8299 - protein, 9 aa, Artificial Sequence
  Protein flightless-1 homolog (881-889)
LPRQPPMSL

SEQ ID NO: 8300 - protein, 9 aa, Artificial Sequence
  Cytochrome c oxidase subunit 2 (78-86)
LPSLRILYM

SEQ ID NO: 8301 - protein, 9 aa, Artificial Sequence
  BAG family molecular chaperone regulator 3 (188-196)
LPSSGRSSL

SEQ ID NO: 8302 - protein, 9 aa, Artificial Sequence
  Staphylococcal nuclease domain-containing protein 1 (747-755)
LPSTRLGTL

SEQ ID NO: 8303 - protein, 9 aa, Artificial Sequence
  Beta-enolase (102-110)
LPVPAFNVI

SEQ ID NO: 8304 - protein, 9 aa, Artificial Sequence
  RNA-binding protein 4 (186-194)
LTEQYNEQY

SEQ ID NO: 8305 - protein, 9 aa, Artificial Sequence
  60S ribosomal protein L13 (150-158)
LTGPVMPVR

SEQ ID NO: 8306 - protein, 9 aa, Artificial Sequence
  Proteasome activator complex subunit 3 (29-37)
LVANFFPKK

SEQ ID NO: 8307 - protein, 9 aa, Artificial Sequence
  CD99 antigen (1-9)
MARGAALAL

SEQ ID NO: 8308 - protein, 11 aa, Artificial Sequence
  Destrin (115-125)
MIYASSKDAIK

SEQ ID NO: 8309 - protein, 12 aa, Artificial Sequence
  Destrin (115-126)
MIYASSKDAIKK

SEQ ID NO: 8310 - protein, 11 aa, Artificial Sequence
  Peroxiredoxin-1 (21-31)
MPDGQFKDISL

SEQ ID NO: 8311 - protein, 9 aa, Artificial Sequence
  E3 ubiquitin-protein ligase HECTD1 (409-417)
MPRGVVVTL

SEQ ID NO: 8312 - protein, 11 aa, Artificial Sequence
  Double-stranded RNA-binding protein Staufen homolog 1 (482-492)
MPRTGNGPMSV

SEQ ID NO: 8313 - protein, 9 aa, Artificial Sequence
  60S acidic ribosomal protein P2 (1-9)
MRYVASYLL

SEQ ID NO: 8314 - protein, 9 aa, Artificial Sequence
  Eukaryotic translation initiation factor 1A, Y-chromosomal (87-95)
NKADVILKY

SEQ ID NO: 8315 - protein, 9 aa, Artificial Sequence
  ATP-dependent RNA helicase DDX24 (498-506)
NPKRQTLVF

SEQ ID NO: 8316 - protein, 10 aa, Artificial Sequence
  Transgelin-2 (158-167)
NPRNFSDNQL

SEQ ID NO: 8317 - protein, 9 aa, Artificial Sequence
  5'-3' exoribonuclease 2 (456-464)
NPRQAAYEM

SEQ ID NO: 8318 - protein, 9 aa, Artificial Sequence
  Lysine-specific histone demethylase 1A (407-415)
NRLLEATSY

SEQ ID NO: 8319 - protein, 9 aa, Artificial Sequence
  Nesprin-2 (5548-5556)
NRPEFITEF

SEQ ID NO: 8320 - protein, 9 aa, Artificial Sequence
  Protein DEK (115-123)
NRPGTVSSL

SEQ ID NO: 8321 - protein, 9 aa, Artificial Sequence
  ATP-dependent RNA helicase DDX3X (644-652)
NSDGYGGNY

SEQ ID NO: 8322 - protein, 8 aa, Artificial Sequence
  40S ribosomal protein S26 (108-115)
PRPPPKPM

SEQ ID NO: 8323 - protein, 9 aa, Artificial Sequence
  Tubulin beta chain (43-51)
QLDRISVYY

SEQ ID NO: 8324 - protein, 9 aa, Artificial Sequence
  Isoleucine-tRNA ligase, cytoplasmic (165-173)
QLYDKGLVY

SEQ ID NO: 8325 - protein, 9 aa, Artificial Sequence
  Filamin-A (2017-2025)
QPASFAVSL

SEQ ID NO: 8326 - protein, 9 aa, Artificial Sequence
  Lysine-specific histone demethylase 1A (574-582)
QPITPGPSI

SEQ ID NO: 8327 - protein, 9 aa, Artificial Sequence
  Pericentriolar material 1 protein (1892-1900)
QPNPLPLRL

SEQ ID NO: 8328 - protein, 10 aa, Artificial Sequence
  Cytochrome c oxidase subunit 4 isoform 1, mitochondrial (93-102)
QSFDKEWVAK

SEQ ID NO: 8329 - protein, 10 aa, Artificial Sequence
  Nucleoporin SEH1 (246-255)
RIFTLKPVRK

SEQ ID NO: 8330 - protein, 10 aa, Artificial Sequence
  L-lactate dehydrogenase B chain (270-279)
RIHPVSTMVK

SEQ ID NO: 8331 - protein, 9 aa, Artificial Sequence
  DNA replication licensing factor MCM6 (131-139)
RIIEKVIHR

SEQ ID NO: 8332 - protein, 12 aa, Artificial Sequence
  Reticulon-4 (62-73)
RIYKGVIQAIQK

SEQ ID NO: 8333 - protein, 9 aa, Artificial Sequence
  DNA (cytosine-5)-methyltransferase 1 (1459-1467)
RLFGNILDK

SEQ ID NO: 8334 - protein, 10 aa, Artificial Sequence
  26S protease regulatory subunit 6B (342-351)
RLIFSTITSK

SEQ ID NO: 8335 - protein, 11 aa, Artificial Sequence
  26S protease regulatory subunit 6A (11-21)
RLLDSEIKIMK

SEQ ID NO: 8336 - protein, 13 aa, Artificial Sequence
  Heat shock 70 kDa protein 4L (128-140)
RLMNETTAVALAY

SEQ ID NO: 8337 - protein, 10 aa, Artificial Sequence
  DNA-dependent protein kinase catalytic subunit (659-668)
RLPLISGFYK

SEQ ID NO: 8338 - protein, 10 aa, Artificial Sequence
  Vimentin (69-78)
RLRSSVPGVR

SEQ ID NO: 8339 - protein, 9 aa, Artificial Sequence
  Cytoskeleton-associated protein 2 (369-377)
RLSEWKAGK

SEQ ID NO: 8340 - protein, 10 aa, Artificial Sequence
  Coiled-coil domain-containing protein 124 (192-201)
RLSQLKQLLK

SEQ ID NO: 8341 - protein, 9 aa, Artificial Sequence
  E3 ubiquitin-protein ligase HECTD1 (170-178)
RLVDLPISK

SEQ ID NO: 8342 - protein, 9 aa, Artificial Sequence
  Serine-threonine kinase receptor-associated protein (290-298)
RLWQTVVGK

SEQ ID NO: 8343 - protein, 13 aa, Artificial Sequence
  Mitotic checkpoint protein BUB3 (40-52)
RLYDVPANSMRLK

SEQ ID NO: 8344 - protein, 9 aa, Artificial Sequence
  DNA damage-binding protein 1 (889-897)
RLYEWTTEK

SEQ ID NO: 8345 - protein, 12 aa, Artificial Sequence
  60S ribosomal protein L23a (129-140)
RPDGEKKAYVRL

SEQ ID NO: 8346 - protein, 9 aa, Artificial Sequence
  26S proteasome non-ATPase regulatory subunit 12 (417-425)
RPKDPNNLL

SEQ ID NO: 8347 - protein, 9 aa, Artificial Sequence
  Ataxin-3 (188-196)
RPKLIGEEL

SEQ ID NO: 8348 - protein, 11 aa, Artificial Sequence
  Poly(rC)-binding protein 2 (183-193)
RPKPSSSPVIF

SEQ ID NO: 8349 - protein, 9 aa, Artificial Sequence
  40S ribosomal protein S11 (132-140)
RPLSKTVRF

SEQ ID NO: 8350 - protein, 9 aa, Artificial Sequence
  Splicing factor 3B subunit 2 (222-230)
RPRGPPPPP

SEQ ID NO: 8351 - protein, 11 aa, Artificial Sequence
  Vimentin (23-33)
RPSSSRSYVTT

SEQ ID NO: 8352 - protein, 9 aa, Artificial Sequence
  Elongation factor 1-alpha 1 (240-248)
RPTDKPLRL

SEQ ID NO: 8353 - protein, 10 aa, Artificial Sequence
  Translation initiation factor eIF-2B subunit delta (385-394)
RPWLEGRHTL

SEQ ID NO: 8354 - protein, 10 aa, Artificial Sequence
  Polyglutamine-binding protein 1 (242-251)
RPYPSPGAVL

SEQ ID NO: 8355 - protein, 10 aa, Artificial Sequence
  Transcriptional repressor p66-alpha (257-266)
RSIPQSATWK

SEQ ID NO: 8356 - protein, 10 aa, Artificial Sequence
  Constitutive coactivator of PPAR-gamma-like protein 1 (313-322)
RTDDKVIRFK

SEQ ID NO: 8357 - protein, 11 aa, Artificial Sequence
  Ras GTPase-activating protein-binding protein 1 (247-257)
RTFSWASVTSK

SEQ ID NO: 8358 - protein, 9 aa, Artificial Sequence
  42 kda non-muscle cytoplasmic actin (2-10)
RVAPEEHPV

SEQ ID NO: 8359 - protein, 13 aa, Artificial Sequence
  Heterogeneous nuclear ribonucleoprotein C-like 1 (17-29)
RVFIGNLNTLVVK

SEQ ID NO: 8360 - protein, 12 aa, Artificial Sequence
  Elongation factor 2 (415-426)
RVFSGLVSTGLK

SEQ ID NO: 8361 - protein, 9 aa, Artificial Sequence
  Paired amphipathic helix protein Sin3a (1263-1271)
RVKYGTVFK

SEQ ID NO: 8362 - protein, 12 aa, Artificial Sequence
  Prohibitin (117-128)
RVLPSITTEILK

SEQ ID NO: 8363 - protein, 13 aa, Artificial Sequence
  Coatomer subunit beta (327-339)
RVLSTPDLEVRKK

SEQ ID NO: 8364 - protein, 9 aa, Artificial Sequence
  Filamin-A (2022-2030)
RVRVSGQGL

SEQ ID NO: 8365 - protein, 9 aa, Artificial Sequence
  Pre-mRNA-processing-splicing factor 8 (444-452)
RVSYQKLLK

SEQ ID NO: 8366 - protein, 16 aa, Artificial Sequence
  Ribose-5-phosphate isomerase (219-234)
RVYFGMQDGSVNMREK

SEQ ID NO: 8367 - protein, 9 aa, Artificial Sequence
  Antigen KI-67 (420-428)
SENLLGKQF

SEQ ID NO: 8368 - protein, 10 aa, Artificial Sequence
  Heterogeneous nuclear ribonucleoproteins A2/B1 (73-82)
SIDGRVVEPK

SEQ ID NO: 8369 - protein, 10 aa, Artificial Sequence
  Transmembrane and coiled-coil domain-containing protein 1 (107-116)
SIFDGRVVAK

SEQ ID NO: 8370 - protein, 11 aa, Artificial Sequence
  Phosphoglycerate kinase 1 (87-97)
SLLGKDVLFLK

SEQ ID NO: 8371 - protein, 9 aa, Artificial Sequence
  Dynein light chain roadblock-type 1 (51-59)
SLMHSFILK

SEQ ID NO: 8372 - protein, 10 aa, Artificial Sequence
  Vimentin (430-439)
SLPLVDTHSK

SEQ ID NO: 8373 - protein, 14 aa, Artificial Sequence
  Vimentin (51-64)
SLYASSPGGVYATR

SEQ ID NO: 8374 - protein, 9 aa, Artificial Sequence
  Fatty acid synthase (2326-2334)
SPAPTHNSL

SEQ ID NO: 8375 - protein, 9 aa, Artificial Sequence
  Ataxin-2-like protein (516-524)
SPASPKISL

SEQ ID NO: 8376 - protein, 9 aa, Artificial Sequence
  Chromosome alignment-maintaining phosphoprotein 1 (618-626)
SPEQSRNVL

SEQ ID NO: 8377 - protein, 9 aa, Artificial Sequence
  Rho guanine nucleotide exchange factor 1 (10-18)
SPGPSRPGL

SEQ ID NO: 8378 - protein, 10 aa, Artificial Sequence
  Isocitrate dehydrogenase (NADP) cytoplasmic (28-37)
SPNGTIRNIL

SEQ ID NO: 8379 - protein, 9 aa, Artificial Sequence
  Trifunctional enzyme subunit alpha, mitochondrial (56-64)
SPNSKVNTL

SEQ ID NO: 8380 - protein, 9 aa, Artificial Sequence
  Cleavage stimulation factor subunit 2 (153-161)
SPQEARNML

SEQ ID NO: 8381 - protein, 9 aa, Artificial Sequence
  Poly(rC)-binding protein 1 (173-181)
SPQGRVMTI

SEQ ID NO: 8382 - protein, 9 aa, Artificial Sequence
  E3 ubiquitin-protein ligase TRIP12 (1954-1962)
SPRLPVGGF

SEQ ID NO: 8383 - protein, 9 aa, Artificial Sequence
  Cytoplasmic dynein 1 light intermediate chain 1 (398-406)
SPRVPGGSP

SEQ ID NO: 8384 - protein, 10 aa, Artificial Sequence
  Telomeric repeat-binding factor 2-interacting protein 1 (154-163)
SPSSVTGNAL

SEQ ID NO: 8385 - protein, 9 aa, Artificial Sequence
  Transketolase (386-394)
SRPENAIIY

SEQ ID NO: 8386 - protein, 8 aa, Artificial Sequence
  Heterogeneous nuclear ribonucleoprotein K (81-88)
SSGPERIL

SEQ ID NO: 8387 - protein, 12 aa, Artificial Sequence
  RNA-binding protein FUS (44-55)
STDTSGYGQSSY

SEQ ID NO: 8388 - protein, 9 aa, Artificial Sequence
  DNA-dependent protein kinase catalytic subunit (1861-1869)
STFDTQITK

SEQ ID NO: 8389 - protein, 9 aa, Artificial Sequence
  60S ribosomal protein L10a (153-161)
STIKFQMKK

SEQ ID NO: 8390 - protein, 9 aa, Artificial Sequence
  Cytoskeleton-associated protein 5 (430-438)
STLPKSLLK

SEQ ID NO: 8391 - protein, 11 aa, Artificial Sequence
  Dolichyl-diphosphooligosaccharide-proteinosyltransferase subunit 2 (254-264)
SVASAAAVLSH

SEQ ID NO: 8392 - protein, 9 aa, Artificial Sequence
  Cytoplasmic FMR1-interacting protein 1 (504-512)
SVFNHAIRH

SEQ ID NO: 8393 - protein, 9 aa, Artificial Sequence
  Far upstream element-binding protein 3 (77-85)
SVYGYGVQK

SEQ ID NO: 8394 - protein, 9 aa, Artificial Sequence
  YTH domain-containing protein 1 (570-578)
SYNDYVREF

SEQ ID NO: 8395 - protein, 9 aa, Artificial Sequence
  RNA binding motif protein, X-linked-like-1 (280-288)
SYRDSYESY

SEQ ID NO: 8396 - protein, 9 aa, Artificial Sequence
  Nuclear pore complex protein Nup98-Nup96 (1516-1524)
TADPLDYRL

SEQ ID NO: 8397 - protein, 9 aa, Artificial Sequence
  Fatty acid synthase (1230-1238)
TAVENMPSL

SEQ ID NO: 8398 - protein, 10 aa, Artificial Sequence
  T-complex protein 1 subunit theta (13-22)
TAYGPNGMNK

SEQ ID NO: 8399 - protein, 9 aa, Artificial Sequence
  Eukaryotic translation elongation factor 1 epsilon-1 (114-122)
TLADILLYY

SEQ ID NO: 8400 - protein, 9 aa, Artificial Sequence
  Coatomer subunit beta' (828-836)
TPNEERNVM

SEQ ID NO: 8401 - protein, 9 aa, Artificial Sequence
  Extended synaptotagmin-1 (769-777)
TPRPTAAEL

SEQ ID NO: 8402 - protein, 9 aa, Artificial Sequence
  Serine/arginine repetitive matrix protein 2 (2049-2057)
TPVAGSQSL

SEQ ID NO: 8403 - protein, 9 aa, Artificial Sequence
  Exportin-1 (61-69)
TRVDTILEF

SEQ ID NO: 8404 - protein, 10 aa, Artificial Sequence
  TATA-binding protein-associated factor 2N (41-50)
TTDSSYGQNY

SEQ ID NO: 8405 - protein, 10 aa, Artificial Sequence
  Retinoblastoma-associated protein (408-417)
TVNPKESILK

SEQ ID NO: 8406 - protein, 9 aa, Artificial Sequence
  Prosaposin (51-59)
TVWNKPTVK

SEQ ID NO: 8407 - protein, 8 aa, Artificial Sequence
  Zinc phosphodiesterase ELAC protein 2 (581-588)
VERLISSL

SEQ ID NO: 8408 - protein, 8 aa, Artificial Sequence
  Antigen KI-67 (75-82)
VIDEPVRL

SEQ ID NO: 8409 - protein, 13 aa, Artificial Sequence
  Myb-binding protein 1A (543-555)
VIRSPSLLQSGAK

SEQ ID NO: 8410 - protein, 10 aa, Artificial Sequence
  Filamin-A (331-340)
VLFAGQHIAK

SEQ ID NO: 8411 - protein, 9 aa, Artificial Sequence
  Barrier-to-autointegration factor (45-53)
VLGQFLVLK

SEQ ID NO: 8412 - protein, 9 aa, Artificial Sequence
  Protein flightless-1 homolog (179-187)
VLNGNPLLH

SEQ ID NO: 8413 - protein, 9 aa, Artificial Sequence
  Signal recognition particle subunit SRP68 (453-461)
VLYDRVLKY

SEQ ID NO: 8414 - protein, 9 aa, Artificial Sequence
  60S ribosomal protein L7 (83-91)
VPAEPKLAF

SEQ ID NO: 8415 - protein, 9 aa, Artificial Sequence
  Protein FAM219A (74-82)
VPNKGYSSL

SEQ ID NO: 8416 - protein, 10 aa, Artificial Sequence
  Long-chain-fatty-acid-CoA ligase 4 (576-585)
VPNQKRLTLL

SEQ ID NO: 8417 - protein, 9 aa, Artificial Sequence
  ATP-dependent RNA helicase DDX24 (199-207)
VPRPVLRAL

SEQ ID NO: 8418 - protein, 9 aa, Artificial Sequence
  Ankyrin repeat and KH domain-containing protein 1 (748-756)
VPRVPTHTL

SEQ ID NO: 8419 - protein, 9 aa, Artificial Sequence
  Nuclear pore complex protein Nup153 (582-590)
VPVAKTAEL

SEQ ID NO: 8420 - protein, 9 aa, Artificial Sequence
  60S ribosomal protein L27a (104-112)
VRSGYYKVL

SEQ ID NO: 8421 - protein, 9 aa, Artificial Sequence
  RNA-binding protein 4 (197-205)
VRTPYTMSY

SEQ ID NO: 8422 - protein, 11 aa, Artificial Sequence
  Tripeptidyl-peptidase 1 (68-78)
VSDPSSPQYGK

SEQ ID NO: 8423 - protein, 11 aa, Artificial Sequence
  Vimentin (31-41)
VTTSTRTYSLG

SEQ ID NO: 8424 - protein, 10 aa, Artificial Sequence
  60S ribosomal protein L8 (15-24)
VVFRDPYRFK

SEQ ID NO: 8425 - protein, 8 aa, Artificial Sequence
  Non-specific lipid-transfer protein (16-23)
VVGVGMTK

SEQ ID NO: 8426 - protein, 10 aa, Artificial Sequence
  Filamin-A (391-400)
VVIQDPMGQK

SEQ ID NO: 8427 - protein, 10 aa, Artificial Sequence
  Barrier-to-autointegration factor (44-53)
VVLGQFLVLK

SEQ ID NO: 8428 - protein, 21 aa, Artificial Sequence
  Glyceraldehyde-3-phosphate dehydrogenase (87-107)
WGDAGAEYVVESTGVFTTMEK

SEQ ID NO: 8429 - protein, 9 aa, Artificial Sequence
  Tubulin beta chain (179-187)
YPDRIMNTF

SEQ ID NO: 8430 - protein, 9 aa, Artificial Sequence
  RNA-binding protein 14 (249-257)
YRAQPSASL

SEQ ID NO: 8431 - protein, 9 aa, Artificial Sequence
  RNA-binding protein 14 (237-245)
YRAQPSVSL

SEQ ID NO: 8432 - protein, 9 aa, Artificial Sequence
  RNA-binding protein 14 (540-548)
YRGQPGNAY

SEQ ID NO: 8433 - protein, 8 aa, Artificial Sequence
  Cyclin-dependent kinase 9 (194-201)
YRPPELLL

SEQ ID NO: 8434 - protein, 9 aa, Artificial Sequence
  Pre-mRNA-processing-splicing factor 8 (1470-1478)
YRTDMIQAL

SEQ ID NO: 8435 - protein, 12 aa, Artificial Sequence
  Plectin (3167-3178)
YSDPSTGEPATY

SEQ ID NO: 8436 - protein, 9 aa, Artificial Sequence
  Protein SON (1132-1140)
YTDSYTDTY

SEQ ID NO: 8437 - protein, 11 aa, Artificial Sequence
  HLA class I histocompatibility antigen, B-38 alpha chain (140-150)
FAYDGKDYIAL

SEQ ID NO: 8438 - protein, 9 aa, Artificial Sequence
  Proteasome subunit beta type-7 (202-210)
IAAGIFNDL

SEQ ID NO: 8439 - protein, 9 aa, Artificial Sequence
  40S ribosomal protein S17 (38-46)
IAIIPSKKL

SEQ ID NO: 8440 - protein, 9 aa, Artificial Sequence
  Neudesin (21-29)
ALAPGLPTA

SEQ ID NO: 8441 - protein, 10 aa, Artificial Sequence
  TRAF2 and NCK-interacting protein kinase (1170-1179)
AWAPKPYHKF

SEQ ID NO: 8442 - protein, 9 aa, Artificial Sequence
  Neuroblast differentiation-associated protein AHNAK (739-747)
DVHGPDWHL

SEQ ID NO: 8443 - protein, 9 aa, Artificial Sequence
  Prelamin-A/C (53-61)
EELDFQKNI

SEQ ID NO: 8444 - protein, 9 aa, Artificial Sequence
  Protein flightless-1 homolog (1158-1166)
EYMKHTRLF

SEQ ID NO: 8445 - protein, 9 aa, Artificial Sequence
  Non-POU domain-containing octamer-binding protein (374-382)
FPDAREQEI

SEQ ID NO: 8446 - protein, 8 aa, Artificial Sequence
  Probable RNA-binding protein 23 (351-358)
FPDGDQEL

SEQ ID NO: 8447 - protein, 9 aa, Artificial Sequence
  Tubulin beta-6 chain (159-167)
FPDRIMNTF

SEQ ID NO: 8448 - protein, 9 aa, Artificial Sequence
  Actin-related protein 2/3 complex subunit 3 (103-111)
FPIPGEPGF

SEQ ID NO: 8449 - protein, 9 aa, Artificial Sequence
  Solute carrier family 35 member F5 (288-296)
FPSNSGDRF

SEQ ID NO: 8450 - protein, 10 aa, Artificial Sequence
  Myoferlin (286-295)
FVYDEPGHAV

SEQ ID NO: 8451 - protein, 10 aa, Artificial Sequence
  HLA class I histocompatibility antigen, B-44 alpha chain (216-225)
HPISDHEVTL

SEQ ID NO: 8452 - protein, 8 aa, Artificial Sequence
  Fructose-bisphosphate aldolase B (192-199)
IPDGDHDL

SEQ ID NO: 8453 - protein, 9 aa, Artificial Sequence
  Neutral cholesterol ester hydrolase 1 (34-42)
KYFLKPEVL

SEQ ID NO: 8454 - protein, 9 aa, Artificial Sequence
  Vacuolar protein sorting-associated protein 13B (2853-2861)
LPDPIIIHL

SEQ ID NO: 8455 - protein, 9 aa, Artificial Sequence
  FERM domain-containing protein 6 (550-558)
LYQKDFLRI

SEQ ID NO: 8456 - protein, 9 aa, Artificial Sequence
  Microtubule-associated protein RP/EB family member 1 (50-58)
MLFPGSIAL

SEQ ID NO: 8457 - protein, 9 aa, Artificial Sequence
  Cyclic AMP-dependent transcription factor ATF-4 (108-116)
MPDDLLTTL

SEQ ID NO: 8458 - protein, 8 aa, Artificial Sequence
  Neuroblast differentiation-associated protein AHNAK (820-827)
MPDVDLHL

SEQ ID NO: 8459 - protein, 9 aa, Artificial Sequence
  Transcription factor AP-1 (42-50)
MVAPAVASV

SEQ ID NO: 8460 - protein, 9 aa, Artificial Sequence
  Chloride intracellular channel protein 4 (190-198)
NLLPKLHIV

SEQ ID NO: 8461 - protein, 9 aa, Artificial Sequence
  Growth arrest and DNA damage-inducible protein GADD45 alpha (48-56)
NVDPDNVVL

SEQ ID NO: 8462 - protein, 9 aa, Artificial Sequence
  Probable C-mannosyltransferase DPY19L4 (693-701)
NYSPYVNYF

SEQ ID NO: 8463 - protein, 11 aa, Artificial Sequence
  Integrin alpha-3 (412-422)
QPQQVIHGEKL

SEQ ID NO: 8464 - protein, 9 aa, Artificial Sequence
  Protein transport protein Sec61 subunit alpha isoform 2 (393-401)
RYIPTAAAF

SEQ ID NO: 8465 - protein, 10 aa, Artificial Sequence
  Tumor suppressor candidate 3 (18-27)
RYLPTGSFPF

SEQ ID NO: 8466 - protein, 9 aa, Artificial Sequence
  Rho GTPase-activating protein 7 (915-923)
SEGPPLRLW

SEQ ID NO: 8467 - protein, 9 aa, Artificial Sequence
  Exosome complex component RRP42 (222-230)
SLASLLVSV

SEQ ID NO: 8468 - protein, 9 aa, Artificial Sequence
  AAC83183.1 (1386-1394)
SLLDPVPEV

SEQ ID NO: 8469 - protein, 9 aa, Artificial Sequence
  E3 ubiquitin-protein ligase BRE1A (312-320)
SLYGGTITI

SEQ ID NO: 8470 - protein, 9 aa, Artificial Sequence
  WD repeat-containing protein 48 (452-460)
SPDGSDPKL

SEQ ID NO: 8471 - protein, 9 aa, Artificial Sequence
  Pericentriolar material 1 protein (1935-1943)
SPDTESPVL

SEQ ID NO: 8472 - protein, 10 aa, Artificial Sequence
  Protein LDOC1 (73-82)
SYMLVNENRF

SEQ ID NO: 8473 - protein, 9 aa, Artificial Sequence
  Nardilysin (1115-1123)
TYLPTSPLL

SEQ ID NO: 8474 - protein, 9 aa, Artificial Sequence
  Calnexin (12-20)
VLGTAIVEA

SEQ ID NO: 8475 - protein, 9 aa, Artificial Sequence
  Cleft lip and palate transmembrane protein 1 (107-115)
VYISEHEHF

SEQ ID NO: 8476 - protein, 9 aa, Artificial Sequence
  U5 small nuclear ribonucleoprotein 200 kDa helicase (1389-1397)
VYMDWYEKF

SEQ ID NO: 8477 - protein, 10 aa, Artificial Sequence
  BTB/POZ domain-containing protein KCTD4 (77-86)
YFIDRDGLLF

SEQ ID NO: 8478 - protein, 10 aa, Artificial Sequence
  DNA-binding protein SATB2 (639-648)
YPDQEAIHTL

SEQ ID NO: 8479 - protein, 10 aa, Artificial Sequence
  Long-chain-fatty-acid-CoA ligase 4 (238-247)
YPEGFEIHSM

SEQ ID NO: 8480 - protein, 10 aa, Artificial Sequence
  Tribbles homolog 3 (259-268)
YPFQDSEPVL

SEQ ID NO: 8481 - protein, 9 aa, Artificial Sequence
  Protein LAP2 (483-491)
YPTPYPDEL

SEQ ID NO: 8482 - protein, 9 aa, Artificial Sequence
  V-type proton ATPase catalytic subunit A (464-472)
YYDKHFTEF

SEQ ID NO: 8483 - protein, 11 aa, Artificial Sequence
  Filamin-B (515-525)
YYPSTPGRYSI

SEQ ID NO: 8484 - protein, 9 aa, Artificial Sequence
  Polypyrimidine tract-binding protein 3 (113-121)
YYTPITPHL

SEQ ID NO: 8485 - protein, 9 aa, Artificial Sequence
  Small nuclear ribonucleoprotein E (28-36)
RSRIQVWLY

SEQ ID NO: 8486 - protein, 21 aa, Artificial Sequence
  60S ribosomal protein L30 (95-115)
AIIDPGDSDIIRSMPEQTGEK

SEQ ID NO: 8487 - protein, 10 aa, Artificial Sequence
  Catenin beta-1 (115-124)
DAAHPTNVQR

SEQ ID NO: 8488 - protein, 9 aa, Artificial Sequence
  HLA class I histocompatibility antigen, B-51 alpha chain (161-169)
DTAAQITQR

SEQ ID NO: 8489 - protein, 9 aa, Artificial Sequence
  Heterogeneous nuclear ribonucleoproteins A2/B1 (139-147)
DTIEIITDR

SEQ ID NO: 8490 - protein, 9 aa, Artificial Sequence
  Translocon-associated protein subunit beta isoform X1 (107-115)
DVSHTVVLR

SEQ ID NO: 8491 - protein, 9 aa, Artificial Sequence
  Actin, aortic smooth muscle (366-374)
EAGPSIVHR

SEQ ID NO: 8492 - protein, 9 aa, Artificial Sequence
  Fructose-bisphosphate aldolase A (35-43)
ESTGSIAKR

SEQ ID NO: 8493 - protein, 9 aa, Artificial Sequence
  SH3 domain-binding glutamic acid-rich-like protein 3 (23-31)
EVTRILDGK

SEQ ID NO: 8494 - protein, 16 aa, Artificial Sequence
  HLA class II histocompatibility antigen, DRB1-4 beta chain (62-77)
HQEEYVRFDSDVGEYR

SEQ ID NO: 8495 - protein, 15 aa, Artificial Sequence
  Sodium/potassium-transporting ATPase subunit alpha-1 (60-74)
IVVYTGDRTVMGRIA

SEQ ID NO: 8496 - protein, 16 aa, Artificial Sequence
  NEDD4 family-interacting protein 1 (63-78)
KPPSYNVATTLPSYDE

SEQ ID NO: 8497 - protein, 9 aa, Artificial Sequence
  Keratin, type I cytoskeletal 18 (32-40)
RLASYLDRV

SEQ ID NO: 8498 - protein, 9 aa, Artificial Sequence
  60S ribosomal protein L24 (86-94)
SLADIMAKR

SEQ ID NO: 8499 - protein, 11 aa, Artificial Sequence
  HLA class I histocompatibility antigen, Cw-4 alpha chain (133-143)
TAADTAAQITR

SEQ ID NO: 8500 - protein, 10 aa, Artificial Sequence
  WD repeat-containing protein 6 (462-471)
TLFPGKVHSL

SEQ ID NO: 8501 - protein, 9 aa, Artificial Sequence
  Fatty acid-binding protein, liver (114-122)
TLGDIVFKR

SEQ ID NO: 8502 - protein, 9 aa, Artificial Sequence
  Actin, aortic smooth muscle (204-212)
TTAEREIVR

SEQ ID NO: 8503 - protein, 9 aa, Artificial Sequence
  Polymeric immunoglobulin receptor (656-664)
VAVGVARAR

SEQ ID NO: 8504 - protein, 9 aa, Artificial Sequence
  DAZ-associated protein 2 (63-71)
AAFPGASLY

SEQ ID NO: 8505 - protein, 9 aa, Artificial Sequence
  Kelch-like protein 24 (576-584)
AAMPRPVSY

SEQ ID NO: 8506 - protein, 9 aa, Artificial Sequence
  Lck-interacting transmembrane adapter 1 (159-167)
AASPVVAEY

SEQ ID NO: 8507 - protein, 9 aa, Artificial Sequence
  Cysteine-rich protein 2-binding protein (154-162)
AFIEKHWTF

SEQ ID NO: 8508 - protein, 9 aa, Artificial Sequence
  Bifunctional 3'-phosphoadenosine 5'-phosphosulfate synthase 2 (479-487)
AIFPSPMLY

SEQ ID NO: 8509 - protein, 9 aa, Artificial Sequence
  Bifunctional 3'-phosphoadenosine 5'-phosphosulfate synthase 1 (488-496)
AIFPSPMMY

SEQ ID NO: 8510 - protein, 9 aa, Artificial Sequence
  Phosphatidylinositol 5-phosphate 4-kinase type-2 alpha (356-364)
AIIDILTHY

SEQ ID NO: 8511 - protein, 10 aa, Artificial Sequence
  Calsyntenin-3 (69-78)
ALDKDAPLRY

SEQ ID NO: 8512 - protein, 9 aa, Artificial Sequence
  Ras-related protein Rab-20 (156-164)
ALYKKILKY

SEQ ID NO: 8513 - protein, 9 aa, Artificial Sequence
  Structure-specific endonuclease subunit SLX4 (1765-1773)
ALYQKVLLY

SEQ ID NO: 8514 - protein, 11 aa, Artificial Sequence
  Myosin regulatory light polypeptide 9 (24-34)
AMFDQSQIQEF

SEQ ID NO: 8515 - protein, 9 aa, Artificial Sequence
  60S ribosomal protein L6 (61-69)
AMYSRKAMY

SEQ ID NO: 8516 - protein, 9 aa, Artificial Sequence
  Junction plakoglobin (472-480)
AQNSVRLNY

SEQ ID NO: 8517 - protein, 9 aa, Artificial Sequence
  Protein transport protein Sec23B (125-133)
AQSPLIFLY

SEQ ID NO: 8518 - protein, 9 aa, Artificial Sequence
  Centrosome-associated protein 350 (330-338)
ATAPPAPAY

SEQ ID NO: 8519 - protein, 9 aa, Artificial Sequence
  Protein transport protein Sec31A (61-69)
ATFSSSHRY

SEQ ID NO: 8520 - protein, 10 aa, Artificial Sequence
  E3 ubiquitin/ISG15 ligase TRIM25 (592-601)
AVADKVHLMY

SEQ ID NO: 8521 - protein, 9 aa, Artificial Sequence
  StAR-related lipid transfer protein 5 (12-20)
AVAEKMLQY

SEQ ID NO: 8522 - protein, 9 aa, Artificial Sequence
  WASH complex subunit 7 (624-632)
AVDAARLHY

SEQ ID NO: 8523 - protein, 10 aa, Artificial Sequence
  Nuclear pore membraneoprotein 210 (497-506)
AVDPTSGQLY

SEQ ID NO: 8524 - protein, 9 aa, Artificial Sequence
  Lysocardiolipin acyltransferase 1 (91-99)
AVHDITVAY

SEQ ID NO: 8525 - protein, 10 aa, Artificial Sequence
  Methylsterol monooxygenase 1 (15-24)
AVIEDTWHYF

SEQ ID NO: 8526 - protein, 9 aa, Artificial Sequence
  V-type proton ATPase subunit d 1 (111-119)
AYLESFYKF

SEQ ID NO: 8527 - protein, 9 aa, Artificial Sequence
  Protein S100-A9 (67-75)
DTNADKQLS

SEQ ID NO: 8528 - protein, 9 aa, Artificial Sequence
  Transcription elongation factor SPT6 (339-347)
DVYNHFLLY

SEQ ID NO: 8529 - protein, 9 aa, Artificial Sequence
  MOB kinase activator 1A (175-183)
EEAHLNTSF

SEQ ID NO: 8530 - protein, 9 aa, Artificial Sequence
  HLA class II histocompatibility antigen, DP alpha 1 chain (43-51)
EEFGQAFSF

SEQ ID NO: 8531 - protein, 9 aa, Artificial Sequence
  Protein arginine N-methyltransferase 1 (319-327)
EEIFGTIGM

SEQ ID NO: 8532 - protein, 10 aa, Artificial Sequence
  Puromycin-sensitive aminopeptidase-like protein (113-122)
EEIHATGFNY

SEQ ID NO: 8533 - protein, 10 aa, Artificial Sequence
  Myocyte-specific enhancer factor 2D (127-136)
EELDGLFRRY

SEQ ID NO: 8534 - protein, 9 aa, Artificial Sequence
  Ribosomal RNA processing protein 36 homolog (132-140)
EVFDKTYQF

SEQ ID NO: 8535 - protein, 9 aa, Artificial Sequence
  G1/S-specific cyclin-D3 (26-34)
EVFPLAMNY

SEQ ID NO: 8536 - protein, 9 aa, Artificial Sequence
  Golgi resident protein GCP60 (490-498)
EVYAGSHQY

SEQ ID NO: 8537 - protein, 9 aa, Artificial Sequence
  Dipeptidyl peptidase 1 (375-383)
EVYDDFLHY

SEQ ID NO: 8538 - protein, 9 aa, Artificial Sequence
  Sphingolipid delta(4)-desaturase DES1 (176-184)
FINPKPITY

SEQ ID NO: 8539 - protein, 9 aa, Artificial Sequence
  Histone acetyltransferase KAT6A (600-608)
FLDHKTLYY

SEQ ID NO: 8540 - protein, 9 aa, Artificial Sequence
  Putative ATP-dependent RNA helicase DHX57 (392-400)
FLYDKALTF

SEQ ID NO: 8541 - protein, 9 aa, Artificial Sequence
  Calnexin (230-238)
FTDKKTHLY

SEQ ID NO: 8542 - protein, 10 aa, Artificial Sequence
  Histone-arginine methyltransferase CARM1 (584-593)
FTMGGPAISM

SEQ ID NO: 8543 - protein, 14 aa, Artificial Sequence
  Myosin regulatory light chain 12A (164-177)
FTRILKHGAKDKDD

SEQ ID NO: 8544 - protein, 9 aa, Artificial Sequence
  Plastin-3 (324-332)
FVANLFNKY

SEQ ID NO: 8545 - protein, 11 aa, Artificial Sequence
  U5 small nuclear ribonucleoprotein 200 kDa helicase (1845-1855)
FVAPATGAHNY

SEQ ID NO: 8546 - protein, 14 aa, Artificial Sequence
  Cytochrome c oxidase subunit NDUFA4 (19-32)
FVFIGTGATGATLY

SEQ ID NO: 8547 - protein, 9 aa, Artificial Sequence
  Ras-related protein Rab-5B (92-100)
FVKGQFHEY

SEQ ID NO: 8548 - protein, 9 aa, Artificial Sequence
  COP9 signalosome complex subunit 6 (275-283)
FVNKFNVLY

SEQ ID NO: 8549 - protein, 10 aa, Artificial Sequence
  Probable ATP-dependent RNA helicase DDX5 (549-558)
FVSAGIQTSF

SEQ ID NO: 8550 - protein, 10 aa, Artificial Sequence
  Transmembrane protein 258 (37-46)
FVYEVTSTKY

SEQ ID NO: 8551 - protein, 12 aa, Artificial Sequence
  Dermcidin (97-108)
GAVHDVKDVLDS

SEQ ID NO: 8552 - protein, 9 aa, Artificial Sequence
  Vacuolar protein sorting-associated protein 51 homolog (121-129)
GAYGQAVRY

SEQ ID NO: 8553 - protein, 9 aa, Artificial Sequence
  Histone H2B type 2-F (76-84)
GEASRLAHY

SEQ ID NO: 8554 - protein, 9 aa, Artificial Sequence
  RING finger and transmembrane domain-containing protein 2 (264-272)
GIADFVLKY

SEQ ID NO: 8555 - protein, 12 aa, Artificial Sequence
  Myosin-9 (1952-1963)
GKADGAEAKPAE

SEQ ID NO: 8556 - protein, 9 aa, Artificial Sequence
  Inositol 1,4,5-trisphosphate receptor type 3 (2333-2341)
GLFAHELFY

SEQ ID NO: 8557 - protein, 9 aa, Artificial Sequence
  E3 ubiquitin-protein ligase TRIM56 (486-494)
GLLPRPIFY

SEQ ID NO: 8558 - protein, 9 aa, Artificial Sequence
  Protein transport protein Sec16A (1463-1471)
GLWGHALLL

SEQ ID NO: 8559 - protein, 9 aa, Artificial Sequence
  DNA repair protein complementing XP-C cells (639-647)
GLYKNHPLY

SEQ ID NO: 8560 - protein, 14 aa, Artificial Sequence
  Heterogeneous nuclear ribonucleoproteins A2/B1 (241-254)
GNYGSGNYNDFGNY

SEQ ID NO: 8561 - protein, 8 aa, Artificial Sequence
  HLA class I histocompatibility antigen, B-15 alpha chain (25-32)
GSHSMRYF

SEQ ID NO: 8562 - protein, 9 aa, Artificial Sequence
  HLA class I histocompatibility antigen, B-35 alpha chain (25-33)
GSHSMRYFY

SEQ ID NO: 8563 - protein, 9 aa, Artificial Sequence
  Heterogeneous nuclear ribonucleoprotein A1 (310-318)
GSYNDFGNY

SEQ ID NO: 8564 - protein, 9 aa, Artificial Sequence
  E3 ubiquitin-protein ligase MARCH6 (620-628)
GTAKIHELY

SEQ ID NO: 8565 - protein, 9 aa, Artificial Sequence
  DNA topoisomerase 2-beta (560-568)
GTATKHLTY

SEQ ID NO: 8566 - protein, 9 aa, Artificial Sequence
  Filamin-A (2181-2189)
GTHTVSVKY

SEQ ID NO: 8567 - protein, 9 aa, Artificial Sequence
  Ubiquitin-conjugating enzyme E2 C (71-79)
GTVYEDLRY

SEQ ID NO: 8568 - protein, 10 aa, Artificial Sequence
  Cold shock domain-containing protein E1 (28-37)
GVIEKLLTSY

SEQ ID NO: 8569 - protein, 13 aa, Artificial Sequence
  ADP-ribosylation factor GTPase-activating protein 2 (469-481)
GVMNSLQDRYGSY

SEQ ID NO: 8570 - protein, 9 aa, Artificial Sequence
  Bardet-Biedl syndrome 2 protein (227-235)
GVYDKTSRY

SEQ ID NO: 8571 - protein, 9 aa, Artificial Sequence
  Coatomer subunit alpha (633-641)
GYPEVALHF

SEQ ID NO: 8572 - protein, 11 aa, Artificial Sequence
  Protein S100-A8 (27-37)
HAVYRDDLKKL

SEQ ID NO: 8573 - protein, 9 aa, Artificial Sequence
  Zinc finger protein 608 (1347-1355)
HAYPYPQMY

SEQ ID NO: 8574 - protein, 9 aa, Artificial Sequence
  Sphingolipid delta(4)-desaturase DES1 (228-236)
HFIAEHYMF

SEQ ID NO: 8575 - protein, 9 aa, Artificial Sequence
  BTB/POZ domain-containing protein KCTD1 (41-49)
HIDVGGHMY

SEQ ID NO: 8576 - protein, 9 aa, Artificial Sequence
  RNA-binding protein with serine-rich domain 1 (176-184)
HIMEIFSTY

SEQ ID NO: 8577 - protein, 9 aa, Artificial Sequence
  Laminin subunit beta-3 (1158-1166)
HINGRVLYY

SEQ ID NO: 8578 - protein, 9 aa, Artificial Sequence
  UDP-N-acetylglucosamine-dolichyl-phosphate N-acetylglucosaminephosphotransferase (55-63)
HLDLGILYY

SEQ ID NO: 8579 - protein, 9 aa, Artificial Sequence
  Nuclear pore complex protein Nup205 (240-248)
HLYGSLLYY

SEQ ID NO: 8580 - protein, 9 aa, Artificial Sequence
  DAZ-associated protein 1 (397-405)
HNVQGFHPY

SEQ ID NO: 8581 - protein, 9 aa, Artificial Sequence
  pre-mRNA 3' end processing protein WDR33 (19-27)
HQAPRQLFY

SEQ ID NO: 8582 - protein, 9 aa, Artificial Sequence
  Nuclear receptor corepressor 2 (34-42)
HTDVGLLEY

SEQ ID NO: 8583 - protein, 9 aa, Artificial Sequence
  Ribosomal protein S6 kinase alpha-1 (517-525)
HTIGKTVEY

SEQ ID NO: 8584 - protein, 9 aa, Artificial Sequence
  Type II inositol 3,4-bisphosphate 4-phosphatase (657-665)
HTVGLIVQY

SEQ ID NO: 8585 - protein, 10 aa, Artificial Sequence
  Zinc finger CCHC domain-containing protein 14 (172-181)
HVDLDSGLRY

SEQ ID NO: 8586 - protein, 11 aa, Artificial Sequence
  Prefoldin subunit 5 (94-104)
HVLIDVGTGYY

SEQ ID NO: 8587 - protein, 9 aa, Artificial Sequence
  Erythroid differentiation-related factor 1 (370-378)
HVNGIVQKY

SEQ ID NO: 8588 - protein, 10 aa, Artificial Sequence
  Protein prenyltransferase alpha subunit repeat-containing protein 1 (213-222)
HVSDHSGFHY

SEQ ID NO: 8589 - protein, 9 aa, Artificial Sequence
  Peroxisomal membrane protein PEX14 (119-127)
IAFGFHQLY

SEQ ID NO: 8590 - protein, 9 aa, Artificial Sequence
  Protein FAM134C (153-161)
IFIRNVLLF

SEQ ID NO: 8591 - protein, 9 aa, Artificial Sequence
  Probable ATP-dependent RNA helicase DDX5 (604-612)
IGYPMPTGY

SEQ ID NO: 8592 - protein, 9 aa, Artificial Sequence
  Dolichol kinase (352-360)
IIFDRPLLY

SEQ ID NO: 8593 - protein, 9 aa, Artificial Sequence
  Dolichyl-diphosphooligosaccharide-proteinosyltransferase subunit 2 (410-418)
ILSPLLLLF

SEQ ID NO: 8594 - protein, 11 aa, Artificial Sequence
  Beta-2-microglobulin (21-31)
IQRTPKIQVYS

SEQ ID NO: 8595 - protein, 13 aa, Artificial Sequence
  Beta-2-microglobulin (21-33)
IQRTPKIQVYSRH

SEQ ID NO: 8596 - protein, 9 aa, Artificial Sequence
  HLA class I histocompatibility antigen, B-52 alpha chain (90-98)
ISKTNTQTY

SEQ ID NO: 8597 - protein, 11 aa, Artificial Sequence
  Eukaryotic peptide chain release factor subunit 1 (307-317)
IVYENLDIMRY

SEQ ID NO: 8598 - protein, 9 aa, Artificial Sequence
  Cyclin-H (138-146)
KALEQILEY

SEQ ID NO: 8599 - protein, 10 aa, Artificial Sequence
  Proliferating cell nuclear antigen (240-249)
KIADMGHLKY

SEQ ID NO: 8600 - protein, 9 aa, Artificial Sequence
  Protein LAP2 (282-290)
KIDENQLMY

SEQ ID NO: 8601 - protein, 9 aa, Artificial Sequence
  Beta-2-microglobulin (90-98)
KIVKWDRDM

SEQ ID NO: 8602 - protein, 10 aa, Artificial Sequence
  Ras GTPase-activating-like protein IQGAP1 (94-103)
KIYDREQTRY

SEQ ID NO: 8603 - protein, 9 aa, Artificial Sequence
  Phosphorylated CTD-interacting factor 1 (363-371)
KIYHISLEY

SEQ ID NO: 8604 - protein, 9 aa, Artificial Sequence
  Cytoplasmic FMR1-interacting protein 1 (739-747)
KLADQIFAY

SEQ ID NO: 8605 - protein, 10 aa, Artificial Sequence
  Cytoplasmic FMR1-interacting protein 1 (739-748)
KLADQIFAYY

SEQ ID NO: 8606 - protein, 9 aa, Artificial Sequence
  Golgi-associated PDZ and coiled-coil motif-containing protein (394-402)
KLDDLHTLY

SEQ ID NO: 8607 - protein, 14 aa, Artificial Sequence
  Oxysterol-binding protein-related protein 8 (705-718)
KLFELDPLTGEWHY

SEQ ID NO: 8608 - protein, 10 aa, Artificial Sequence
  SHC SH2 domain-binding protein 1 (262-271)
KLIENPLLRY

SEQ ID NO: 8609 - protein, 9 aa, Artificial Sequence
  Proteasome subunit alpha type (67-75)
KLNEYLLQY

SEQ ID NO: 8610 - protein, 9 aa, Artificial Sequence
  Protein farnesyltransferase/geranylgeranyltransferase type-1 subunit alpha (211-219)
KLWDNELQY

SEQ ID NO: 8611 - protein, 9 aa, Artificial Sequence
  Crooked neck-like protein 1 (615-623)
KLYEKFLEF

SEQ ID NO: 8612 - protein, 9 aa, Artificial Sequence
  Tetratricopeptide repeat protein 21B (693-701)
KMADIYLKH

SEQ ID NO: 8613 - protein, 9 aa, Artificial Sequence
  SPRY domain-containing protein 3 (14-22)
KMDDLNLHY

SEQ ID NO: 8614 - protein, 9 aa, Artificial Sequence
  Phosphatidylinositol 4-kinase alpha (321-329)
KMLRDTLYY

SEQ ID NO: 8615 - protein, 9 aa, Artificial Sequence
  Platelet-activating factor acetylhydrolase IB subunit alpha (95-103)
KMWEVQTGY

SEQ ID NO: 8616 - protein, 10 aa, Artificial Sequence
  Clathrin heavy chain 1 (1209-1218)
KMYDAAKLLY

SEQ ID NO: 8617 - protein, 9 aa, Artificial Sequence
  Elongation factor Tu GTP-binding domain-containing protein 1 (71-79)
KSSAISLHY

SEQ ID NO: 8618 - protein, 9 aa, Artificial Sequence
  Elongation factor 2 (71-79)
KSTAISLFY

SEQ ID NO: 8619 - protein, 9 aa, Artificial Sequence
  Flotillin-2 (214-222)
KTAEAQLAY

SEQ ID NO: 8620 - protein, 9 aa, Artificial Sequence
  Cytoplasmic dynein 1 heavy chain 1 (2633-2641)
KTFDHYCEY

SEQ ID NO: 8621 - protein, 9 aa, Artificial Sequence
  Protein RMD5 homolog B (13-21)
KVLQKFLTY

SEQ ID NO: 8622 - protein, 9 aa, Artificial Sequence
  Probable E3 ubiquitin-protein ligase HECTD4 (700-708)
KVLSRALMY

SEQ ID NO: 8623 - protein, 9 aa, Artificial Sequence
  Cartilage-associated protein (329-337)
KVMQQNLVY

SEQ ID NO: 8624 - protein, 9 aa, Artificial Sequence
  KIF1-binding protein (205-213)
KVYTHNLYY

SEQ ID NO: 8625 - protein, 10 aa, Artificial Sequence
  Protein S100-A9 (66-75)
LDTNADKQLS

SEQ ID NO: 8626 - protein, 8 aa, Artificial Sequence
  Engulfment and cell motility protein 2 (574-581)
LNHKVLHY

SEQ ID NO: 8627 - protein, 9 aa, Artificial Sequence
  CDNA FLJ25829 fis, clone TST08126 (128-136)
MTAKLQTPY

SEQ ID NO: 8628 - protein, 9 aa, Artificial Sequence
  HLA class II histocompatibility antigen, DQ alpha 1 chain (247-255)
NAAERRGPL

SEQ ID NO: 8629 - protein, 9 aa, Artificial Sequence
  Heat shock protein beta-1 (177-185)
NEITIPVTF

SEQ ID NO: 8630 - protein, 9 aa, Artificial Sequence
  Serpin B12 (169-177)
NKTQTILFY

SEQ ID NO: 8631 - protein, 9 aa, Artificial Sequence
  S1 RNA-binding domain-containing protein 1 (240-248)
NTIPFIIRY

SEQ ID NO: 8632 - protein, 14 aa, Artificial Sequence
  Mediator of RNA polymerase II transcription subunit 12 (2010-2023)
NTQPQPSTNIFGRY

SEQ ID NO: 8633 - protein, 9 aa, Artificial Sequence
  Agrin (56-64)
NVDPVQHTY

SEQ ID NO: 8634 - protein, 9 aa, Artificial Sequence
  Abhydrolase domain-containing protein 2 (306-314)
NVMRKFHGY

SEQ ID NO: 8635 - protein, 10 aa, Artificial Sequence
  Tubulin beta chain (103-112)
QIFRPDNFVF

SEQ ID NO: 8636 - protein, 9 aa, Artificial Sequence
  WD repeat-containing protein 19 (527-535)
QLYEKGLYY

SEQ ID NO: 8637 - protein, 9 aa, Artificial Sequence
  Serine/threonine-protein phosphatase 2A 56 kDa regulatory subunit epsilon isoform (358-366)
QVAERALYY

SEQ ID NO: 8638 - protein, 10 aa, Artificial Sequence
  Muskelin (626-635)
QVDPLSALKY

SEQ ID NO: 8639 - protein, 9 aa, Artificial Sequence
  Coatomer subunit beta' (136-144)
QVFEGHTHY

SEQ ID NO: 8640 - protein, 9 aa, Artificial Sequence
  DNA polymerase epsilon subunit 3 (39-47)
RAASVFVLY

SEQ ID NO: 8641 - protein, 9 aa, Artificial Sequence
  Histone H2B type 1-A (94-102)
REIQTAVRL

SEQ ID NO: 8642 - protein, 9 aa, Artificial Sequence
  26S proteasome non-ATPase regulatory subunit 3 (294-302)
RIKAIQLEY

SEQ ID NO: 8643 - protein, 11 aa, Artificial Sequence
  DNA polymerase delta catalytic subunit (386-396)
RIMDPDVITGY

SEQ ID NO: 8644 - protein, 9 aa, Artificial Sequence
  Protein TASOR (185-193)
RLDDKKFLY

SEQ ID NO: 8645 - protein, 9 aa, Artificial Sequence
  F-box only protein 7 (266-274)
RLFKDQLVY

SEQ ID NO: 8646 - protein, 11 aa, Artificial Sequence
  Zinc finger protein 419 (43-53)
RLLDDAQRLLY

SEQ ID NO: 8647 - protein, 9 aa, Artificial Sequence
  Angiomotin (17-25)
RLLQEQLRY

SEQ ID NO: 8648 - protein, 9 aa, Artificial Sequence
  Protein Smaug homolog 2 (103-111)
RLLQKVLAY

SEQ ID NO: 8649 - protein, 9 aa, Artificial Sequence
  N-acetylgalactosamine-6-sulfatase (376-384)
RLMDRPIFY

SEQ ID NO: 8650 - protein, 9 aa, Artificial Sequence
  Beta-catenin-like protein 1 (330-338)
RLMELHFKY

SEQ ID NO: 8651 - protein, 9 aa, Artificial Sequence
  Mitochondrial folate transporter/carrier (251-259)
RLQDQHMFY

SEQ ID NO: 8652 - protein, 9 aa, Artificial Sequence
  Probable C-mannosyltransferase DPY19L3 (411-419)
RLSDTLLFY

SEQ ID NO: 8653 - protein, 9 aa, Artificial Sequence
  Vacuolar protein sorting-associated protein 4A (30-38)
RLYQHAVEY

SEQ ID NO: 8654 - protein, 11 aa, Artificial Sequence
  Src substrate cortactin (94-104)
RMDKSAVGHEY

SEQ ID NO: 8655 - protein, 9 aa, Artificial Sequence
  ATP-dependent RNA helicase DDX42 (292-300)
RMFDMGFEY

SEQ ID NO: 8656 - protein, 9 aa, Artificial Sequence
  Signal peptidase complex catalytic subunit SEC11A (12-20)
RMNKRQLYY

SEQ ID NO: 8657 - protein, 9 aa, Artificial Sequence
  60S ribosomal protein L24 (47-55)
RQINWTVLY

SEQ ID NO: 8658 - protein, 13 aa, Artificial Sequence
  Annexin A5 (245-257)
RSIPAYLAETLYY

SEQ ID NO: 8659 - protein, 9 aa, Artificial Sequence
  Nuclear pore complex protein Nup160 (729-737)
RTAPLLLSY

SEQ ID NO: 8660 - protein, 10 aa, Artificial Sequence
  Matrin-3 (149-158)
RTEEGPTLSY

SEQ ID NO: 8661 - protein, 9 aa, Artificial Sequence
  26S proteasome non-ATPase regulatory subunit 2 (673-681)
RTFGHLLRY

SEQ ID NO: 8662 - protein, 9 aa, Artificial Sequence
  Tyrosine-protein phosphatase non-receptor type 23 (1272-1280)
RTGAFALLY

SEQ ID NO: 8663 - protein, 9 aa, Artificial Sequence
  Msx2-interacting protein (176-184)
RTLQHGLYY

SEQ ID NO: 8664 - protein, 9 aa, Artificial Sequence
  NFX1-type zinc finger-containing protein 1 (334-342)
RTMPIYPTY

SEQ ID NO: 8665 - protein, 9 aa, Artificial Sequence
  UPF0505 protein C16orf62 (929-937)
RTMVKTLEY

SEQ ID NO: 8666 - protein, 12 aa, Artificial Sequence
  DNA damage-regulated autophagy modulator protein 2 (236-247)
RVEANLHGLTLY

SEQ ID NO: 8667 - protein, 13 aa, Artificial Sequence
  Eukaryotic translation initiation factor 3 subunit C-like protein (873-885)
RVFDHKQGTYGGY

SEQ ID NO: 8668 - protein, 10 aa, Artificial Sequence
  Semaphorin-4C (339-348)
RVFEGPYKEY

SEQ ID NO: 8669 - protein, 9 aa, Artificial Sequence
  Niemann-Pick C1 protein (1077-1085)
RVFPYSVFY

SEQ ID NO: 8670 - protein, 11 aa, Artificial Sequence
  26S protease regulatory subunit 4 (249-259)
RVVGSELIQKY

SEQ ID NO: 8671 - protein, 9 aa, Artificial Sequence
  HLA class II histocompatibility antigen, DRB1-4 beta chain (123-131)
RVYPEVTVY

SEQ ID NO: 8672 - protein, 9 aa, Artificial Sequence
  Sorting nexin-17 (432-440)
SASDVHGNF

SEQ ID NO: 8673 - protein, 9 aa, Artificial Sequence
  Splicing factor 3B subunit 3 (351-359)
SEFGNHYLY

SEQ ID NO: 8674 - protein, 9 aa, Artificial Sequence
  Mitotic checkpoint protein BUB3 (241-249)
SFHNIHNTF

SEQ ID NO: 8675 - protein, 9 aa, Artificial Sequence
  Transmembrane 9 superfamily member 2 (545-553)
SIWSHQMYY

SEQ ID NO: 8676 - protein, 10 aa, Artificial Sequence
  Vimentin (87-96)
SLADAINTEF

SEQ ID NO: 8677 - protein, 10 aa, Artificial Sequence
  Protein PRRC1 (47-56)
SMESFPPLAY

SEQ ID NO: 8678 - protein, 9 aa, Artificial Sequence
  Heterogeneous nuclear ribonucleoprotein A1 (304-312)
SNFGGGGSY

SEQ ID NO: 8679 - protein, 12 aa, Artificial Sequence
  Cyclin-dependent kinase 19 (490-501)
SQYHPSHQAHRY

SEQ ID NO: 8680 - protein, 9 aa, Artificial Sequence
  Pre-mRNA-splicing factor ATP-dependent RNA helicase DHX15 (227-235)
SSAKTILKY

SEQ ID NO: 8681 - protein, 9 aa, Artificial Sequence
  Probable glutamate-tRNA ligase, mitochondrial (249-257)
STAKHLLLY

SEQ ID NO: 8682 - protein, 9 aa, Artificial Sequence
  Chondroitin sulfate proteoglycan 4 (745-753)
STDPQHHAY

SEQ ID NO: 8683 - protein, 9 aa, Artificial Sequence
  Peroxisomal carnitine O-octanoyltransferase (8-16)
STEERTFQY

SEQ ID NO: 8684 - protein, 11 aa, Artificial Sequence
  WD repeat-containing protein 44 (34-44)
STFKETENTAY

SEQ ID NO: 8685 - protein, 9 aa, Artificial Sequence
  Serine/threonine-protein kinase mTOR (1766-1774)
STIPKVLQY

SEQ ID NO: 8686 - protein, 9 aa, Artificial Sequence
  ADP-ribosylation factor GTPase-activating protein 3 (97-105)
STNDTNAKY

SEQ ID NO: 8687 - protein, 11 aa, Artificial Sequence
  Cytochrome c oxidase subunit 1 (9-19)
STNHKDIGTLY

SEQ ID NO: 8688 - protein, 9 aa, Artificial Sequence
  Syntaxin-binding protein 1 (511-519)
STTAVSARY

SEQ ID NO: 8689 - protein, 9 aa, Artificial Sequence
  Regulator of microtubule dynamics protein 1 (209-217)
STYEKALGY

SEQ ID NO: 8690 - protein, 9 aa, Artificial Sequence
  GPI transamidase component PIG-S (261-269)
SVDSQILYY

SEQ ID NO: 8691 - protein, 9 aa, Artificial Sequence
  Ubiquitin-protein ligase E3C (150-158)
SVIEQILHY

SEQ ID NO: 8692 - protein, 9 aa, Artificial Sequence
  Transcription elongation regulator 1 (419-427)
TADGKTYYY

SEQ ID NO: 8693 - protein, 9 aa, Artificial Sequence
  Sorting nexin-9 (146-154)
TAFGHPQAY

SEQ ID NO: 8694 - protein, 9 aa, Artificial Sequence
  Heterogeneous nuclear ribonucleoprotein F (301-309)
TENDIYNFF

SEQ ID NO: 8695 - protein, 12 aa, Artificial Sequence
  N-acetylglucosamine-6-sulfatase (192-203)
TIDPELLGKMNY

SEQ ID NO: 8696 - protein, 11 aa, Artificial Sequence
  Thymosin beta-4 (34-44)
TIEQEKQAGES

SEQ ID NO: 8697 - protein, 9 aa, Artificial Sequence
  Integral membrane protein GPR155 (369-377)
TMDPKPLAY

SEQ ID NO: 8698 - protein, 9 aa, Artificial Sequence
  Intraflagellar transport protein 122 homolog (937-945)
TMLGKFYHF

SEQ ID NO: 8699 - protein, 11 aa, Artificial Sequence
  Cytochrome c oxidase subunit 2 (182-192)
TTFTATRPGVY

SEQ ID NO: 8700 - protein, 12 aa, Artificial Sequence
  Cytochrome c oxidase subunit 2 (182-193)
TTFTATRPGVYY

SEQ ID NO: 8701 - protein, 9 aa, Artificial Sequence
  Calponin-3 (136-144)
TTIDIGVKY

SEQ ID NO: 8702 - protein, 9 aa, Artificial Sequence
  E3 ubiquitin/ISG15 ligase TRIM25 (593-601)
VADKVHLMY

SEQ ID NO: 8703 - protein, 9 aa, Artificial Sequence
  T-complex protein 1 subunit eta (127-135)
VAFKKTFSY

SEQ ID NO: 8704 - protein, 9 aa, Artificial Sequence
  General transcription factor II-I (324-332)
VEELFERKY

SEQ ID NO: 8705 - protein, 9 aa, Artificial Sequence
  Inactive hydroxysteroid dehydrogenase-like protein 1 (133-141)
VFYPYPQYF

SEQ ID NO: 8706 - protein, 9 aa, Artificial Sequence
  NADH dehydrogenase (ubiquinone) 1 alpha subcomplex subunit 3 (30-38)
VILPPLSPY

SEQ ID NO: 8707 - protein, 9 aa, Artificial Sequence
  Tribbles homolog 3 (126-134)
VLAGTQLLY

SEQ ID NO: 8708 - protein, 9 aa, Artificial Sequence
  Transketolase (50-58)
VLFFHTMRY

SEQ ID NO: 8709 - protein, 9 aa, Artificial Sequence
  Unconventional myosin-Id (415-423)
VLKQEQEEY

SEQ ID NO: 8710 - protein, 9 aa, Artificial Sequence
  Calcyclin-binding protein (63-71)
VVAPITTGY

SEQ ID NO: 8711 - protein, 9 aa, Artificial Sequence
  Nischarin (324-332)
VVDNLQHLY

SEQ ID NO: 8712 - protein, 9 aa, Artificial Sequence
  F-box only protein 31 (26-34)
VYAKLLHRY

SEQ ID NO: 8713 - protein, 9 aa, Artificial Sequence
  DNA replication licensing factor MCM7 (101-109)
VYIEHRLMM

SEQ ID NO: 8714 - protein, 9 aa, Artificial Sequence
  MORN repeat-containing protein 1 (31-39)
VYPNSFFRY

SEQ ID NO: 8715 - protein, 10 aa, Artificial Sequence
  Glycoprotein endo-alpha-1,2-mannosidase-like protein (101-110)
VYSDLHAFYY

SEQ ID NO: 8716 - protein, 10 aa, Artificial Sequence
  Prolyl endopeptidase (178-187)
WTHDGKGMFY

SEQ ID NO: 8717 - protein, 9 aa, Artificial Sequence
  Vimentin (53-61)
YASSPGGVY

SEQ ID NO: 8718 - protein, 9 aa, Artificial Sequence
  NmrA-like family domain-containing protein 1 (73-81)
YATFIVTNY

SEQ ID NO: 8719 - protein, 9 aa, Artificial Sequence
  Leukocyte receptor cluster member 8 (111-119)
YAYPYSYYY

SEQ ID NO: 8720 - protein, 12 aa, Artificial Sequence
  RNMT-activating mini protein (107-118)
YGYNQRPPYGYY

SEQ ID NO: 8721 - protein, 9 aa, Artificial Sequence
  Serine/threonine-protein kinase NLK (415-423)
YLDEGRLRY

SEQ ID NO: 8722 - protein, 9 aa, Artificial Sequence
  chromosome 1 open reading frame 9, isoform CRA_e (1086-1094)
YLEELSQRY

SEQ ID NO: 8723 - protein, 9 aa, Artificial Sequence
  Chromodomain-helicase-DNA-binding protein 1-like (385-393)
YMDYRGYSY

SEQ ID NO: 8724 - protein, 10 aa, Artificial Sequence
  RNMT-activating mini protein (109-118)
YNQRPPYGYY

SEQ ID NO: 8725 - protein, 10 aa, Artificial Sequence
  ATP-dependent RNA helicase DDX3X (643-652)
YNSDGYGGNY

SEQ ID NO: 8726 - protein, 9 aa, Artificial Sequence
  Histone acetyltransferase KAT6B (551-559)
YSSPYPQEY

SEQ ID NO: 8727 - protein, 9 aa, Artificial Sequence
  RNA-binding protein EWS (21-29)
YTAQPTQGY

SEQ ID NO: 8728 - protein, 10 aa, Artificial Sequence
  Protein FAM26F (92-101)
YTFNPKGQYY

SEQ ID NO: 8729 - protein, 9 aa, Artificial Sequence
  MORN repeat-containing protein 2 (30-38)
YTFPNGAKY

SEQ ID NO: 8730 - protein, 9 aa, Artificial Sequence
  Probable ATP-dependent RNA helicase YTHDC2 (389-397)
YTNKEMLKY

SEQ ID NO: 8731 - protein, 9 aa, Artificial Sequence
  Probable dolichyl pyrophosphate Glc1Man9GlcNAc2 alpha-1,3-glucosyltransferase (204-212)
YVAPAYGVY

SEQ ID NO: 8732 - protein, 9 aa, Artificial Sequence
  Filamin-A (1581-1589)
YVPDVTGRY

SEQ ID NO: 8733 - protein, 9 aa, Artificial Sequence
  Leucine-rich repeat-containing protein 1 (26-34)
YVPEEIYRY

SEQ ID NO: 8734 - protein, 9 aa, Artificial Sequence
  Ectopic P granules protein 5 homolog (664-672)
YVSDHWAQY

SEQ ID NO: 8735 - protein, 9 aa, Artificial Sequence
  Sphingomyelin phosphodiesterase 2 (133-141)
YVTHLHAEY

SEQ ID NO: 8736 - protein, 10 aa, Artificial Sequence
  MORN repeat-containing protein 1 (30-39)
YVYPNSFFRY

SEQ ID NO: 8737 - protein, 9 aa, Artificial Sequence
  Protein polybromo-1 (132-140)
YYKPDSPEY

SEQ ID NO: 8738 - protein, 9 aa, Artificial Sequence
  V-type proton ATPase subunit d 1 (7-15)
YYPEYKLLF

SEQ ID NO: 8739 - protein, 17 aa, Artificial Sequence
  Calmodulin (133-149)
GDGQVNYEEFVQMMTAK

SEQ ID NO: 8740 - protein, 23 aa, Artificial Sequence
  Myosin regulatory light chain 12B (150-172)
KKGNFNYIEFTRILKHGAKDKDD

SEQ ID NO: 8741 - protein, 21 aa, Artificial Sequence
  HLA class I histocompatibility antigen, B-55 alpha chain (52-72)
VDDTQFVRFDSDAASPREEPR

SEQ ID NO: 8742 - protein, 13 aa, Artificial Sequence
  Sorting nexin-6 (245-257)
AADDYNRIGSSLY

SEQ ID NO: 8743 - protein, 9 aa, Artificial Sequence
  Peptidyl-prolyl cis-trans isomerase-like 2 (27-35)
AIDEDVLRY

SEQ ID NO: 8744 - protein, 9 aa, Artificial Sequence
  Nucleolar GTP-binding protein 2 (416-424)
ALDEKIAKY

SEQ ID NO: 8745 - protein, 10 aa, Artificial Sequence
  Serine/threonine-protein kinase MRCK alpha (1203-1212)
ALDGRETDFY

SEQ ID NO: 8746 - protein, 12 aa, Artificial Sequence
  Cleavage stimulation factor subunit 3 (120-131)
ALDKIGMEIMSY

SEQ ID NO: 8747 - protein, 12 aa, Artificial Sequence
  2-oxoisovalerate dehydrogenase subunit alpha, mitochondrial (80-91)
ALDNTDLVFGQY

SEQ ID NO: 8748 - protein, 13 aa, Artificial Sequence
  Structural maintenance of chromosomes protein 1A (1161-1173)
ALDNTNIGKVANY

SEQ ID NO: 8749 - protein, 9 aa, Artificial Sequence
  Ubiquitin-like modifier-activating enzyme 6 (331-339)
ALDQFQEKY

SEQ ID NO: 8750 - protein, 9 aa, Artificial Sequence
  SWI/SNF-related matrix-associated actin-dependent regulator of chromatin subfamily A member 5 (920-928)
ALDTKIGRY

SEQ ID NO: 8751 - protein, 9 aa, Artificial Sequence
  Eukaryotic translation initiation factor 3 subunit E (54-62)
AMDVYKNLY

SEQ ID NO: 8752 - protein, 9 aa, Artificial Sequence
  SAFB-like transcription modulator (735-743)
ARFGHGSDY

SEQ ID NO: 8753 - protein, 10 aa, Artificial Sequence
  Putative heat shock protein HSP 90-beta 2 (88-97)
ASDALDKIRY

SEQ ID NO: 8754 - protein, 10 aa, Artificial Sequence
  Gelsolin (362-371)
ASDFITKMDY

SEQ ID NO: 8755 - protein, 9 aa, Artificial Sequence
  Ubiquitin-like protein 3 (32-40)
ASDIAKHVY

SEQ ID NO: 8756 - protein, 11 aa, Artificial Sequence
  Proteasome-associated protein ECM29 homolog (1073-1083)
ASDLSQPDLVY

SEQ ID NO: 8757 - protein, 9 aa, Artificial Sequence
  Kelch repeat and BTB domain-containing protein 6 (147-155)
ASDMLQLEY

SEQ ID NO: 8758 - protein, 9 aa, Artificial Sequence
  GPN-loop GTPase 2 (210-218)
ASDPFFRHY

SEQ ID NO: 8759 - protein, 11 aa, Artificial Sequence
  WD repeat-containing protein 81 (817-827)
ASDPIHTFDLY

SEQ ID NO: 8760 - protein, 9 aa, Artificial Sequence
  DNA-directed RNA polymerase II subunit RPB2 (1103-1111)
ASDPYQVHV

SEQ ID NO: 8761 - protein, 9 aa, Artificial Sequence
  DDB1- and CUL4-associated factor 13 (368-376)
ASDRNIVLY

SEQ ID NO: 8762 - protein, 10 aa, Artificial Sequence
  Probable ATP-dependent RNA helicase DHX37 (105-114)
ASEAEMRLFY

SEQ ID NO: 8763 - protein, 12 aa, Artificial Sequence
  Platelet-activating factor acetylhydrolase IB subunit alpha (4-15)
ASEDATIKVWDY

SEQ ID NO: 8764 - protein, 10 aa, Artificial Sequence
  T-complex protein 11-like protein 1 (271-280)
ASEDLMTQKY

SEQ ID NO: 8765 - protein, 10 aa, Artificial Sequence
  Splicing factor 3B subunit 3 (350-359)
ASEFGNHYLY

SEQ ID NO: 8766 - protein, 13 aa, Artificial Sequence
  Aspartate-tRNA ligase, cytoplasmic (226-238)
ASEGGANVFTVSY

SEQ ID NO: 8767 - protein, 14 aa, Artificial Sequence
  MAP kinase-activated protein kinase 2 (163-176)
ASEIMKSIGEAIQY

SEQ ID NO: 8768 - protein, 13 aa, Artificial Sequence
  Thyroid receptor-interacting protein 11 (84-96)
ASEIQIKQQSTSY

SEQ ID NO: 8769 - protein, 12 aa, Artificial Sequence
  Clusterin-associated protein 1 (160-171)
ASEITSKGASLY

SEQ ID NO: 8770 - protein, 9 aa, Artificial Sequence
  Cleavage stimulation factor subunit 3 (70-78)
ASELKALGY

SEQ ID NO: 8771 - protein, 12 aa, Artificial Sequence
  DNA-dependent protein kinase catalytic subunit (2173-2184)
ASENNGGEGIHY

SEQ ID NO: 8772 - protein, 10 aa, Artificial Sequence
  Exocyst complex component 4 (72-81)
ASEPSAQLSY

SEQ ID NO: 8773 - protein, 12 aa, Artificial Sequence
  Nucleoporin NUP188 homolog (766-777)
ASEQQALHTVQY

SEQ ID NO: 8774 - protein, 11 aa, Artificial Sequence
  Ubiquitin carboxyl-terminal hydrolase 32 (141-151)
ASETAGSGFLY

SEQ ID NO: 8775 - protein, 10 aa, Artificial Sequence
  Low-density lipoprotein receptor class A domain-containing protein 3 (250-259)
ASEVGSPPSY

SEQ ID NO: 8776 - protein, 9 aa, Artificial Sequence
  Homeodomain-interacting protein kinase 2 (404-412)
ASEYDQIRY

SEQ ID NO: 8777 - protein, 12 aa, Artificial Sequence
  Amyloid protein-binding protein 2 (330-341)
ATAHEDLAYSSY

SEQ ID NO: 8778 - protein, 13 aa, Artificial Sequence
  Zinc finger protein 318 (1381-1393)
ATANAKDLYDIFY

SEQ ID NO: 8779 - protein, 13 aa, Artificial Sequence
  E3 ubiquitin-protein ligase BRE1B (85-97)
ATDDATLLIVNRY

SEQ ID NO: 8780 - protein, 9 aa, Artificial Sequence
  O-acetyl-ADP-ribose deacetylase 1 (142-150)
ATDIKITVY

SEQ ID NO: 8781 - protein, 9 aa, Artificial Sequence
  Coiled-coil domain-containing protein 141 (498-506)
ATDLAQHLY

SEQ ID NO: 8782 - protein, 10 aa, Artificial Sequence
  Endoribonuclease Dicer (239-248)
ATDLVVLDRY

SEQ ID NO: 8783 - protein, 10 aa, Artificial Sequence
  EVI5-like protein (131-140)
ATDMPVKNQY

SEQ ID NO: 8784 - protein, 9 aa, Artificial Sequence
  Dystonin (4021-4029)
ATDRFRSLY

SEQ ID NO: 8785 - protein, 13 aa, Artificial Sequence
  MAP kinase-interacting serine/threonine-protein kinase 2 (71-83)
ATDSFSGRFEDVY

SEQ ID NO: 8786 - protein, 10 aa, Artificial Sequence
  Nicotinamide phosphoribosyltransferase (14-23)
ATDSYKVTHY

SEQ ID NO: 8787 - protein, 13 aa, Artificial Sequence
  Spectrin beta chain, non-erythrocytic 1 (6-18)
ATDYDNIEIQQQY

SEQ ID NO: 8788 - protein, 9 aa, Artificial Sequence
  Fibronectin type III domain-containing protein 3B (348-356)
ATDYHVRVY

SEQ ID NO: 8789 - protein, 11 aa, Artificial Sequence
  Coatomer subunit beta' (480-490)
ATEESFFILKY

SEQ ID NO: 8790 - protein, 9 aa, Artificial Sequence
  Cytoplasmic dynein 1 heavy chain 1 (3596-3604)
ATEFIMNEY

SEQ ID NO: 8791 - protein, 13 aa, Artificial Sequence
  T-complex protein 1 subunit theta (414-426)
ATEIELAKQITSY

SEQ ID NO: 8792 - protein, 14 aa, Artificial Sequence
  Protein PRRC2A (1894-1907)
ATELGKLPAGGVLY

SEQ ID NO: 8793 - protein, 9 aa, Artificial Sequence
  Eukaryotic translation initiation factor 3 subunit D (422-430)
ATELKNNSY

SEQ ID NO: 8794 - protein, 9 aa, Artificial Sequence
  Serine/threonine-protein kinase SMG1 (2701-2709)
ATEMTLQRY

SEQ ID NO: 8795 - protein, 12 aa, Artificial Sequence
  Protein phosphatase 1G (149-160)
ATMTIEELLTRY

SEQ ID NO: 8796 - protein, 11 aa, Artificial Sequence
  Alpha-catulin (401-411)
ATQLAADLLKY

SEQ ID NO: 8797 - protein, 10 aa, Artificial Sequence
  60S ribosomal protein L8 (27-36)
AVDFAERHGY

SEQ ID NO: 8798 - protein, 10 aa, Artificial Sequence
  Nuclear pore complex protein Nup160 (1036-1045)
AVDLMTHNYY

SEQ ID NO: 8799 - protein, 9 aa, Artificial Sequence
  Chromodomain-helicase-DNA-binding protein 8 (2348-2356)
AVDPRFLAY

SEQ ID NO: 8800 - protein, 12 aa, Artificial Sequence
  Short transient receptor potential channel 4-associated protein (530-541)
AVESFLRGTTSY

SEQ ID NO: 8801 - protein, 10 aa, Artificial Sequence
  TOX high mobility group box family member 4 (107-116)
DLDHSIGTQY

SEQ ID NO: 8802 - protein, 11 aa, Artificial Sequence
  Nuclear factor of activated T-cells 5 (12-22)
DLDLESPKSLY

SEQ ID NO: 8803 - protein, 9 aa, Artificial Sequence
  Myocyte-specific enhancer factor 2A (61-69)
DMDKVLLKY

SEQ ID NO: 8804 - protein, 10 aa, Artificial Sequence
  Elongator complex protein 5 (57-66)
DSDINNRLVY

SEQ ID NO: 8805 - protein, 12 aa, Artificial Sequence
  Tubulin beta chain (39-50)
DSDLQLDRISVY

SEQ ID NO: 8806 - protein, 13 aa, Artificial Sequence
  Tubulin beta chain (39-51)
DSDLQLDRISVYY

SEQ ID NO: 8807 - protein, 13 aa, Artificial Sequence
  Protein FAM13A (271-283)
DSDPMLSPRFYAY

SEQ ID NO: 8808 - protein, 13 aa, Artificial Sequence
  Eukaryotic translation initiation factor 4B (229-241)
DSDRYRDGYRDGY

SEQ ID NO: 8809 - protein, 12 aa, Artificial Sequence
  Eukaryotic translation initiation factor 4 gamma 3 (1501-1512)
DSDTEKELQALY

SEQ ID NO: 8810 - protein, 12 aa, Artificial Sequence
  GPI transamidase component PIG-T (51-62)
DSELQREGVSHY

SEQ ID NO: 8811 - protein, 10 aa, Artificial Sequence
  Inositol 1,4,5-trisphosphate receptor type 1 (2098-2107)
DSENAERILY

SEQ ID NO: 8812 - protein, 9 aa, Artificial Sequence
  Transcription factor E2F3 (290-298)
DSENQRLAY

SEQ ID NO: 8813 - protein, 12 aa, Artificial Sequence
  Zinc finger MYND domain-containing protein 11 (140-151)
DSEQADIARMLY

SEQ ID NO: 8814 - protein, 9 aa, Artificial Sequence
  Tubulin-specific chaperone cofactor E-like protein (299-307)
DSERFFIRY

SEQ ID NO: 8815 - protein, 11 aa, Artificial Sequence
  Matrin-3 (233-243)
DSFFGETSHNY

SEQ ID NO: 8816 - protein, 11 aa, Artificial Sequence
  Calcium and integrin-binding protein 1 (100-110)
DTATPDIKSHY

SEQ ID NO: 8817 - protein, 12 aa, Artificial Sequence
  SAFB-like transcription modulator (732-743)
DTDARFGHGSDY

SEQ ID NO: 8818 - protein, 9 aa, Artificial Sequence
  Calnexin (92-100)
DTDDEIAKY

SEQ ID NO: 8819 - protein, 10 aa, Artificial Sequence
  Phospholipid scramblase 4 (159-168)
DTDDFTRNAY

SEQ ID NO: 8820 - protein, 12 aa, Artificial Sequence
  Complex I intermediate-associated protein 30, mitochondrial (226-237)
DTDFFQRTNQMY

SEQ ID NO: 8821 - protein, 10 aa, Artificial Sequence
  Aspartate-tRNA ligase, cytoplasmic (384-393)
DTDFYILDKY

SEQ ID NO: 8822 - protein, 9 aa, Artificial Sequence
  Replication protein A 70 kDa DNA-binding subunit (504-512)
DTEFPNFKY

SEQ ID NO: 8823 - protein, 9 aa, Artificial Sequence
  Adenylyl cyclase-associated protein 1 (344-352)
DTELKQVAY

SEQ ID NO: 8824 - protein, 9 aa, Artificial Sequence
  Actin, cytoplasmic 2 (77-85)
DVDIRKDLY

SEQ ID NO: 8825 - protein, 9 aa, Artificial Sequence
  Heterogeneous nuclear ribonucleoprotein C-like 1 (32-40)
DVEAIFSKY

SEQ ID NO: 8826 - protein, 10 aa, Artificial Sequence
  Protein arginine N-methyltransferase 7 (368-377)
EAEPHPLWEY

SEQ ID NO: 8827 - protein, 9 aa, Artificial Sequence
  Melanoma-associated antigen D2 (338-346)
EIDKNDHLY

SEQ ID NO: 8828 - protein, 11 aa, Artificial Sequence
  Annexin A1 (305-315)
EIDMNDIKAFY

SEQ ID NO: 8829 - protein, 10 aa, Artificial Sequence
  LIM domain kinase 2 (716-725)
ELDHTVSMQY

SEQ ID NO: 8830 - protein, 11 aa, Artificial Sequence
  NADPH-cytochrome P450 reductase (304-314)
ELDISDSKIRY

SEQ ID NO: 8831 - protein, 11 aa, Artificial Sequence
  Splicing factor 3B subunit 2 (811-821)
ELDPMAMTQKY

SEQ ID NO: 8832 - protein, 11 aa, Artificial Sequence
  Peptidyl-prolyl cis-trans isomerase D (301-311)
ELDPSNTKALY

SEQ ID NO: 8833 - protein, 9 aa, Artificial Sequence
  Ankyrin repeat and IBR domain-containing protein 1 (229-237)
ELDRFMHYY

SEQ ID NO: 8834 - protein, 9 aa, Artificial Sequence
  Plectin (502-510)
ELEDSTLRY

SEQ ID NO: 8835 - protein, 10 aa, Artificial Sequence
  Small G protein signaling modulator 2 (307-316)
ELEKSVYWDY

SEQ ID NO: 8836 - protein, 10 aa, Artificial Sequence
  GPI transamidase component PIG-T (53-62)
ELQREGVSHY

SEQ ID NO: 8837 - protein, 11 aa, Artificial Sequence
  60S ribosomal protein L4 (254-264)
ESAFRKLDELY

SEQ ID NO: 8838 - protein, 10 aa, Artificial Sequence
  Protein-glutamate O-methyltransferase (101-110)
ESDGKSRWFY

SEQ ID NO: 8839 - protein, 9 aa, Artificial Sequence
  Guanine nucleotide-binding protein subunit beta-5 (239-247)
ESDINSVRY

SEQ ID NO: 8840 - protein, 9 aa, Artificial Sequence
  Zinc transporter 5 (26-34)
ESDSRQIFY

SEQ ID NO: 8841 - protein, 14 aa, Artificial Sequence
  Proteasome activator complex subunit 3 (182-195)
ESEAASYLDQISRY

SEQ ID NO: 8842 - protein, 12 aa, Artificial Sequence
  Myotubularin-related protein 5 (821-832)
ESENRSYEGTLY

SEQ ID NO: 8843 - protein, 10 aa, Artificial Sequence
  Asparagine synthetase (glutamine-hydrolyzing) (389-398)
ESERLLRELY

SEQ ID NO: 8844 - protein, 11 aa, Artificial Sequence
  Peptidyl-prolyl cis-trans isomerase FKBP8 (167-177)
ETAMVTADSKY

SEQ ID NO: 8845 - protein, 10 aa, Artificial Sequence
  Eyes absent homolog 3 (87-96)
ETAYPGQTQY

SEQ ID NO: 8846 - protein, 10 aa, Artificial Sequence
  ATP-dependent RNA helicase DDX24 (571-580)
ETDEKDFYLY

SEQ ID NO: 8847 - protein, 11 aa, Artificial Sequence
  TFIIH basal transcription factor complex helicase XPD subunit (251-261)
ETDEQRLRDEY

SEQ ID NO: 8848 - protein, 10 aa, Artificial Sequence
  Nicotinamide riboside kinase 1 (46-55)
ETDKNGFLQY

SEQ ID NO: 8849 - protein, 9 aa, Artificial Sequence
  RNA binding motif protein 22 (245-253)
ETDLRNHFY

SEQ ID NO: 8850 - protein, 14 aa, Artificial Sequence
  PCNA-interacting partner (146-159)
ETDLSIPTSPTSKY

SEQ ID NO: 8851 - protein, 9 aa, Artificial Sequence
  Beta-mannosidase (118-126)
ETDNMFNRY

SEQ ID NO: 8852 - protein, 13 aa, Artificial Sequence
  Probable ATP-dependent RNA helicase DDX17 (61-73)
ETDRAGYANGSGY

SEQ ID NO: 8853 - protein, 9 aa, Artificial Sequence
  Synergin gamma (1198-1206)
ETDSFKLAY

SEQ ID NO: 8854 - protein, 11 aa, Artificial Sequence
  Probable ATP-dependent RNA helicase DDX56 (239-249)
ETEEDKFLLLY

SEQ ID NO: 8855 - protein, 10 aa, Artificial Sequence
  Kremen protein 2 (104-113)
ETEEGIYWRY

SEQ ID NO: 8856 - protein, 9 aa, Artificial Sequence
  Intron-binding protein aquarius (887-895)
ETEKDFSRY

SEQ ID NO: 8857 - protein, 12 aa, Artificial Sequence
  Guanine nucleotide exchange factor VAV3 (683-694)
ETELINRVNSTY

SEQ ID NO: 8858 - protein, 13 aa, Artificial Sequence
  DNA polymerase zeta catalytic subunit (827-839)
ETEQSFGLYGNKY

SEQ ID NO: 8859 - protein, 11 aa, Artificial Sequence
  Protein transport protein Sec16A (1244-1254)
ETERFRELLLY

SEQ ID NO: 8860 - protein, 9 aa, Artificial Sequence
  Dynamin-2 (455-463)
ETERIVTTY

SEQ ID NO: 8861 - protein, 9 aa, Artificial Sequence
  Integrin alpha-3 (1043-1051)
ETERLTDDY

SEQ ID NO: 8862 - protein, 11 aa, Artificial Sequence
  DnaJ homolog subfamily C member 7 (29-39)
ETFKEQGNAYY

SEQ ID NO: 8863 - protein, 11 aa, Artificial Sequence
  HLA class I histocompatibility antigen, B-8 alpha chain (21-31)
ETWAGSHSMRY

SEQ ID NO: 8864 - protein, 10 aa, Artificial Sequence
  Lamin-B1 (229-238)
EVDSGRQIEY

SEQ ID NO: 8865 - protein, 10 aa, Artificial Sequence
  Fatty acid synthase (1244-1253)
EVLAGHGHLY

SEQ ID NO: 8866 - protein, 11 aa, Artificial Sequence
  Histone acetyltransferase type B catalytic subunit (191-201)
FIDVDDERWHY

SEQ ID NO: 8867 - protein, 11 aa, Artificial Sequence
  Protein Smaug homolog 2 (118-128)
FIEESRQLLSY

SEQ ID NO: 8868 - protein, 12 aa, Artificial Sequence
  Interferon regulatory factor 2-binding protein-like (420-431)
FIEYPTGSGNVY

SEQ ID NO: 8869 - protein, 13 aa, Artificial Sequence
  Protein YIF1B (69-81)
FLADPVSNMAMAY

SEQ ID NO: 8870 - protein, 9 aa, Artificial Sequence
  Asparagine synthetase (glutamine-hydrolyzing) (337-345)
FLDHRFSSY

SEQ ID NO: 8871 - protein, 10 aa, Artificial Sequence
  Phosphatidylinositol-binding clathrin assembly protein (109-118)
FLDKSGLQGY

SEQ ID NO: 8872 - protein, 11 aa, Artificial Sequence
  Rho GTPase-activating protein 35 (733-743)
FLDPASAGIGY

SEQ ID NO: 8873 - protein, 11 aa, Artificial Sequence
  Ubiquitin carboxyl-terminal hydrolase 8 (552-562)
FLDPITGTFRY

SEQ ID NO: 8874 - protein, 12 aa, Artificial Sequence
  Group XV phospholipase A2 (126-137)
FLDPSKSSVGSY

SEQ ID NO: 8875 - protein, 11 aa, Artificial Sequence
  Microtubule-associated protein 4 (103-113)
FLEEKMAYQEY

SEQ ID NO: 8876 - protein, 12 aa, Artificial Sequence
  Histone H4 (31-42)
FLENVIRDAVTY

SEQ ID NO: 8877 - protein, 10 aa, Artificial Sequence
  Adenylate cyclase type 3 (615-624)
FMDPEMETRY

SEQ ID NO: 8878 - protein, 10 aa, Artificial Sequence
  Probable C-mannosyltransferase DPY19L1 (397-406)
FMEKETPLRY

SEQ ID NO: 8879 - protein, 12 aa, Artificial Sequence
  Probable E3 ubiquitin-protein ligase HERC1 (402-413)
FSDAQTIEAGQY

SEQ ID NO: 8880 - protein, 10 aa, Artificial Sequence
  Iduronate 2-sulfatase (424-433)
FSDIHAGELY

SEQ ID NO: 8881 - protein, 11 aa, Artificial Sequence
  Iduronate 2-sulfatase (424-434)
FSDIHAGELYF

SEQ ID NO: 8882 - protein, 10 aa, Artificial Sequence
  Type 2 lactosamine alpha-2,3-sialyltransferase (283-292)
FSDLKSPLHY

SEQ ID NO: 8883 - protein, 11 aa, Artificial Sequence
  Type 2 lactosamine alpha-2,3-sialyltransferase (175-185)
FSDLKSPLHYY

SEQ ID NO: 8884 - protein, 11 aa, Artificial Sequence
  Rab GTPase-activating protein 1-like (338-348)
FSDLNLEAHMY

SEQ ID NO: 8885 - protein, 11 aa, Artificial Sequence
  DAZ-associated protein 1 (363-373)
FSDPSQQPPSY

SEQ ID NO: 8886 - protein, 9 aa, Artificial Sequence
  Nipped-B-like protein (37-45)
FSDSKIQKY

SEQ ID NO: 8887 - protein, 11 aa, Artificial Sequence
  Protein FAM65B (671-681)
FSDTETEKHSY

SEQ ID NO: 8888 - protein, 11 aa, Artificial Sequence
  Probable E3 ubiquitin-protein ligase HERC1 (3591-3601)
FSEDRPFAVGY

SEQ ID NO: 8889 - protein, 10 aa, Artificial Sequence
  Programmed cell death protein 6 (82-91)
FSEFTGVWKY

SEQ ID NO: 8890 - protein, 9 aa, Artificial Sequence
  Ubiquitin carboxyl-terminal hydrolase 32 (135-143)
FSEGEKVNY

SEQ ID NO: 8891 - protein, 11 aa, Artificial Sequence
  Heat shock protein HSP 90-beta (342-352)
FSELAEDKENY

SEQ ID NO: 8892 - protein, 11 aa, Artificial Sequence
  Uncharacterized protein C14orf119 (120-130)
FSEPDFVAKFY

SEQ ID NO: 8893 - protein, 11 aa, Artificial Sequence
  Fc receptor-like A (67-77)
FSEPFHLIVSY

SEQ ID NO: 8894 - protein, 9 aa, Artificial Sequence
  cAMP-dependent protein kinase catalytic subunit alpha (131-139)
FSEPHARFY

SEQ ID NO: 8895 - protein, 9 aa, Artificial Sequence
  Serine/threonine-protein kinase N1 (718-726)
FSEPRAIFY

SEQ ID NO: 8896 - protein, 11 aa, Artificial Sequence
  Protein C-ets-1 (175-185)
FSEPSFITESY

SEQ ID NO: 8897 - protein, 9 aa, Artificial Sequence
  Protein RCC2 (314-322)
FSEQVAMGY

SEQ ID NO: 8898 - protein, 12 aa, Artificial Sequence
  DNA ligase 3 (127-138)
FSESGGDMKEWY

SEQ ID NO: 8899 - protein, 10 aa, Artificial Sequence
  ETS translocation variant 5 (318-327)
FSSSHEGFSY

SEQ ID NO: 8900 - protein, 9 aa, Artificial Sequence
  FAS-associated factor 1 (337-345)
FTAEFSSRY

SEQ ID NO: 8901 - protein, 9 aa, Artificial Sequence
  Staphylococcal nuclease domain-containing protein 1 (607-615)
FTAERSSYY

SEQ ID NO: 8902 - protein, 9 aa, Artificial Sequence
  LanC-like protein 1 (199-207)
FTAKSPLMY

SEQ ID NO: 8903 - protein, 9 aa, Artificial Sequence
  Cytochrome c oxidase subunit 2 (184-192)
FTATRPGVY

SEQ ID NO: 8904 - protein, 11 aa, Artificial Sequence
  Splicing factor 3A subunit 3 (130-140)
FTDEEGYGRYL

SEQ ID NO: 8905 - protein, 8 aa, Artificial Sequence
  Gem-associated protein 5 (895-902)
FTDRATLY

SEQ ID NO: 8906 - protein, 13 aa, Artificial Sequence
  Geranylgeranyl transferase type-2 subunit alpha (166-178)
FTDSLITRNFSNY

SEQ ID NO: 8907 - protein, 10 aa, Artificial Sequence
  CLIP-associating protein 2 (80-89)
FTDVPSIQIY

SEQ ID NO: 8908 - protein, 12 aa, Artificial Sequence
  Basic leucine zipper and W2 domain-containing protein 1 (149-160)
FTEAGLKELSEY

SEQ ID NO: 8909 - protein, 11 aa, Artificial Sequence
  Heat shock protein HSP 90-alpha (546-556)
FTELAEDKENY

SEQ ID NO: 8910 - protein, 11 aa, Artificial Sequence
  Zinc finger protein 746 (547-557)
FTERSKLIDHY

SEQ ID NO: 8911 - protein, 12 aa, Artificial Sequence
  Coatomer subunit gamma-1 (402-413)
FTMLREEGGFEY

SEQ ID NO: 8912 - protein, 9 aa, Artificial Sequence
  Cytoplasmic dynein 1 heavy chain 1 (2784-2792)
FTQDTQPHY

SEQ ID NO: 8913 - protein, 11 aa, Artificial Sequence
  Dolichyl-diphosphooligosaccharide-proteinosyltransferase subunit 2 (449-459)
FVAEPDNKNVY

SEQ ID NO: 8914 - protein, 12 aa, Artificial Sequence
  G patch domain and KOW motifs-containing protein (365-376)
FVDNMYKGGQYY

SEQ ID NO: 8915 - protein, 12 aa, Artificial Sequence
  Retinoid-inducible serine carboxypeptidase (63-74)
FVDNPVGTGFSY

SEQ ID NO: 8916 - protein, 10 aa, Artificial Sequence
  Kelch-like protein 15 (325-334)
FVDPYPVNKY

SEQ ID NO: 8917 - protein, 10 aa, Artificial Sequence
  Abhydrolase domain-containing protein 2 (146-155)
FVDYAQKNGY

SEQ ID NO: 8918 - protein, 13 aa, Artificial Sequence
  Trafficking protein particle complex subunit 3 (115-127)
FVELPDNHSSLIY

SEQ ID NO: 8919 - protein, 12 aa, Artificial Sequence
  ADP-ribosylation factor 5 (24-35)
GLDAAGKTTILY

SEQ ID NO: 8920 - protein, 9 aa, Artificial Sequence
  Exosome complex exonuclease RRP44 (757-765)
GMDNDFHHY

SEQ ID NO: 8921 - protein, 9 aa, Artificial Sequence
  Archaemetzincin-2 (148-156)
GSDFYSMHY

SEQ ID NO: 8922 - protein, 13 aa, Artificial Sequence
  Xaa-Pro aminopeptidase 1 (256-268)
GSDVEHNPVFFSY

SEQ ID NO: 8923 - protein, 9 aa, Artificial Sequence
  Sorbitol dehydrogenase (46-54)
GSDVHYWEY

SEQ ID NO: 8924 - protein, 9 aa, Artificial Sequence
  Eukaryotic translation initiation factor 3 subunit D (443-451)
GSEYLKLGY

SEQ ID NO: 8925 - protein, 13 aa, Artificial Sequence
  PMS1 protein homolog 1 (39-51)
GTAVMNNMESFQY

SEQ ID NO: 8926 - protein, 10 aa, Artificial Sequence
  SEC23-interacting protein (313-322)
GTDGGRYDVY

SEQ ID NO: 8927 - protein, 9 aa, Artificial Sequence
  Syndetin (394-402)
GTDLSIFKY

SEQ ID NO: 8928 - protein, 12 aa, Artificial Sequence
  X-ray repair cross-complementing protein 5 (63-74)
GTDNPLSGGDQY

SEQ ID NO: 8929 - protein, 11 aa, Artificial Sequence
  DNA replication licensing factor MCM5 (45-55)
GTDRTGFTFKY

SEQ ID NO: 8930 - protein, 9 aa, Artificial Sequence
  WD repeat-containing protein 19 (157-165)
GTDTGVVQY

SEQ ID NO: 8931 - protein, 14 aa, Artificial Sequence
  E3 ubiquitin-protein ligase MYCBP2 (1371-1384)
GTDVNAGQIPQLLY

SEQ ID NO: 8932 - protein, 13 aa, Artificial Sequence
  CDK5 regulatory subunit-associated protein 3 (77-89)
GTEASTKNIFGRY

SEQ ID NO: 8933 - protein, 10 aa, Artificial Sequence
  Endophilin-B1 (5-14)
GTEFGPGTAY

SEQ ID NO: 8934 - protein, 12 aa, Artificial Sequence
  GON-4-like protein (39-50)
GTEFPNPLISKY

SEQ ID NO: 8935 - protein, 12 aa, Artificial Sequence
  Nucleolin (451-462)
GTEIDGRSISLY

SEQ ID NO: 8936 - protein, 13 aa, Artificial Sequence
  Nucleolin (451-463)
GTEIDGRSISLYY

SEQ ID NO: 8937 - protein, 10 aa, Artificial Sequence
  MHC class I polypeptide-related sequence A (50-59)
HLDGQPFLRY

SEQ ID NO: 8938 - protein, 10 aa, Artificial Sequence
  Zinc finger protein with KRAB and SCAN domains 5 (234-243)
HLDQSQKSLY

SEQ ID NO: 8939 - protein, 9 aa, Artificial Sequence
  Zinc finger CW-type PWWP domain protein 1 (230-238)
HLDSLPSKY

SEQ ID NO: 8940 - protein, 12 aa, Artificial Sequence
  Conserved oligomeric Golgi complex subunit 6 (528-539)
HLDTLINEQASY

SEQ ID NO: 8941 - protein, 10 aa, Artificial Sequence
  Unconventional myosin-Va (41-50)
HLEEGKDLEY

SEQ ID NO: 8942 - protein, 10 aa, Artificial Sequence
  N6-adenosine-methyltransferase 70 kDa subunit (322-331)
HMDTCKYVHY

SEQ ID NO: 8943 - protein, 10 aa, Artificial Sequence
  5'-nucleotidase domain-containing protein 1 (266-275)
HSDIFPARHY

SEQ ID NO: 8944 - protein, 9 aa, Artificial Sequence
  Endoribonuclease Dicer (118-126)
HSDLKVGEY

SEQ ID NO: 8945 - protein, 10 aa, Artificial Sequence
  Arylamine N-acetyltransferase 1 (177-186)
HSDLLEDSKY

SEQ ID NO: 8946 - protein, 12 aa, Artificial Sequence
  Protein virilizer homolog (783-794)
HSDLLGTLHNLY

SEQ ID NO: 8947 - protein, 11 aa, Artificial Sequence
  CD82 antigen (257-267)
HSEDYSKVPKY

SEQ ID NO: 8948 - protein, 12 aa, Artificial Sequence
  Ribonucleoside-diphosphate reductase subunit M2 B (68-79)
HSEMYSLLIDTY

SEQ ID NO: 8949 - protein, 9 aa, Artificial Sequence
  Histone deacetylase 5 (338-346)
HSEYHTLLY

SEQ ID NO: 8950 - protein, 12 aa, Artificial Sequence
  Acyl-CoA desaturase (302-313)
HSFPYDYSASEY

SEQ ID NO: 8951 - protein, 10 aa, Artificial Sequence
  Elongation factor Tu, mitochondrial (124-133)
HTDCPGHADY

SEQ ID NO: 8952 - protein, 10 aa, Artificial Sequence
  Lathosterol oxidase (229-238)
HTDHHMFFDY

SEQ ID NO: 8953 - protein, 10 aa, Artificial Sequence
  NADPH-cytochrome P450 reductase (250-259)
HTDIDAAKVY

SEQ ID NO: 8954 - protein, 10 aa, Artificial Sequence
  Synembryn-B (153-162)
HTDIRSQLRY

SEQ ID NO: 8955 - protein, 10 aa, Artificial Sequence
  Mitochondrial enolase superfamily member 1 (29-38)
HTDPDYSAAY

SEQ ID NO: 8956 - protein, 13 aa, Artificial Sequence
  Serine/threonine-protein kinase N2 (593-605)
HTDVFSEPRAVFY

SEQ ID NO: 8957 - protein, 11 aa, Artificial Sequence
  RNA polymerase II subunit A C-terminal domain phosphatase (601-611)
HTDYYAKYDRY

SEQ ID NO: 8958 - protein, 13 aa, Artificial Sequence
  Hermansky-Pudlak syndrome 1 protein (98-110)
HTESEGDLRRKLY

SEQ ID NO: 8959 - protein, 9 aa, Artificial Sequence
  Protein 4.1 (461-469)
HTETKTITY

SEQ ID NO: 8960 - protein, 11 aa, Artificial Sequence
  Histone-lysine N-methyltransferase, H3 lysine-79 specific (273-283)
HTIDRTILENY

SEQ ID NO: 8961 - protein, 11 aa, Artificial Sequence
  Lysine-specific demethylase 2A (212-222)
HVDFGGTSVWY

SEQ ID NO: 8962 - protein, 12 aa, Artificial Sequence
  MICOS complex subunit MIC27 (90-101)
IMDTVQFGKDAY

SEQ ID NO: 8963 - protein, 13 aa, Artificial Sequence
  TP53-regulating kinase (188-200)
ISALPEDKGVDLY

SEQ ID NO: 8964 - protein, 13 aa, Artificial Sequence
  Tubulin beta-4B chain (24-36)
ISDEHGIDPTGTY

SEQ ID NO: 8965 - protein, 12 aa, Artificial Sequence
  Integrin alpha-V (214-225)
ISDQVAEIVSKY

SEQ ID NO: 8966 - protein, 9 aa, Artificial Sequence
  Reticulon-4 (90-98)
ISEELVQKY

SEQ ID NO: 8967 - protein, 13 aa, Artificial Sequence
  Adenosylhomocysteinase (155-167)
ISEETTTGVHNLY

SEQ ID NO: 8968 - protein, 9 aa, Artificial Sequence
  Protein disulfide-isomerase A5 (349-357)
ISEFPTLKY

SEQ ID NO: 8969 - protein, 11 aa, Artificial Sequence
  ATP-citrate synthase (6-16)
ISEQTGKELLY

SEQ ID NO: 8970 - protein, 11 aa, Artificial Sequence
  Oligoribonuclease, mitochondrial (168-178)
ISESIKELQFY

SEQ ID NO: 8971 - protein, 11 aa, Artificial Sequence
  Protein furry homolog-like (546-556)
ISETPIIGNKY

SEQ ID NO: 8972 - protein, 9 aa, Artificial Sequence
  Bone morphogenetic protein receptor type-2 (374-382)
ISEVGTIRY

SEQ ID NO: 8973 - protein, 11 aa, Artificial Sequence
  Beta-hexosaminidase subunit alpha (436-446)
ISYGPDWKDFY

SEQ ID NO: 8974 - protein, 11 aa, Artificial Sequence
  N-alpha-acetyltransferase 16, NatA auxiliary subunit (155-165)
ITDDQFDFHTY

SEQ ID NO: 8975 - protein, 10 aa, Artificial Sequence
  Trophinin (580-589)
ITDEFVKQKY

SEQ ID NO: 8976 - protein, 8 aa, Artificial Sequence
  Vacuolar protein sorting-associated protein 13C (155-162)
ITDIHIKY

SEQ ID NO: 8977 - protein, 13 aa, Artificial Sequence
  Filamin-A (1793-1805)
ITDNKDGTVTVRY

SEQ ID NO: 8978 - protein, 14 aa, Artificial Sequence
  Sorting nexin-1 (149-162)
ITDPEKIGDGMNAY

SEQ ID NO: 8979 - protein, 12 aa, Artificial Sequence
  F-box/LRR-repeat protein 14 (130-141)
ITDSSLGRIAQY

SEQ ID NO: 8980 - protein, 13 aa, Artificial Sequence
  Coatomer subunit gamma-1 (131-143)
ITDSTMLQAIERY

SEQ ID NO: 8981 - protein, 12 aa, Artificial Sequence
  F-box/LRR-repeat protein 17 (206-217)
ITDYALIAIGRY

SEQ ID NO: 8982 - protein, 13 aa, Artificial Sequence
  T-complex protein 1 subunit gamma (291-303)
ITEKGISDLAQHY

SEQ ID NO: 8983 - protein, 11 aa, Artificial Sequence
  Tubulin alpha-1C chain (58-68)
ITGKEDAANNY

SEQ ID NO: 8984 - protein, 10 aa, Artificial Sequence
  Transmembrane protein 218 (3-12)
IVDDFFIGRY

SEQ ID NO: 8985 - protein, 9 aa, Artificial Sequence
  Protein unc-13 homolog B (372-380)
IVDEFAMRY

SEQ ID NO: 8986 - protein, 12 aa, Artificial Sequence
  116 kDa U5 small nuclear ribonucleoprotein component (281-292)
IVDEVNGLISMY

SEQ ID NO: 8987 - protein, 9 aa, Artificial Sequence
  Putative eukaryotic translation initiation factor 2 subunit 3-like protein (421-429)
KADLGKIVL

SEQ ID NO: 8988 - protein, 14 aa, Artificial Sequence
  Heterogeneous nuclear ribonucleoprotein L (552-565)
KSDALETLGFLNHY

SEQ ID NO: 8989 - protein, 11 aa, Artificial Sequence
  Heterogeneous nuclear ribonucleoprotein C-like 1 (30-40)
KSDVEAIFSKY

SEQ ID NO: 8990 - protein, 11 aa, Artificial Sequence
  RNA-binding protein Raly (35-45)
KSDVETIFSKY

SEQ ID NO: 8991 - protein, 10 aa, Artificial Sequence
  Interferon-induced protein with tetratricopeptide repeats 1 (393-402)
KSDVNAIIHY

SEQ ID NO: 8992 - protein, 11 aa, Artificial Sequence
  Ras GTPase-activating protein-binding protein 1 (353-363)
KSELKDFFQSY

SEQ ID NO: 8993 - protein, 10 aa, Artificial Sequence
  Mitochondrial import receptor subunit TOM70 (576-585)
KSEMEMAHLY

SEQ ID NO: 8994 - protein, 9 aa, Artificial Sequence
  Epidermal growth factor receptor substrate 15-like 1 (284-292)
KTDLDLDGY

SEQ ID NO: 8995 - protein, 12 aa, Artificial Sequence
  Myosin-9 (289-300)
KTDLLLEPYNKY

SEQ ID NO: 8996 - protein, 11 aa, Artificial Sequence
  Unconventional myosin-Id (307-317)
KTDMVEKALLY

SEQ ID NO: 8997 - protein, 12 aa, Artificial Sequence
  RNA polymerase II-associated factor 1 homolog (123-134)
KTEYISTEFNRY

SEQ ID NO: 8998 - protein, 11 aa, Artificial Sequence
  Cytokine receptor-like factor 3 (197-207)
KVDDDFTAQDY

SEQ ID NO: 8999 - protein, 9 aa, Artificial Sequence
  X-ray repair cross-complementing protein 5 (221-229)
KVDEEQMKY

SEQ ID NO: 9000 - protein, 9 aa, Artificial Sequence
  Dolichyl-diphosphooligosaccharide-proteinosyltransferase 48 kDa subunit (391-399)
KVDYNRLGY

SEQ ID NO: 9001 - protein, 10 aa, Artificial Sequence
  Cytosol aminopeptidase (431-440)
LADVNNIGKY

SEQ ID NO: 9002 - protein, 11 aa, Artificial Sequence
  Double-stranded RNA-specific adenosine deaminase (334-344)
LIDMERQGDVY

SEQ ID NO: 9003 - protein, 10 aa, Artificial Sequence
  Annexin A2 (190-199)
LIDQDARDLY

SEQ ID NO: 9004 - protein, 11 aa, Artificial Sequence
  Protein zyg-11 homolog B (425-435)
LIEEGGLQHLY

SEQ ID NO: 9005 - protein, 14 aa, Artificial Sequence
  N-acetylglucosamine-1-phosphotransferase subunits alpha/beta (903-916)
LLDEEESLKTQLAY

SEQ ID NO: 9006 - protein, 10 aa, Artificial Sequence
  Protein transport protein Sec61 subunit alpha isoform 1 (164-173)
LLDELLQKGY

SEQ ID NO: 9007 - protein, 12 aa, Artificial Sequence
  Mitogen-activated protein kinase kinase kinase 7 (547-558)
LLDENKSLSTYY

SEQ ID NO: 9008 - protein, 11 aa, Artificial Sequence
  Syntaxin-binding protein 2 (253-263)
LLDIEQDTYRY

SEQ ID NO: 9009 - protein, 10 aa, Artificial Sequence
  Intraflagellar transport protein 43 homolog (4-13)
LLDLDEELRY

SEQ ID NO: 9010 - protein, 10 aa, Artificial Sequence
  Zinc finger protein 627 (79-88)
LLDPSQKNLY

SEQ ID NO: 9011 - protein, 10 aa, Artificial Sequence
  Zinc finger protein 614 (24-33)
LLDTAQKNLY

SEQ ID NO: 9012 - protein, 10 aa, Artificial Sequence
  Zinc finger protein 324B (17-26)
LLDTAQRALY

SEQ ID NO: 9013 - protein, 12 aa, Artificial Sequence
  S100P-binding protein (91-102)
LLDTPREKNSSY

SEQ ID NO: 9014 - protein, 13 aa, Artificial Sequence
  Chromodomain-helicase-DNA-binding protein 4 (1078-1090)
LLEDFLEHEGYKY

SEQ ID NO: 9015 - protein, 9 aa, Artificial Sequence
  SWI/SNF-related matrix-associated actin-dependent regulator of chromatin subfamily A member 5 (784-792)
LLEKEILFY

SEQ ID NO: 9016 - protein, 10 aa, Artificial Sequence
  Early endosome antigen 1 (541-550)
LLEKEREDLY

SEQ ID NO: 9017 - protein, 11 aa, Artificial Sequence
  E3 ubiquitin-protein ligase HUWE1 (982-992)
LLENDVSTLGY

SEQ ID NO: 9018 - protein, 12 aa, Artificial Sequence
  Ankyrin repeat and LEM domain-containing protein 2 (110-121)
LLEQGGRLSSFY

SEQ ID NO: 9019 - protein, 14 aa, Artificial Sequence
  Phospholipid scramblase 1 (116-129)
LLEVLTGFETNNKY

SEQ ID NO: 9020 - protein, 10 aa, Artificial Sequence
  Signal recognition particle subunit SRP68 (128-137)
LMDAERAWSY

SEQ ID NO: 9021 - protein, 11 aa, Artificial Sequence
  Sialidase-1 (232-242)
LSDDHGASWRY

SEQ ID NO: 9022 - protein, 8 aa, Artificial Sequence
  Melanoma inhibitory activity protein 3 (136-143)
LSDEAIKY

SEQ ID NO: 9023 - protein, 9 aa, Artificial Sequence
  FACT complex subunit SSRP1 (85-93)
LSDFFKTHY

SEQ ID NO: 9024 - protein, 10 aa, Artificial Sequence
  Inhibitor of nuclear factor kappa-B kinase subunit beta (67-76)
LSDIASALRY

SEQ ID NO: 9025 - protein, 9 aa, Artificial Sequence
  Deoxyribose-phosphate aldolase (312-320)
LSDIERQIY

SEQ ID NO: 9026 - protein, 10 aa, Artificial Sequence
  Inhibitor of nuclear factor kappa-B kinase subunit alpha (94-103)
LSDIGSGIRY

SEQ ID NO: 9027 - protein, 9 aa, Artificial Sequence
  Rho-related BTB domain-containing protein 3 (340-348)
LSDILRFIY

SEQ ID NO: 9028 - protein, 13 aa, Artificial Sequence
  DnaJ homolog subfamily C member 11 (69-81)
LSDPQTRAIYDIY

SEQ ID NO: 9029 - protein, 10 aa, Artificial Sequence
  Ribosomal protein S6 kinase delta-1 (155-164)
LSDPSGPKSY

SEQ ID NO: 9030 - protein, 12 aa, Artificial Sequence
  Nucleoporin NDC1 (58-69)
LSDSFSDLYSSY

SEQ ID NO: 9031 - protein, 11 aa, Artificial Sequence
  Importin-7 (681-691)
LSDTKYLEMIY

SEQ ID NO: 9032 - protein, 12 aa, Artificial Sequence
  DNA polymerase zeta catalytic subunit (2423-2434)
LSDWFDNKTDLY

SEQ ID NO: 9033 - protein, 11 aa, Artificial Sequence
  Cyclin-dependent kinase 2-associated protein 1 (39-49)
LSDYGPPSLGY

SEQ ID NO: 9034 - protein, 9 aa, Artificial Sequence
  PAS domain-containing serine/threonine-protein kinase (64-72)
LSEDRWSSY

SEQ ID NO: 9035 - protein, 9 aa, Artificial Sequence
  Vacuolar protein sorting-associated protein 18 homolog (306-314)
LSEERVWEY

SEQ ID NO: 9036 - protein, 9 aa, Artificial Sequence
  Transmembrane and TPR repeat-containing protein 3 (84-92)
LSELKPMSY

SEQ ID NO: 9037 - protein, 12 aa, Artificial Sequence
  DmX-like protein 1 (783-794)
LSELSNPEISKY

SEQ ID NO: 9038 - protein, 9 aa, Artificial Sequence
  Alpha/beta hydrolase domain-containing protein 17B (50-58)
LSERADWQY

SEQ ID NO: 9039 - protein, 9 aa, Artificial Sequence
  Immediate early response gene 5-like protein (48-56)
LSERYAELY

SEQ ID NO: 9040 - protein, 10 aa, Artificial Sequence
  Signal peptidase complex subunit 1 (5-14)
LSSLPTQMDY

SEQ ID NO: 9041 - protein, 15 aa, Artificial Sequence
  Coatomer subunit epsilon (43-57)
LSSPERDVERDVFLY

SEQ ID NO: 9042 - protein, 11 aa, Artificial Sequence
  26S proteasome non-ATPase regulatory subunit 2 (391-401)
LTDDGNKWLYK

SEQ ID NO: 9043 - protein, 9 aa, Artificial Sequence
  Casein kinase II subunit alpha' (129-137)
LTDFDIRFY

SEQ ID NO: 9044 - protein, 8 aa, Artificial Sequence
  Lysine-tRNA ligase (133-140)
LTDFIQKY

SEQ ID NO: 9045 - protein, 9 aa, Artificial Sequence
  DNA excision repair protein ERCC-6-like 2 (214-222)
LTDFQKAVY

SEQ ID NO: 9046 - protein, 10 aa, Artificial Sequence
  Thyroid adenoma-associated protein (45-54)
LTDGVSQIHY

SEQ ID NO: 9047 - protein, 11 aa, Artificial Sequence
  3'(2'),5'-bisphosphate nucleotidase 1 (262-272)
LTDIHGNVLQY

SEQ ID NO: 9048 - protein, 10 aa, Artificial Sequence
  Myotubularin-related protein 5 (70-79)
LTDINSERHY

SEQ ID NO: 9049 - protein, 12 aa, Artificial Sequence
  E3 ubiquitin-protein ligase UBR4 (278-289)
LTDKAVKDYSAY

SEQ ID NO: 9050 - protein, 11 aa, Artificial Sequence
  MAP kinase-activating death domain protein (81-91)
LTDKDTGVTRY

SEQ ID NO: 9051 - protein, 10 aa, Artificial Sequence
  Dynactin subunit 2 (168-177)
LTDPDGALAK

SEQ ID NO: 9052 - protein, 10 aa, Artificial Sequence
  Mucosa-associated lymphoid tissue lymphoma translocation protein 1 (876-885)
LTDPIQGTEY

SEQ ID NO: 9053 - protein, 10 aa, Artificial Sequence
  Putative deoxyribonuclease TATDN1 (13-22)
LTDPMFRGIY

SEQ ID NO: 9054 - protein, 9 aa, Artificial Sequence
  Interferon regulatory factor 3 (252-260)
LTDRGVMSY

SEQ ID NO: 9055 - protein, 10 aa, Artificial Sequence
  Tubulin polyglutamylase complex subunit 2 (125-134)
LTDTFTAYYR

SEQ ID NO: 9056 - protein, 13 aa, Artificial Sequence
  Peroxisomal multifunctional enzyme type 2 (493-505)
LTDTTSLNQAALY

SEQ ID NO: 9057 - protein, 9 aa, Artificial Sequence
  DNA polymerase zeta catalytic subunit (928-936)
LTEEKMELY

SEQ ID NO: 9058 - protein, 11 aa, Artificial Sequence
  Regulator of microtubule dynamics protein 3 (316-326)
LTEEVSEKKSY

SEQ ID NO: 9059 - protein, 11 aa, Artificial Sequence
  Protein FAM65B (122-132)
LTEINRSFKEY

SEQ ID NO: 9060 - protein, 13 aa, Artificial Sequence
  Probable histidine-tRNA ligase, mitochondrial (104-116)
LTEKYGEDSGLMY

SEQ ID NO: 9061 - protein, 10 aa, Artificial Sequence
  ATP synthase subunit alpha, mitochondrial (467-476)
LTELLKQGQY

SEQ ID NO: 9062 - protein, 9 aa, Artificial Sequence
  39S ribosomal protein L52, mitochondrial (43-51)
LTELPDWSY

SEQ ID NO: 9063 - protein, 9 aa, Artificial Sequence
  Tectonin beta-propeller repeat-containing protein 2 (950-958)
LTEQRALLY

SEQ ID NO: 9064 - protein, 10 aa, Artificial Sequence
  7SK snRNA methylphosphate capping enzyme (629-638)
LTETIYKNYY

SEQ ID NO: 9065 - protein, 13 aa, Artificial Sequence
  HLA class I histocompatibility antigen, B-8 alpha chain (19-31)
LTETWAGSHSMRY

SEQ ID NO: 9066 - protein, 10 aa, Artificial Sequence
  Proline-rich nuclear receptor coactivator 1 (270-279)
LTEVSQKENY

SEQ ID NO: 9067 - protein, 13 aa, Artificial Sequence
  TOX high mobility group box family member 4 (104-116)
LTMDLDHSIGTQY

SEQ ID NO: 9068 - protein, 11 aa, Artificial Sequence
  Ubiquinone biosynthesis protein COQ9, mitochondrial (105-115)
LTSMVDDMWHY

SEQ ID NO: 9069 - protein, 10 aa, Artificial Sequence
  Clustered mitochondria protein homolog (608-617)
LVDAFVEHRY

SEQ ID NO: 9070 - protein, 12 aa, Artificial Sequence
  Poly (ADP-ribose) polymerase 1 (559-570)
LVDIVKGTNSYY

SEQ ID NO: 9071 - protein, 9 aa, Artificial Sequence
  Alsin (683-691)
LVDKNIMGY

SEQ ID NO: 9072 - protein, 13 aa, Artificial Sequence
  Dexamethasone-induced protein (67-79)
LVDLGVLSDPGSG

SEQ ID NO: 9073 - protein, 15 aa, Artificial Sequence
  Dexamethasone-induced protein (67-81)
LVDLGVLSDPGSGLY

SEQ ID NO: 9074 - protein, 9 aa, Artificial Sequence
  Zinc finger FYVE domain-containing protein 16 (1229-1237)
LVDLRNYQY

SEQ ID NO: 9075 - protein, 10 aa, Artificial Sequence
  Semaphorin-4F (69-78)
LVDPASHTLY

SEQ ID NO: 9076 - protein, 10 aa, Artificial Sequence
  Fatty acid-binding protein, epidermal (13-22)
LVDSKGFDEY

SEQ ID NO: 9077 - protein, 9 aa, Artificial Sequence
  Probable C-mannosyltransferase DPY19L1 (398-406)
MEKETPLRY

SEQ ID NO: 9078 - protein, 10 aa, Artificial Sequence
  MICOS complex subunit MIC60 (261-270)
MIDETRNSLY

SEQ ID NO: 9079 - protein, 9 aa, Artificial Sequence
  SWI/SNF-related matrix-associated actin-dependent regulator of chromatin subfamily D member 2 (247-255)
MLDHQPPQY

SEQ ID NO: 9080 - protein, 9 aa, Artificial Sequence
  Acylamino-acid-releasing enzyme (544-552)
MLDKSPIRY

SEQ ID NO: 9081 - protein, 9 aa, Artificial Sequence
  Cytoplasmic dynein 1 heavy chain 1 (3043-3051)
MLDSHEELY

SEQ ID NO: 9082 - protein, 12 aa, Artificial Sequence
  Zinc finger MYM-type protein 4 (480-491)
MSDGSIRNFCSY

SEQ ID NO: 9083 - protein, 10 aa, Artificial Sequence
  YTH domain-containing family protein 3 (52-61)
MSDPYMPSYY

SEQ ID NO: 9084 - protein, 8 aa, Artificial Sequence
  trabeculin-alpha (2316-2323)
MSDVNLKY

SEQ ID NO: 9085 - protein, 10 aa, Artificial Sequence
  A-kinase anchor protein 6 (990-999)
MSEEQQQHLY

SEQ ID NO: 9086 - protein, 9 aa, Artificial Sequence
  Lambda-crystallin homolog (224-232)
MSEGLGMRY

SEQ ID NO: 9087 - protein, 10 aa, Artificial Sequence
  Talin-1 (289-298)
MSEIEAKVRY

SEQ ID NO: 9088 - protein, 13 aa, Artificial Sequence
  Kelch-like protein 13 (423-435)
MSEPHYGHAGTVY

SEQ ID NO: 9089 - protein, 9 aa, Artificial Sequence
  Antigen KI-67 (1611-1619)
MTDDKITEV

SEQ ID NO: 9090 - protein, 11 aa, Artificial Sequence
  Telomerase protein component 1 (365-375)
MTDKFAQFDEY

SEQ ID NO: 9091 - protein, 12 aa, Artificial Sequence
  DNA helicase B (287-298)
MTDLEKNALIMY

SEQ ID NO: 9092 - protein, 13 aa, Artificial Sequence
  TAR DNA-binding protein 43 (202-214)
MTEDELREFFSQY

SEQ ID NO: 9093 - protein, 13 aa, Artificial Sequence
  Muskelin (98-110)
MTELLSSGLKNDY

SEQ ID NO: 9094 - protein, 10 aa, Artificial Sequence
  Presenilin-1 (1-10)
MTELPAPLSY

SEQ ID NO: 9095 - protein, 10 aa, Artificial Sequence
  Prolyl endopeptidase (67-76)
MTELYDYPKY

SEQ ID NO: 9096 - protein, 9 aa, Artificial Sequence
  E3 ubiquitin-protein ligase UBR5 (2723-2731)
MTERQDLVY

SEQ ID NO: 9097 - protein, 10 aa, Artificial Sequence
  Protein Spindly (51-60)
MTESYEQEKY

SEQ ID NO: 9098 - protein, 13 aa, Artificial Sequence
  Zinc finger protein 428 (44-56)
MTETREPAETGGY

SEQ ID NO: 9099 - protein, 12 aa, Artificial Sequence
  NF-kappa-B-repressing factor (190-201)
MTSGSDKINYTY

SEQ ID NO: 9100 - protein, 9 aa, Artificial Sequence
  Probable ATP-dependent RNA helicase DHX35 (162-170)
MVDPLLTKY

SEQ ID NO: 9101 - protein, 11 aa, Artificial Sequence
  Cytochrome c oxidase subunit 1 (484-494)
MVEEPSMNLEW

SEQ ID NO: 9102 - protein, 12 aa, Artificial Sequence
  Lysocardiolipin acyltransferase 1 (88-99)
NLDAVHDITVAY

SEQ ID NO: 9103 - protein, 12 aa, Artificial Sequence
  Prolyl 3-hydroxylase OGFOD1 (84-95)
NLDFHEKYNDLY

SEQ ID NO: 9104 - protein, 9 aa, Artificial Sequence
  Tubulin alpha-1C chain (181-189)
NLDIERPTY

SEQ ID NO: 9105 - protein, 12 aa, Artificial Sequence
  Splicing factor 3B subunit 4 (106-117)
NLDPEIDEKLLY

SEQ ID NO: 9106 - protein, 9 aa, Artificial Sequence
  N-alpha-acetyltransferase 20 (7-15)
NLDPLTETY

SEQ ID NO: 9107 - protein, 10 aa, Artificial Sequence
  E3 ubiquitin-protein ligase RNF135 (381-390)
NLEEGKLAFY

SEQ ID NO: 9108 - protein, 9 aa, Artificial Sequence
  Basigin (111-119)
NMEADPGQY

SEQ ID NO: 9109 - protein, 14 aa, Artificial Sequence
  Ribonucleoside-diphosphate reductase large subunit (35-48)
NSAIIYDRDFSYNY

SEQ ID NO: 9110 - protein, 10 aa, Artificial Sequence
  Thrombospondin-3 (640-649)
NSDPGLAVGY

SEQ ID NO: 9111 - protein, 12 aa, Artificial Sequence
  NADH-ubiquinone oxidoreductase chain 5 (109-120)
NSDPNINQFFKY

SEQ ID NO: 9112 - protein, 11 aa, Artificial Sequence
  52 kDa repressor of the inhibitor of the protein kinase (452-462)
NSDTNIRWNNY

SEQ ID NO: 9113 - protein, 9 aa, Artificial Sequence
  Homeodomain-interacting protein kinase 1 (604-612)
NSDVSLLNY

SEQ ID NO: 9114 - protein, 10 aa, Artificial Sequence
  Serine/threonine-protein kinase RIO3 (378-387)
NSEEMKEAYY

SEQ ID NO: 9115 - protein, 14 aa, Artificial Sequence
  Cerebellar degeneration-related protein 2 (286-299)
NSELEQQLGATGAY

SEQ ID NO: 9116 - protein, 10 aa, Artificial Sequence
  YY1-associated protein 1 (320-329)
NSELGSETRY

SEQ ID NO: 9117 - protein, 9 aa, Artificial Sequence
  Myosin-14 (29-37)
NSELLNDRY

SEQ ID NO: 9118 - protein, 9 aa, Artificial Sequence
  Thymidylate synthase (205-213)
NSELSCQLY

SEQ ID NO: 9119 - protein, 14 aa, Artificial Sequence
  Neuroblastoma-amplified sequence (1978-1991)
NSEQETLQKYSHLY

SEQ ID NO: 9120 - protein, 13 aa, Artificial Sequence
  Cytochrome c oxidase subunit 1 (360-372)
NSSLDIVLHDTYY

SEQ ID NO: 9121 - protein, 11 aa, Artificial Sequence
  LIM domain and actin-binding protein 1 (82-92)
NTDASGKIEKY

SEQ ID NO: 9122 - protein, 11 aa, Artificial Sequence
  Zinc finger protein 462 (265-275)
NTDFGDSGRLY

SEQ ID NO: 9123 - protein, 12 aa, Artificial Sequence
  Zinc finger protein 462 (265-276)
NTDFGDSGRLYY

SEQ ID NO: 9124 - protein, 9 aa, Artificial Sequence
  Protein YIPF5 (8-16)
NTDFYQTSY

SEQ ID NO: 9125 - protein, 9 aa, Artificial Sequence
  2-oxoisovalerate dehydrogenase subunit alpha, mitochondrial (83-91)
NTDLVFGQY

SEQ ID NO: 9126 - protein, 11 aa, Artificial Sequence
  Protein TASOR (346-356)
NTDRNIDKYNY

SEQ ID NO: 9127 - protein, 12 aa, Artificial Sequence
  26S proteasome non-ATPase regulatory subunit 13 (227-238)
NTDRQWLIDTLY

SEQ ID NO: 9128 - protein, 11 aa, Artificial Sequence
  Pericentriolar material 1 protein (1414-1424)
NTDYLRQRALY

SEQ ID NO: 9129 - protein, 12 aa, Artificial Sequence
  DnaJ homolog subfamily C member 3 (221-232)
NTEAFYKISTLY

SEQ ID NO: 9130 - protein, 13 aa, Artificial Sequence
  Polypyrimidine tract-binding protein 1 (102-114)
NTEEAANTMVNYY

SEQ ID NO: 9131 - protein, 13 aa, Artificial Sequence
  DNA-directed RNA polymerase I subunit RPA1 (1579-1591)
NTEGINLPELFKY

SEQ ID NO: 9132 - protein, 9 aa, Artificial Sequence
  Putative SMEK homolog 3 (187-195)
NTEGLHHLY

SEQ ID NO: 9133 - protein, 13 aa, Artificial Sequence
  Condensin complex subunit 1 (509-521)
NTETTEDVKGRIY

SEQ ID NO: 9134 - protein, 10 aa, Artificial Sequence
  Charged multivesicular body protein 4b (102-111)
NTEVLKNMGY

SEQ ID NO: 9135 - protein, 13 aa, Artificial Sequence
  Solute carrier family 25 member 46 (374-386)
NTIRQEEGVFGFY

SEQ ID NO: 9136 - protein, 13 aa, Artificial Sequence
  Microphthalmia-associated transcription factor (237-249)
NTLPVSGNLIDLY

SEQ ID NO: 9137 - protein, 11 aa, Artificial Sequence
  AT-rich interactive domain-containing protein 1A (858-868)
NTSDMMGRMSY

SEQ ID NO: 9138 - protein, 13 aa, Artificial Sequence
  Lysine-specific demethylase 5A (460-472)
NVDISGMKVPWLY

SEQ ID NO: 9139 - protein, 12 aa, Artificial Sequence
  Anaphase-promoting complex subunit 7 (270-281)
NVDLLGSLADLY

SEQ ID NO: 9140 - protein, 9 aa, Artificial Sequence
  60S ribosomal protein L13a (184-192)
NVEKKIDKY

SEQ ID NO: 9141 - protein, 10 aa, Artificial Sequence
  Unhealthy ribosome biogenesis protein 2 homolog (1354-1363)
PLDHLKPLEY

SEQ ID NO: 9142 - protein, 10 aa, Artificial Sequence
  Nardilysin (107-116)
PSDPKQYRYI

SEQ ID NO: 9143 - protein, 11 aa, Artificial Sequence
  Probable 28S rRNA (cytosine-C(5))-methyltransferase (291-301)
PSDPRYHEVHY

SEQ ID NO: 9144 - protein, 9 aa, Artificial Sequence
  Vesicle-associated membrane protein 7 (37-45)
PSENNKLTY

SEQ ID NO: 9145 - protein, 12 aa, Artificial Sequence
  ELAV-like protein 1 (98-109)
PSSEVIKDANLY

SEQ ID NO: 9146 - protein, 9 aa, Artificial Sequence
  Copine-1 (299-307)
PSSPDSLHY

SEQ ID NO: 9147 - protein, 9 aa, Artificial Sequence
  Leucyl-cystinyl aminopeptidase (155-163)
PTAVVPLRY

SEQ ID NO: 9148 - protein, 12 aa, Artificial Sequence
  Mitogen-activated protein kinase kinase kinase kinase 2 (799-810)
PTDNPEAHSNLY

SEQ ID NO: 9149 - protein, 11 aa, Artificial Sequence
  GRAM domain-containing protein 4 (500-510)
PTDYIRNGVLY

SEQ ID NO: 9150 - protein, 10 aa, Artificial Sequence
  Vam6/Vps39-like protein (288-297)
PTDYRKQLQY

SEQ ID NO: 9151 - protein, 9 aa, Artificial Sequence
  Syntaxin-binding protein 5 (645-653)
PTEIQRLTY

SEQ ID NO: 9152 - protein, 12 aa, Artificial Sequence
  Mitochondrial import receptor subunit TOM70 (145-156)
PTEKNVDLSTFY

SEQ ID NO: 9153 - protein, 12 aa, Artificial Sequence
  Nuclear factor erythroid 2-related factor 1 (309-320)
PVEEFNELLSKY

SEQ ID NO: 9154 - protein, 11 aa, Artificial Sequence
  Uncharacterized protein KIAA2013 (534-544)
QADPDVLHNSY

SEQ ID NO: 9155 - protein, 10 aa, Artificial Sequence
  Lysophospholipid acyltransferase LPCAT4 (420-429)
QAEGPNRLLY

SEQ ID NO: 9156 - protein, 13 aa, Artificial Sequence
  Actin-related protein 6 (44-56)
QIDEIKDPSGLFY

SEQ ID NO: 9157 - protein, 9 aa, Artificial Sequence
  Hepatocyte growth factor-regulated tyrosine kinase substrate (459-467)
QLDERRLYY

SEQ ID NO: 9158 - protein, 9 aa, Artificial Sequence
  Speriolin-like protein (48-56)
QLDRRILAY

SEQ ID NO: 9159 - protein, 10 aa, Artificial Sequence
  Zinc finger protein 74 (59-68)
QLDSPQRALY

SEQ ID NO: 9160 - protein, 9 aa, Artificial Sequence
  trabeculin-alpha (4357-4365)
QLDTHMELY

SEQ ID NO: 9161 - protein, 11 aa, Artificial Sequence
  Phosphofurin acidic cluster sorting protein 1 (106-116)
QLDVAGRVMQY

SEQ ID NO: 9162 - protein, 11 aa, Artificial Sequence
  Ubiquitin-40S ribosomal protein S27a (69-79)
QLEDGRTLSDY

SEQ ID NO: 9163 - protein, 12 aa, Artificial Sequence
  PH domain leucine-rich repeat-containing protein phosphatase 2 (23-34)
QLERPGGLDTLY

SEQ ID NO: 9164 - protein, 9 aa, Artificial Sequence
  Transketolase (102-110)
QSDPAPLQH

SEQ ID NO: 9165 - protein, 10 aa, Artificial Sequence
  HMG box-containing protein 1 (66-75)
QSDPTQSGMY

SEQ ID NO: 9166 - protein, 10 aa, Artificial Sequence
  Aryl hydrocarbon receptor (150-159)
QSDVIHQSVY

SEQ ID NO: 9167 - protein, 13 aa, Artificial Sequence
  HLA class I histocompatibility antigen, A-1 alpha chain (86-98)
QSEDGSHTIQIMY

SEQ ID NO: 9168 - protein, 11 aa, Artificial Sequence
  Pre-mRNA-splicing factor ISY1 homolog (275-285)
QSEEARRLLGY

SEQ ID NO: 9169 - protein, 10 aa, Artificial Sequence
  LIM and SH3 domain protein 1 (77-86)
QSELQSQVRY

SEQ ID NO: 9170 - protein, 9 aa, Artificial Sequence
  Dynamin-1-like protein (672-680)
QSELVGQLY

SEQ ID NO: 9171 - protein, 12 aa, Artificial Sequence
  E3 ubiquitin-protein ligase synoviolin (163-174)
QSENPWDNKAVY

SEQ ID NO: 9172 - protein, 9 aa, Artificial Sequence
  Vacuolar protein sorting-associated protein 13D (1153-1161)
QSEREYIRY

SEQ ID NO: 9173 - protein, 10 aa, Artificial Sequence
  Ubiquitin carboxyl-terminal hydrolase 25 (71-80)
QTALPGNDRY

SEQ ID NO: 9174 - protein, 10 aa, Artificial Sequence
  Zinc finger MYM-type protein 2 (609-618)
QTDDTWRTEY

SEQ ID NO: 9175 - protein, 9 aa, Artificial Sequence
  Disintegrin and metalloproteinase domain-containing protein 10 (227-235)
QTDHLFFKY

SEQ ID NO: 9176 - protein, 11 aa, Artificial Sequence
  RNA polymerase-associated protein CTR9 homolog (424-434)
QTDIQGALSAY

SEQ ID NO: 9177 - protein, 12 aa, Artificial Sequence
  AP-1 complex subunit beta-1 (59-70)
QTDNLELKKLVY

SEQ ID NO: 9178 - protein, 10 aa, Artificial Sequence
  Charged multivesicular body protein 7 (274-283)
QTDQMVFNAY

SEQ ID NO: 9179 - protein, 11 aa, Artificial Sequence
  Midasin (362-372)
QTDSKMLLGMY

SEQ ID NO: 9180 - protein, 10 aa, Artificial Sequence
  RAB6A-GEF complex partner protein 2 (260-269)
QTEERVQPEY

SEQ ID NO: 9181 - protein, 11 aa, Artificial Sequence
  UDP-glucose:glycoprotein glucosyltransferase 1 (1328-1338)
QTEKQRIIWGY

SEQ ID NO: 9182 - protein, 10 aa, Artificial Sequence
  Probable cation-transporting ATPase 13A3 (131-140)
QTESQQIRYF

SEQ ID NO: 9183 - protein, 12 aa, Artificial Sequence
  Intraflagellar transport protein 81 homolog (447-458)
QTMEEKKGISGY

SEQ ID NO: 9184 - protein, 9 aa, Artificial Sequence
  Importin subunit alpha-5 (516-524)
QVDLNQQQY

SEQ ID NO: 9185 - protein, 10 aa, Artificial Sequence
  Protein PRR14L (815-824)
QVDNSLITKY

SEQ ID NO: 9186 - protein, 10 aa, Artificial Sequence
  DNA-directed RNA polymerase II subunit RPB9 (103-112)
RAEDAMRLYY

SEQ ID NO: 9187 - protein, 9 aa, Artificial Sequence
  CDK5 regulatory subunit-associated protein 2 (1335-1343)
RIEEDNLTY

SEQ ID NO: 9188 - protein, 9 aa, Artificial Sequence
  Vacuole membrane protein 1 (105-113)
RIEKQFLLY

SEQ ID NO: 9189 - protein, 9 aa, Artificial Sequence
  Lanosterol 14-alpha demethylase (418-426)
RLDFNPDRY

SEQ ID NO: 9190 - protein, 10 aa, Artificial Sequence
  Tubulin alpha-1C chain (355-364)
RLDHKFDLMY

SEQ ID NO: 9191 - protein, 12 aa, Artificial Sequence
  Nitric oxide synthase, endothelial (782-793)
RLDTGGQEGLQY

SEQ ID NO: 9192 - protein, 11 aa, Artificial Sequence
  Transmembrane emp24 domain-containing protein 7 (68-78)
RLEDPDGKVLY

SEQ ID NO: 9193 - protein, 10 aa, Artificial Sequence
  Peptidyl-prolyl cis-trans isomerase FKBP3 (189-198)
RLEIEPEWAY

SEQ ID NO: 9194 - protein, 11 aa, Artificial Sequence
  Ubiquitin carboxyl-terminal hydrolase 15 (403-413)
RMDPLTKPMQY

SEQ ID NO: 9195 - protein, 12 aa, Artificial Sequence
  WASH complex subunit strumpellin (230-241)
RSDDIYNQVSAY

SEQ ID NO: 9196 - protein, 10 aa, Artificial Sequence
  Selenocysteine insertion sequence-binding protein 2-like (379-388)
RSDPNSESLY

SEQ ID NO: 9197 - protein, 11 aa, Artificial Sequence
  Nuclear cap-binding protein subunit 2 (10-20)
RSDSYVELSQY

SEQ ID NO: 9198 - protein, 12 aa, Artificial Sequence
  Methyltransferase-like protein 22 (16-27)
RSDTVLSDVHLY

SEQ ID NO: 9199 - protein, 15 aa, Artificial Sequence
  Eukaryotic translation initiation factor 3 subunit E (431-445)
RSEAPNWATQDSGFY

SEQ ID NO: 9200 - protein, 10 aa, Artificial Sequence
  F-box only protein 9 (210-219)
RTDAILLGHY

SEQ ID NO: 9201 - protein, 11 aa, Artificial Sequence
  General transcription factor II-I repeat domain-containing protein 2B (69-79)
RTDFQKDFAKY

SEQ ID NO: 9202 - protein, 9 aa, Artificial Sequence
  Cytoplasmic dynein 1 heavy chain 1 (3544-3552)
RTDIARTEY

SEQ ID NO: 9203 - protein, 12 aa, Artificial Sequence
  ERI1 exoribonuclease 3 (98-109)
RTMEIESTFHMY

SEQ ID NO: 9204 - protein, 10 aa, Artificial Sequence
  U5 small nuclear ribonucleoprotein 200 kDa helicase (666-675)
RVDPAKGLFY

SEQ ID NO: 9205 - protein, 10 aa, Artificial Sequence
  DmX-like protein 2 (729-738)
RVDPIGPLSY

SEQ ID NO: 9206 - protein, 9 aa, Artificial Sequence
  Serine/threonine-protein kinase SMG1 (32-40)
SADPGNLKY

SEQ ID NO: 9207 - protein, 9 aa, Artificial Sequence
  DNA mismatch repair protein Msh6 (340-348)
SDSLVQKGY

SEQ ID NO: 9208 - protein, 11 aa, Artificial Sequence
  GPI transamidase component PIG-T (52-62)
SELQREGVSHY

SEQ ID NO: 9209 - protein, 11 aa, Artificial Sequence
  Ectonucleotide pyrophosphatase/phosphodiesterase family member 2 (308-318)
SEQPDFSGHKY

SEQ ID NO: 9210 - protein, 10 aa, Artificial Sequence
  Protein YIPF5 (17-26)
SIDDQSQQSY

SEQ ID NO: 9211 - protein, 10 aa, Artificial Sequence
  E3 ubiquitin-protein ligase HECTD1 (532-541)
SIERLPLHLY

SEQ ID NO: 9212 - protein, 11 aa, Artificial Sequence
  Creatine kinase B-type (164-174)
SLDGDLAGRYY

SEQ ID NO: 9213 - protein, 11 aa, Artificial Sequence
  Protein FAM91A1 (206-216)
SLDYNVVHSLY

SEQ ID NO: 9214 - protein, 9 aa, Artificial Sequence
  Cytochrome c oxidase subunit 4 isoform 1, mitochondrial (36-44)
SMDEKVELY

SEQ ID NO: 9215 - protein, 10 aa, Artificial Sequence
  Paired box protein Pax-3 (312-321)
SMDPVTGYQY

SEQ ID NO: 9216 - protein, 10 aa, Artificial Sequence
  Heat shock protein HSP 90-alpha (174-183)
SSDALDKIRY

SEQ ID NO: 9217 - protein, 11 aa, Artificial Sequence
  Integrin beta-3 (536-546)
SSDFGKITGKY

SEQ ID NO: 9218 - protein, 11 aa, Artificial Sequence
  Protein SEC13 homolog (124-134)
SSDGAISLLTY

SEQ ID NO: 9219 - protein, 10 aa, Artificial Sequence
  Nucleoporin GLE1 (16-25)
SSDKGRLCYY

SEQ ID NO: 9220 - protein, 9 aa, Artificial Sequence
  Histone-lysine N-methyltransferase SETDB2 (309-317)
SSDKITTGY

SEQ ID NO: 9221 - protein, 10 aa, Artificial Sequence
  Scm-like with four MBT domains protein 1 (201-210)
SSDNYEHWLY

SEQ ID NO: 9222 - protein, 10 aa, Artificial Sequence
  Forkhead box protein M1 (39-48)
SSDPASQLSY

SEQ ID NO: 9223 - protein, 11 aa, Artificial Sequence
  Protein kinase C and casein kinase substrate in neurons protein 2 (14-24)
SSDSFWEVGNY

SEQ ID NO: 9224 - protein, 12 aa, Artificial Sequence
  Vacuolar protein sorting-associated protein 51 homolog (377-388)
SSDSSKRTFSVY

SEQ ID NO: 9225 - protein, 10 aa, Artificial Sequence
  Clathrin interactor 1 (163-172)
SSDSVGGFRY

SEQ ID NO: 9226 - protein, 11 aa, Artificial Sequence
  Protein FAM189B (167-177)
SSDTADFRDLY

SEQ ID NO: 9227 - protein, 11 aa, Artificial Sequence
  WD40 repeat-containing protein SMU1 (7-17)
SSDVIRLIMQY

SEQ ID NO: 9228 - protein, 10 aa, Artificial Sequence
  Archaemetzincin-2 (168-177)
SSDYSIFDNY

SEQ ID NO: 9229 - protein, 9 aa, Artificial Sequence
  Nuclear receptor-interacting protein 1 (271-279)
SSEAHLQQY

SEQ ID NO: 9230 - protein, 9 aa, Artificial Sequence
  KIF1-binding protein (164-172)
SSEALYNQY

SEQ ID NO: 9231 - protein, 13 aa, Artificial Sequence
  DNA-dependent protein kinase catalytic subunit (3366-3378)
SSEDSEKVIAGLY

SEQ ID NO: 9232 - protein, 10 aa, Artificial Sequence
  Protein C-ets-1 (192-201)
SSEELLSLKY

SEQ ID NO: 9233 - protein, 11 aa, Artificial Sequence
  UPF0769 protein C21orf59 (235-245)
SSEEQKQLMLY

SEQ ID NO: 9234 - protein, 11 aa, Artificial Sequence
  Protein-glutamate O-methyltransferase (271-281)
SSELATEVHFY

SEQ ID NO: 9235 - protein, 9 aa, Artificial Sequence
  Trafficking protein particle complex subunit 3 (15-23)
SSELFTLTY

SEQ ID NO: 9236 - protein, 10 aa, Artificial Sequence
  Centriole, cilia and spindle-associated protein (253-262)
SSENPWMTEY

SEQ ID NO: 9237 - protein, 11 aa, Artificial Sequence
  Proline and serine-rich protein 1 (34-44)
SSEQVVDLLRY

SEQ ID NO: 9238 - protein, 10 aa, Artificial Sequence
  Ubiquitin carboxyl-terminal hydrolase 38 (207-216)
SSESGHYYSY

SEQ ID NO: 9239 - protein, 10 aa, Artificial Sequence
  DNA-dependent protein kinase catalytic subunit (556-565)
SSESLNHLLY

SEQ ID NO: 9240 - protein, 14 aa, Artificial Sequence
  Single Ig IL-1-related receptor (382-395)
SSEVDVSDLGSRNY

SEQ ID NO: 9241 - protein, 11 aa, Artificial Sequence
  ELAV-like protein 1 (99-109)
SSEVIKDANLY

SEQ ID NO: 9242 - protein, 11 aa, Artificial Sequence
  Protein FAM65B (857-867)
SSEVVTVFQYY

SEQ ID NO: 9243 - protein, 12 aa, Artificial Sequence
  Interferon-induced, double-stranded RNA-activated protein kinase (420-431)
SSQDYGKEVDLY

SEQ ID NO: 9244 - protein, 12 aa, Artificial Sequence
  Histone-arginine methyltransferase CARM1 (405-416)
STAPTEPLTHWY

SEQ ID NO: 9245 - protein, 13 aa, Artificial Sequence
  Protein HIRA (392-404)
STAVIENPEMLKY

SEQ ID NO: 9246 - protein, 11 aa, Artificial Sequence
  Nucleoprotein TPR (1876-1886)
STDGEVETQVY

SEQ ID NO: 9247 - protein, 10 aa, Artificial Sequence
  Recombining binding protein suppressor of hairless (318-327)
STDKAEYTFY

SEQ ID NO: 9248 - protein, 11 aa, Artificial Sequence
  Holliday junction recognition protein (523-533)
STDKASMEVRY

SEQ ID NO: 9249 - protein, 8 aa, Artificial Sequence
  Eukaryotic translation initiation factor 3 subunit I (111-118)
STDKQMGY

SEQ ID NO: 9250 - protein, 11 aa, Artificial Sequence
  Myocyte-specific enhancer factor 2A (59-69)
STDMDKVLLKY

SEQ ID NO: 9251 - protein, 11 aa, Artificial Sequence
  Integrin alpha-5 (179-189)
STDNFTRILEY

SEQ ID NO: 9252 - protein, 10 aa, Artificial Sequence
  Nuclear pore complex protein Nup93 (541-550)
STDPREALQY

SEQ ID NO: 9253 - protein, 10 aa, Artificial Sequence
  Immunoglobulin superfamily member 8 (131-140)
STDTRYLGSY

SEQ ID NO: 9254 - protein, 15 aa, Artificial Sequence
  RNA-binding protein FUS (44-58)
STDTSGYGQSSYSSY

SEQ ID NO: 9255 - protein, 10 aa, Artificial Sequence
  Signal-induced proliferation-associated 1-like protein 1 (909-918)
STDTSLKIFY

SEQ ID NO: 9256 - protein, 12 aa, Artificial Sequence
  Eukaryotic translation initiation factor 2A (264-275)
STDVDKTGASYY

SEQ ID NO: 9257 - protein, 11 aa, Artificial Sequence
  26S proteasome non-ATPase regulatory subunit 8 (239-249)
STELAKQVIEY

SEQ ID NO: 9258 - protein, 9 aa, Artificial Sequence
  Asparagine-tRNA ligase, cytoplasmic (174-182)
STESSVAVY

SEQ ID NO: 9259 - protein, 12 aa, Artificial Sequence
  Mitochondrial import inner membrane translocase subunit Tim17-A (156-167)
STQLPSSPFGDY

SEQ ID NO: 9260 - protein, 9 aa, Artificial Sequence
  Zinc finger protein 106 (662-670)
STSEIGTRY

SEQ ID NO: 9261 - protein, 9 aa, Artificial Sequence
  Protein strawberry notch homolog 1 (1169-1177)
STSGHVELY

SEQ ID NO: 9262 - protein, 11 aa, Artificial Sequence
  T-complex protein 1 subunit epsilon (270-280)
SVEDYKALQKY

SEQ ID NO: 9263 - protein, 10 aa, Artificial Sequence
  Glutamine-fructose-6-phosphate aminotransferase (isomerizing) 1 (444-453)
TADTLMGLRY

SEQ ID NO: 9264 - protein, 12 aa, Artificial Sequence
  Splicing factor 3B subunit 6 (31-42)
TAEEMYDIFGKY

SEQ ID NO: 9265 - protein, 10 aa, Artificial Sequence
  Annexin A11 (431-440)
TDLLDIRSEY

SEQ ID NO: 9266 - protein, 10 aa, Artificial Sequence
  RNA binding motif protein 22 (244-253)
TETDLRNHFY

SEQ ID NO: 9267 - protein, 11 aa, Artificial Sequence
  Glutamine-tRNA ligase (47-57)
TIDKATGILLY

SEQ ID NO: 9268 - protein, 10 aa, Artificial Sequence
  Pre-mRNA-splicing factor ATP-dependent RNA helicase DHX15 (294-303)
TLDAGKFQIY

SEQ ID NO: 9269 - protein, 10 aa, Artificial Sequence
  ATP-dependent RNA helicase DHX8 (717-726)
TLDAVKFSQY

SEQ ID NO: 9270 - protein, 10 aa, Artificial Sequence
  BRCA2-interacting transcriptional repressor EMSY (945-954)
TLDPQTGLFY

SEQ ID NO: 9271 - protein, 13 aa, Artificial Sequence
  A-kinase anchor protein 11 (1443-1455)
TLDPYRNEVSQLY

SEQ ID NO: 9272 - protein, 9 aa, Artificial Sequence
  E3 SUMO-protein ligase NSE2 (70-78)
TLDRQLNHY

SEQ ID NO: 9273 - protein, 12 aa, Artificial Sequence
  TOX high mobility group box family member 4 (105-116)
TMDLDHSIGTQY

SEQ ID NO: 9274 - protein, 10 aa, Artificial Sequence
  Dynein light chain roadblock-type 1 (40-49)
TMDNPTTTQY

SEQ ID NO: 9275 - protein, 11 aa, Artificial Sequence
  Retinal dehydrogenase 1 (105-115)
TMESMNGGKLY

SEQ ID NO: 9276 - protein, 14 aa, Artificial Sequence
  Alpha-N-acetylglucosaminidase (545-558)
TSAPSLATSPAFRY

SEQ ID NO: 9277 - protein, 10 aa, Artificial Sequence
  Cytoplasmic dynein 1 heavy chain 1 (1163-1172)
TSDAVTFITY

SEQ ID NO: 9278 - protein, 10 aa, Artificial Sequence
  G1/S-specific cyclin-E2 (81-90)
TSDFSRFTNY

SEQ ID NO: 9279 - protein, 11 aa, Artificial Sequence
  E3 SUMO-protein ligase RanBP2 (1071-1081)
TSDKPLQGDGY

SEQ ID NO: 9280 - protein, 11 aa, Artificial Sequence
  Endoplasmic reticulum metallopeptidase 1 (361-371)
TSDMLAAASKY

SEQ ID NO: 9281 - protein, 11 aa, Artificial Sequence
  Fizzy-related protein homolog (81-91)
TSDNGKDGLAY

SEQ ID NO: 9282 - protein, 9 aa, Artificial Sequence
  Beta-hexosaminidase subunit alpha (32-40)
TSDQRYVLY

SEQ ID NO: 9283 - protein, 10 aa, Artificial Sequence
  Leucine-rich repeat flightless-interacting protein 1 (241-250)
TSDTLNNVGY

SEQ ID NO: 9284 - protein, 11 aa, Artificial Sequence
  Protein SDE2 homolog (58-68)
TSDTVQHGAVY

SEQ ID NO: 9285 - protein, 12 aa, Artificial Sequence
  Uncharacterized protein C15orf41 (61-72)
TSEAIESYYQRY

SEQ ID NO: 9286 - protein, 9 aa, Artificial Sequence
  High affinity cAMP-specific and IBMX-insensitive 3',5'-cyclic phosphodiesterase 8A (115-123)
TSEDRFIQY

SEQ ID NO: 9287 - protein, 12 aa, Artificial Sequence
  Caprin-1 (438-449)
TSEGYTASQPLY

SEQ ID NO: 9288 - protein, 13 aa, Artificial Sequence
  Endoplasmin (188-200)
TSELIGQFGVGFY

SEQ ID NO: 9289 - protein, 11 aa, Artificial Sequence
  Sodium/potassium-transporting ATPase subunit alpha-2 (19-29)
TSEQLDDILKY

SEQ ID NO: 9290 - protein, 9 aa, Artificial Sequence
  Putative pre-mRNA-splicing factor ATP-dependent RNA helicase DHX16 (487-495)
TSERTVLRY

SEQ ID NO: 9291 - protein, 9 aa, Artificial Sequence
  Neuroplastin (57-65)
TSSSHTLTY

SEQ ID NO: 9292 - protein, 12 aa, Artificial Sequence
  Unconventional myosin-Va (1775-1786)
TTAQIVKVLNLY

SEQ ID NO: 9293 - protein, 10 aa, Artificial Sequence
  Leukotriene A-4 hydrolase (421-430)
TTDDWKDFLY

SEQ ID NO: 9294 - protein, 11 aa, Artificial Sequence
  DNA-directed RNA polymerases I and III subunit RPAC1 (26-36)
TTDFPGNYSGY

SEQ ID NO: 9295 - protein, 9 aa, Artificial Sequence
  Mitotic spindle assembly checkpoint protein MAD2A (56-64)
TTDLELIKY

SEQ ID NO: 9296 - protein, 10 aa, Artificial Sequence
  Ubiquitin-like modifier-activating enzyme 6 (145-154)
TTDLSFLDKY

SEQ ID NO: 9297 - protein, 13 aa, Artificial Sequence
  Exosome complex component RRP4 (34-46)
TTDTGFMRGHGTY

SEQ ID NO: 9298 - protein, 9 aa, Artificial Sequence
  SET domain-containing protein 4 (60-68)
TTDTVIRSY

SEQ ID NO: 9299 - protein, 10 aa, Artificial Sequence
  Transmembrane protein 70, mitochondrial (28-37)
TTDTYKAITY

SEQ ID NO: 9300 - protein, 9 aa, Artificial Sequence
  Enhancer of filamentation 1 (432-440)
TTDWRCYGY

SEQ ID NO: 9301 - protein, 12 aa, Artificial Sequence
  Matrin-3 (444-455)
TTEDAQAAVDYY

SEQ ID NO: 9302 - protein, 10 aa, Artificial Sequence
  Superkiller viralicidic activity 2-like 2 (229-238)
TTEILRSMLY

SEQ ID NO: 9303 - protein, 12 aa, Artificial Sequence
  TBCC domain-containing protein 1 (479-490)
TTEIPGGLPSVY

SEQ ID NO: 9304 - protein, 13 aa, Artificial Sequence
  DNA damage-binding protein 1 (894-906)
TTEKELRTECNHY

SEQ ID NO: 9305 - protein, 12 aa, Artificial Sequence
  Mitotic spindle assembly checkpoint protein MAD1 (643-654)
TTENQYRLTSLY

SEQ ID NO: 9306 - protein, 13 aa, Artificial Sequence
  Akirin-2 (77-89)
TTEQILYNIKQEY

SEQ ID NO: 9307 - protein, 10 aa, Artificial Sequence
  vacuolar protein sorting-associated protein 26A isoform 3 (217-226)
TTETETIAKY

SEQ ID NO: 9308 - protein, 13 aa, Artificial Sequence
  BCL2/adenovirus E1B 19 kDa protein-interacting protein 2 (168-180)
TTEVIRKGSITEY

SEQ ID NO: 9309 - protein, 9 aa, Artificial Sequence
  ADP-sugar pyrophosphatase (192-200)
TVDARVYSY

SEQ ID NO: 9310 - protein, 9 aa, Artificial Sequence
  U3 small nucleolar RNA-associated protein 15 homolog (108-116)
TVDFTADKY

SEQ ID NO: 9311 - protein, 10 aa, Artificial Sequence
  Fascin (484-493)
TVDPASLWEY

SEQ ID NO: 9312 - protein, 10 aa, Artificial Sequence
  Proteasome subunit alpha type-7 (97-106)
TVEDPVTVEY

SEQ ID NO: 9313 - protein, 12 aa, Artificial Sequence
  14-3-3 protein epsilon (38-49)
TVEERNLLSVAY

SEQ ID NO: 9314 - protein, 12 aa, Artificial Sequence
  Importin-11 (432-443)
TVEETGGDSWKY

SEQ ID NO: 9315 - protein, 12 aa, Artificial Sequence
  Nodal modulator 2 (271-282)
TVSREDGSFSFY

SEQ ID NO: 9316 - protein, 11 aa, Artificial Sequence
  Tetratricopeptide repeat protein 13 (506-516)
VADRLGSLMQY

SEQ ID NO: 9317 - protein, 13 aa, Artificial Sequence
  Proteasome subunit beta type-4 (85-97)
VIDEELLGDGHSY

SEQ ID NO: 9318 - protein, 10 aa, Artificial Sequence
  Tubulin alpha-1C chain (144-153)
VIDEVRTGTY

SEQ ID NO: 9319 - protein, 12 aa, Artificial Sequence
  Spindlin-3 (381-392)
VIDSLVGKQVEY

SEQ ID NO: 9320 - protein, 10 aa, Artificial Sequence
  Protein HIRA (395-404)
VIENPEMLKY

SEQ ID NO: 9321 - protein, 9 aa, Artificial Sequence
  Beta-hexosaminidase subunit alpha (60-68)
VLDEAFQRY

SEQ ID NO: 9322 - protein, 9 aa, Artificial Sequence
  LETM1 and EF-hand domain-containing protein 1, mitochondrial (157-165)
VLDELKHYY

SEQ ID NO: 9323 - protein, 9 aa, Artificial Sequence
  Activating signal cointegrator 1 complex subunit 2 (386-394)
VLDETRTAY

SEQ ID NO: 9324 - protein, 12 aa, Artificial Sequence
  DNA-directed RNA polymerase I subunit RPA1 (748-759)
VLDKAHYGSSAY

SEQ ID NO: 9325 - protein, 12 aa, Artificial Sequence
  Nucleolar protein 14 (322-333)
VLDKDDRRLLSY

SEQ ID NO: 9326 - protein, 10 aa, Artificial Sequence
  ATP-binding cassette sub-family B member 10, mitochondrial (194-203)
VLDQGKITEY

SEQ ID NO: 9327 - protein, 9 aa, Artificial Sequence
  Kinesin-like protein KIF18B (102-110)
VLDSFLQGY

SEQ ID NO: 9328 - protein, 9 aa, Artificial Sequence
  Ubiquitin-conjugating enzyme E2 Z (270-278)
VMEKSFLEY

SEQ ID NO: 9329 - protein, 9 aa, Artificial Sequence
  Elongator complex protein 1 (872-880)
VSAEEALKY

SEQ ID NO: 9330 - protein, 12 aa, Artificial Sequence
  DNA repair protein XRCC4 (166-177)
VSAKEALETDLY

SEQ ID NO: 9331 - protein, 9 aa, Artificial Sequence
  FERM domain-containing protein 4A (924-932)
VSDELRQWY

SEQ ID NO: 9332 - protein, 10 aa, Artificial Sequence
  Constitutive coactivator of peroxisome proliferator-activated receptor gamma (279-288)
VSDHISKVLY

SEQ ID NO: 9333 - protein, 12 aa, Artificial Sequence
  Importin-5 (842-853)
VSDILHSIFSSY

SEQ ID NO: 9334 - protein, 12 aa, Artificial Sequence
  Splicing factor 1 (136-147)
VSDKVMIPQDEY

SEQ ID NO: 9335 - protein, 9 aa, Artificial Sequence
  Phosphatidylinositol 4-phosphate 3-kinase C2 domain-containing subunit beta (917-925)
VSDLRVTHY

SEQ ID NO: 9336 - protein, 10 aa, Artificial Sequence
  Acetyl-coenzyme A transporter 1 (439-448)
VSDPLIGGTY

SEQ ID NO: 9337 - protein, 13 aa, Artificial Sequence
  Zinc finger protein 275 (31-43)
VSDPSPNTDPAKY

SEQ ID NO: 9338 - protein, 12 aa, Artificial Sequence
  Tripeptidyl-peptidase 1 (68-79)
VSDPSSPQYGKY

SEQ ID NO: 9339 - protein, 13 aa, Artificial Sequence
  Tripeptidyl-peptidase 1 (68-80)
VSDPSSPQYGKYL

SEQ ID NO: 9340 - protein, 11 aa, Artificial Sequence
  Cleavage and polyadenylation specificity factor subunit 1 (1271-1281)
VSDRDRNLMVY

SEQ ID NO: 9341 - protein, 12 aa, Artificial Sequence
  TELO2-interacting protein 1 homolog (40-51)
VSDSALQELQQY

SEQ ID NO: 9342 - protein, 10 aa, Artificial Sequence
  E3 ubiquitin-protein ligase HACE1 (749-758)
VSDWIKNTEY

SEQ ID NO: 9343 - protein, 9 aa, Artificial Sequence
  AT-rich interactive domain-containing protein 2 (138-146)
VSDYLRQSY

SEQ ID NO: 9344 - protein, 11 aa, Artificial Sequence
  Dolichyl-diphosphooligosaccharide-proteinosyltransferase subunit 2 (116-126)
VSEDSSVTQIY

SEQ ID NO: 9345 - protein, 11 aa, Artificial Sequence
  Histone H2B type 1-A (113-123)
VSEGTKAVTKY

SEQ ID NO: 9346 - protein, 12 aa, Artificial Sequence
  Tetraspanin-33 (126-137)
VSEIINNAIVHY

SEQ ID NO: 9347 - protein, 9 aa, Artificial Sequence
  Peroxisome assembly factor 2 (962-970)
VSEQELLRY

SEQ ID NO: 9348 - protein, 10 aa, Artificial Sequence
  TraB domain-containing protein (260-269)
VSERDVYLTY

SEQ ID NO: 9349 - protein, 13 aa, Artificial Sequence
  Paired amphipathic helix protein Sin3a (44-56)
VSETMQSATGIQY

SEQ ID NO: 9350 - protein, 15 aa, Artificial Sequence
  Nuclear pore complex protein Nup160 (1171-1185)
VSEYVDAVLGKGHQY

SEQ ID NO: 9351 - protein, 12 aa, Artificial Sequence
  Oral-facial-digital syndrome 1 protein (787-798)
VSSPPEQKVGLY

SEQ ID NO: 9352 - protein, 11 aa, Artificial Sequence
  Zinc finger protein 106 (703-713)
VSSTSEIGTRY

SEQ ID NO: 9353 - protein, 13 aa, Artificial Sequence
  Nuclear factor of activated T-cells, cytoplasmic 1 (282-294)
VTDDSWLGNTTQY

SEQ ID NO: 9354 - protein, 12 aa, Artificial Sequence
  Mediator of RNA polymerase II transcription subunit 27 (204-215)
VTDHATTALLHY

SEQ ID NO: 9355 - protein, 10 aa, Artificial Sequence
  DnaJ homolog subfamily B member 12 (287-296)
VTDHLGVVYY

SEQ ID NO: 9356 - protein, 11 aa, Artificial Sequence
  Telomerase protein component 1 (1368-1378)
VTDHLRLFTLY

SEQ ID NO: 9357 - protein, 12 aa, Artificial Sequence
  TBC1 domain family member 8 (757-768)
VTDISDLIRDSY

SEQ ID NO: 9358 - protein, 10 aa, Artificial Sequence
  Protein MEF2BNB (13-22)
VTDKFTESVY

SEQ ID NO: 9359 - protein, 12 aa, Artificial Sequence
  Complex I assembly factor TMEM126B, mitochondrial (46-57)
VTDKLFVIDALY

SEQ ID NO: 9360 - protein, 13 aa, Artificial Sequence
  Histone acetyltransferase type B catalytic subunit (339-351)
VTDMSDAEQYRSY

SEQ ID NO: 9361 - protein, 12 aa, Artificial Sequence
  Afadin (762-773)
VTDPDSGLCSHY

SEQ ID NO: 9362 - protein, 10 aa, Artificial Sequence
  Cation-independent mannose-6-phosphate receptor (769-778)
VTDPSTLEQY

SEQ ID NO: 9363 - protein, 10 aa, Artificial Sequence
  DNA polymerase delta subunit 3 (14-23)
VTDQNKIVTY

SEQ ID NO: 9364 - protein, 11 aa, Artificial Sequence
  Gamma-secretase subunit APH-1A (59-69)
VTDRSDARLQY

SEQ ID NO: 9365 - protein, 10 aa, Artificial Sequence
  DNA topoisomerase 2-alpha (1118-1127)
VTDSGPTFNY

SEQ ID NO: 9366 - protein, 10 aa, Artificial Sequence
  Bcl-2-modifying factor (88-97)
VTEEPQRLFY

SEQ ID NO: 9367 - protein, 11 aa, Artificial Sequence
  Protein SET (135-145)
VTEFEDIKSGY

SEQ ID NO: 9368 - protein, 9 aa, Artificial Sequence
  Epididymis-specific alpha-mannosidase (660-668)
VTEIRQYFY

SEQ ID NO: 9369 - protein, 11 aa, Artificial Sequence
  Ras association domain-containing protein 3 (64-74)
VTESPAKFALY

SEQ ID NO: 9370 - protein, 10 aa, Artificial Sequence
  WD repeat-containing protein 63 (174-183)
VTESTKQITY

SEQ ID NO: 9371 - protein, 9 aa, Artificial Sequence
  Uncharacterized protein C15orf61 (132-140)
VTETVHTSY

SEQ ID NO: 9372 - protein, 12 aa, Artificial Sequence
  Nesprin-2 (266-277)
VVDPDEKSIMTY

SEQ ID NO: 9373 - protein, 12 aa, Artificial Sequence
  Spindlin-1 (194-205)
VVDSLVGKQVEY

SEQ ID NO: 9374 - protein, 13 aa, Artificial Sequence
  Protein transport protein Sec61 subunit alpha isoform 1 (324-336)
WSDTSSGGPARAY

SEQ ID NO: 9375 - protein, 10 aa, Artificial Sequence
  Cholinesterase (404-413)
WVDDQRPENY

SEQ ID NO: 9376 - protein, 13 aa, Artificial Sequence
  Acetyl-CoA carboxylase 1 (1775-1787)
WVDPEDPYKGYRY

SEQ ID NO: 9377 - protein, 10 aa, Artificial Sequence
  Proteasome subunit beta type-4 (129-138)
YADGESFLGY

SEQ ID NO: 9378 - protein, 10 aa, Artificial Sequence
  DNA polymerase epsilon catalytic subunit A (1792-1801)
YADNQVMHFY

SEQ ID NO: 9379 - protein, 11 aa, Artificial Sequence
  Sorting nexin-4 (300-310)
YADQLKEYLFY

SEQ ID NO: 9380 - protein, 11 aa, Artificial Sequence
  Cleavage stimulation factor subunit 3 (337-347)
YADYEESRMKY

SEQ ID NO: 9381 - protein, 9 aa, Artificial Sequence
  Transmembrane protein 87A (216-224)
YAEFQNIRY

SEQ ID NO: 9382 - protein, 9 aa, Artificial Sequence
  Transcription elongation factor SPT6 (993-1001)
YGDKHITLY

SEQ ID NO: 9383 - protein, 11 aa, Artificial Sequence
  Lysyl oxidase homolog 3 (543-553)
YIEDRPLHMLY

SEQ ID NO: 9384 - protein, 12 aa, Artificial Sequence
  High mobility group protein 20A (39-50)
YLDEADRDKERY

SEQ ID NO: 9385 - protein, 12 aa, Artificial Sequence
  SWI/SNF-related matrix-associated actin-dependent regulator of chromatin subfamily E member 1-related (119-130)
YLDEAEREKQQY

SEQ ID NO: 9386 - protein, 9 aa, Artificial Sequence
  Prostamide/prostaglandin F synthase (122-130)
YLDESKQLY

SEQ ID NO: 9387 - protein, 9 aa, Artificial Sequence
  putative RHO/RAC effector protein (1124-1132)
YLDIPNPRY

SEQ ID NO: 9388 - protein, 8 aa, Artificial Sequence
  Proteasome activator complex subunit 3 (188-195)
YLDQISRY

SEQ ID NO: 9389 - protein, 12 aa, Artificial Sequence
  E3 ubiquitin-protein ligase TRIM4 (423-434)
YLDRGTGNVSFY

SEQ ID NO: 9390 - protein, 11 aa, Artificial Sequence
  U3 small nucleolar RNA-associated protein 6 homolog (480-490)
YLDWAYRSGGY

SEQ ID NO: 9391 - protein, 11 aa, Artificial Sequence
  E3 ubiquitin-protein ligase UBR2 (1583-1593)
YLEGERDAIRY

SEQ ID NO: 9392 - protein, 12 aa, Artificial Sequence
  MAGUK p55 subfamily member 2 (440-451)
YLEHGEYEGNLY

SEQ ID NO: 9393 - protein, 13 aa, Artificial Sequence
  DNA-directed RNA polymerase II subunit RPB1 (657-669)
YLEMGHDITRLFY

SEQ ID NO: 9394 - protein, 12 aa, Artificial Sequence
  KIF1-binding protein (161-172)
YLESSEALYNQY

SEQ ID NO: 9395 - protein, 10 aa, Artificial Sequence
  Immediate early response gene 5-like protein (47-56)
YLSERYAELY

SEQ ID NO: 9396 - protein, 9 aa, Artificial Sequence
  Cullin-1 (42-50)
YMELYTHVY

SEQ ID NO: 9397 - protein, 9 aa, Artificial Sequence
  Far upstream element-binding protein 1 (632-640)
YSAAWAEYY

SEQ ID NO: 9398 - protein, 13 aa, Artificial Sequence
  Nuclear factor erythroid 2-related factor 1 (12-24)
YSAPPGDPLSTNY

SEQ ID NO: 9399 - protein, 13 aa, Artificial Sequence
  Cohesin subunit SA-2 (319-331)
YSDAFLNDSYLKY

SEQ ID NO: 9400 - protein, 10 aa, Artificial Sequence
  Dimethylaniline monooxygenase (N-oxide-forming) 4 (69-78)
YSDFPFHEDY

SEQ ID NO: 9401 - protein, 12 aa, Artificial Sequence
  Dihydropyrimidine dehydrogenase (NADP(+)) (211-222)
YSDITIFEKQEY

SEQ ID NO: 9402 - protein, 12 aa, Artificial Sequence
  Cyclin-dependent kinases regulatory subunit 2 (8-19)
YSDKYFDEHYEY

SEQ ID NO: 9403 - protein, 11 aa, Artificial Sequence
  Spermatogenesis-associated protein 20 (357-367)
YSDVAKGILQY

SEQ ID NO: 9404 - protein, 11 aa, Artificial Sequence
  F-box only protein 3 (79-89)
YSDVGRYIDHY

SEQ ID NO: 9405 - protein, 9 aa, Artificial Sequence
  AN1-type zinc finger protein 6 (175-183)
YSDVHNCSY

SEQ ID NO: 9406 - protein, 12 aa, Artificial Sequence
  YTH domain-containing family protein 1 (300-311)
YSEDDIHRSIKY

SEQ ID NO: 9407 - protein, 10 aa, Artificial Sequence
  Intraflagellar transport protein 122 homolog (415-424)
YSEDLSDMHY

SEQ ID NO: 9408 - protein, 11 aa, Artificial Sequence
  SUN domain-containing protein 2 (38-48)
YSEDRIGLADY

SEQ ID NO: 9409 - protein, 11 aa, Artificial Sequence
  MICOS complex subunit MIC60 (615-625)
YSEETLRARFY

SEQ ID NO: 9410 - protein, 13 aa, Artificial Sequence
  45 kDa calcium-binding protein (340-352)
YSEFFTGSKLVDY

SEQ ID NO: 9411 - protein, 10 aa, Artificial Sequence
  Protein artemis (322-331)
YSEIKDFLSY

SEQ ID NO: 9412 - protein, 10 aa, Artificial Sequence
  Integrator complex subunit 6 (86-95)
YSELGHPFGY

SEQ ID NO: 9413 - protein, 11 aa, Artificial Sequence
  Plectin (1309-1319)
YSELTTLTSQY

SEQ ID NO: 9414 - protein, 10 aa, Artificial Sequence
  Vacuolar protein sorting-associated protein 13C (3362-3371)
YSEQFLKQMY

SEQ ID NO: 9415 - protein, 9 aa, Artificial Sequence
  Protein Lines homolog 1 (181-189)
YSESNKAIY

SEQ ID NO: 9416 - protein, 12 aa, Artificial Sequence
  Proline-rich protein 7 (145-156)
YSEVLTDTRGLY

SEQ ID NO: 9417 - protein, 10 aa, Artificial Sequence
  Zinc finger MIZ domain-containing protein 2 (269-278)
YSEVYPGQQY

SEQ ID NO: 9418 - protein, 12 aa, Artificial Sequence
  Annexin A4 (298-309)
YSFIKGDTSGDY

SEQ ID NO: 9419 - protein, 10 aa, Artificial Sequence
  Nucleoporin NUP188 homolog (239-248)
YSFLDKMSFY

SEQ ID NO: 9420 - protein, 9 aa, Artificial Sequence
  RNA-binding protein 5 (374-382)
YSQDYQQFY

SEQ ID NO: 9421 - protein, 12 aa, Artificial Sequence
  Serine/arginine-rich splicing factor 10 (105-116)
YSSSRYDDYDRY

SEQ ID NO: 9422 - protein, 9 aa, Artificial Sequence
  Interferon-induced helicase C domain-containing protein 1 (5-13)
YSTDENFRY

SEQ ID NO: 9423 - protein, 9 aa, Artificial Sequence
  Filamin-A (1685-1693)
YTAPQPGKY

SEQ ID NO: 9424 - protein, 12 aa, Artificial Sequence
  DAZ-associated protein 2 (35-46)
YTDAPPAYSELY

SEQ ID NO: 9425 - protein, 8 aa, Artificial Sequence
  Tetraspanin-4 (107-114)
YTDKIDRY

SEQ ID NO: 9426 - protein, 10 aa, Artificial Sequence
  Serine/threonine-protein phosphatase PP1-beta catalytic subunit (68-77)
YTDLLRLFEY

SEQ ID NO: 9427 - protein, 12 aa, Artificial Sequence
  E3 ubiquitin-protein ligase HUWE1 (157-168)
YTDMESEDYHFY

SEQ ID NO: 9428 - protein, 11 aa, Artificial Sequence
  Chromodomain-helicase-DNA-binding protein 8 (513-523)
YTEAEEFFVKY

SEQ ID NO: 9429 - protein, 10 aa, Artificial Sequence
  Protein transport protein Sec61 subunit beta (59-68)
YTEDSPGLKV

SEQ ID NO: 9430 - protein, 13 aa, Artificial Sequence
  DNA-directed RNA polymerases I, II, and III subunit RPABC5 (29-41)
YTEGDALDALGLK

SEQ ID NO: 9431 - protein, 15 aa, Artificial Sequence
  DNA-directed RNA polymerases I, II, and III subunit RPABC5 (29-43)
YTEGDALDALGLKRY

SEQ ID NO: 9432 - protein, 11 aa, Artificial Sequence
  Ribosomal RNA small subunit methyltransferase NEP1 (207-217)
YTEKMVSISNY

SEQ ID NO: 9433 - protein, 10 aa, Artificial Sequence
  Presenilin-2 (112-121)
YTEKNGQLIY

SEQ ID NO: 9434 - protein, 11 aa, Artificial Sequence
  Exocyst complex component 4 (66-76)
YTELTTAIRTY

SEQ ID NO: 9435 - protein, 10 aa, Artificial Sequence
  Prolyl 3-hydroxylase 2 (212-221)
YTEPNYWIRY

SEQ ID NO: 9436 - protein, 11 aa, Artificial Sequence
  Mitogen-activated protein kinase kinase kinase 1 (1349-1359)
YTEQLLRGLSY

SEQ ID NO: 9437 - protein, 12 aa, Artificial Sequence
  Coiled-coil domain-containing protein 121 (212-223)
YTEQPEKVWNSY

SEQ ID NO: 9438 - protein, 10 aa, Artificial Sequence
  Gamma-secretase subunit PEN-2 (47-56)
YTEQSQIKGY

SEQ ID NO: 9439 - protein, 9 aa, Artificial Sequence
  Vacuolar protein sorting-associated protein 18 homolog (381-389)
YTERAVFRY

SEQ ID NO: 9440 - protein, 12 aa, Artificial Sequence
  Osteoclast-stimulating factor 1 (21-32)
YTFEPRTPDELY

SEQ ID NO: 9441 - protein, 10 aa, Artificial Sequence
  Cleavage and polyadenylation specificity factor subunit 5 (45-54)
YTFGTKEPLY

SEQ ID NO: 9442 - protein, 9 aa, Artificial Sequence
  Coatomer subunit alpha (543-551)
YTTSNHIKY

SEQ ID NO: 9443 - protein, 11 aa, Artificial Sequence
  Nodal modulator 2 (270-280)
YTVSREDGSFS

SEQ ID NO: 9444 - protein, 13 aa, Artificial Sequence
  Nodal modulator 2 (270-282)
YTVSREDGSFSFY

SEQ ID NO: 9445 - protein, 12 aa, Artificial Sequence
  Nuclear pore complex protein Nup160 (1174-1185)
YVDAVLGKGHQY

SEQ ID NO: 9446 - protein, 10 aa, Artificial Sequence
  General transcription factor 3C polypeptide 1 (627-636)
YVDDASWMRY

SEQ ID NO: 9447 - protein, 9 aa, Artificial Sequence
  39S ribosomal protein L35, mitochondrial (172-180)
YVDDPYQKY

SEQ ID NO: 9448 - protein, 10 aa, Artificial Sequence
  UDP-N-acetylhexosamine pyrophosphorylase-like protein 1 (277-286)
YVDEEGNLVK

SEQ ID NO: 9449 - protein, 12 aa, Artificial Sequence
  RNA-binding protein 39 (436-447)
YVDKNSAQGNVY

SEQ ID NO: 9450 - protein, 9 aa, Artificial Sequence
  Thioredoxin-like protein AAED1 (118-126)
YVDPEREIY

SEQ ID NO: 9451 - protein, 11 aa, Artificial Sequence
  Transmembrane emp24 domain-containing protein 3 (68-78)
YVEDPQGNTIY

SEQ ID NO: 9452 - protein, 9 aa, Artificial Sequence
  Vacuole membrane protein 1 (94-102)
YVEGVHQQY

SEQ ID NO: 9453 - protein, 11 aa, Artificial Sequence
  Eukaryotic translation initiation factor 3 subunit K (32-42)
YVETQAKENAY

SEQ ID NO: 9454 - protein, 10 aa, Artificial Sequence
  Serine/threonine-protein kinase mTOR (89-98)
AIASLIGVEG

SEQ ID NO: 9455 - protein, 9 aa, Artificial Sequence
  Eukaryotic translation initiation factor 4 gamma 1 (1248-1256)
AIIEEYLHL

SEQ ID NO: 9456 - protein, 9 aa, Artificial Sequence
  Protein timeless homolog (848-856)
AILAHLNTV

SEQ ID NO: 9457 - protein, 9 aa, Artificial Sequence
  Zinc finger and BTB domain-containing protein 6 (396-404)
ALKKHLTSV

SEQ ID NO: 9458 - protein, 9 aa, Artificial Sequence
  Small subunit processome component 20 homolog (626-634)
ALMELFPKL

SEQ ID NO: 9459 - protein, 9 aa, Artificial Sequence
  Ribosome-binding protein 1 (124-132)
ALQKRLDEV

SEQ ID NO: 9460 - protein, 10 aa, Artificial Sequence
  Cytochrome c oxidase subunit 7A2, mitochondrial (74-83)
AVASFPKKQE

SEQ ID NO: 9461 - protein, 9 aa, Artificial Sequence
  DNA-dependent protein kinase catalytic subunit (145-153)
DEFKIGELF

SEQ ID NO: 9462 - protein, 9 aa, Artificial Sequence
  Exosome component 10 (58-66)
DEYDFYRSF

SEQ ID NO: 9463 - protein, 14 aa, Artificial Sequence
  Peptidyl-prolyl cis-trans isomerase A (9-22)
DIAVDGEPLGRVSF

SEQ ID NO: 9464 - protein, 21 aa, Artificial Sequence
  Endoplasmin (783-803)
DVGTDEEEETAKESTAEKDEL

SEQ ID NO: 9465 - protein, 9 aa, Artificial Sequence
  Zinc finger protein 638 (1756-1764)
EEDEDSLAD

SEQ ID NO: 9466 - protein, 9 aa, Artificial Sequence
  Inner centromere protein (48-56)
EFSKEPELM

SEQ ID NO: 9467 - protein, 9 aa, Artificial Sequence
  ATP-binding cassette sub-family A member 3 (1686-1694)
EQVFLSFAH

SEQ ID NO: 9468 - protein, 10 aa, Artificial Sequence
  Vinculin (10-19)
ESILEPVAQQ

SEQ ID NO: 9469 - protein, 9 aa, Artificial Sequence
  Microtubule-associated protein 1A (806-814)
ETELTYPTN

SEQ ID NO: 9470 - protein, 10 aa, Artificial Sequence
  C-Jun-amino-terminal kinase-interacting protein 2 (683-692)
FDVQFLGSVE

SEQ ID NO: 9471 - protein, 19 aa, Artificial Sequence
  Cytochrome c oxidase subunit 7C, mitochondrial (45-63)
FGSAFATPFLVVRHQLLKT

SEQ ID NO: 9472 - protein, 25 aa, Artificial Sequence
  Peptidyl-prolyl cis-trans isomerase A (88-112)
FILKHTGPGILSMANAGPNTNGSQF

SEQ ID NO: 9473 - protein, 10 aa, Artificial Sequence
  Elongation factor 1-alpha 1 (415-424)
FSDYPPLGRF

SEQ ID NO: 9474 - protein, 14 aa, Artificial Sequence
  Elongation factor 1-beta (2-15)
GFGDLKSPAGLQVL

SEQ ID NO: 9475 - protein, 23 aa, Artificial Sequence
  Elongation factor 1-beta (2-24)
GFGDLKSPAGLQVLNDYLADKSY

SEQ ID NO: 9476 - protein, 10 aa, Artificial Sequence
  Plakophilin-2 (581-590)
GLIDSLVHYV

SEQ ID NO: 9477 - protein, 15 aa, Artificial Sequence
  Peptidyl-prolyl cis-trans isomerase A (10-24)
IAVDGEPLGRVSFEL

SEQ ID NO: 9478 - protein, 9 aa, Artificial Sequence
  39S ribosomal protein L34, mitochondrial (58-66)
IKRKNKHGW

SEQ ID NO: 9479 - protein, 9 aa, Artificial Sequence
  Centrosome-associated protein 350 (2297-2305)
ILSKKDLPL

SEQ ID NO: 9480 - protein, 16 aa, Artificial Sequence
  Glyceraldehyde-3-phosphate dehydrogenase (269-284)
ISWYDNEFGYSNRVVD

SEQ ID NO: 9481 - protein, 19 aa, Artificial Sequence
  Macrophage migration inhibitory factor (3-21)
IVNTNVPRASVPDGFLSEL

SEQ ID NO: 9482 - protein, 9 aa, Artificial Sequence
  T-complex protein 1 subunit theta (234-242)
KYNIMLVRL

SEQ ID NO: 9483 - protein, 9 aa, Artificial Sequence
  Ras-related protein Rab-27A (178-186)
LDLIMKRME

SEQ ID NO: 9484 - protein, 9 aa, Artificial Sequence
  Uncharacterized protein C18orf8 (501-509)
LHELVIKTL

SEQ ID NO: 9485 - protein, 9 aa, Artificial Sequence
  ER membrane protein complex subunit 1 (641-649)
LLIDDEYKV

SEQ ID NO: 9486 - protein, 9 aa, Artificial Sequence
  DNA-dependent protein kinase catalytic subunit (2836-2844)
LLQDFNRFL

SEQ ID NO: 9487 - protein, 9 aa, Artificial Sequence
  Acyl-CoA desaturase (132-140)
LPLRLFLII

SEQ ID NO: 9488 - protein, 9 aa, Artificial Sequence
  Serine/threonine-protein kinase tousled-like 1 (49-57)
MDELASLDP

SEQ ID NO: 9489 - protein, 14 aa, Artificial Sequence
  Protein S100-A4 (59-72)
MSNLDSNRDNEVDF

SEQ ID NO: 9490 - protein, 9 aa, Artificial Sequence
  Centriolin (2174-2182)
NLNQFLPEL

SEQ ID NO: 9491 - protein, 9 aa, Artificial Sequence
  Transcriptional repressor CTCF (102-110)
NMEEQPINI

SEQ ID NO: 9492 - protein, 9 aa, Artificial Sequence
  Golgin subfamily A member 3 (875-883)
RLDSELKEL

SEQ ID NO: 9493 - protein, 22 aa, Artificial Sequence
  Cytochrome c oxidase subunit 7C, mitochondrial (17-38)
SHYEEGPGKNLPFSVENKWSLL

SEQ ID NO: 9494 - protein, 11 aa, Artificial Sequence
  Midasin (1471-1481)
SLADDSVLERL

SEQ ID NO: 9495 - protein, 9 aa, Artificial Sequence
  Cullin-7 (999-1007)
SLHTELNSV

SEQ ID NO: 9496 - protein, 9 aa, Artificial Sequence
  Small subunit processome component 20 homolog (299-307)
SLLDLHTKV

SEQ ID NO: 9497 - protein, 11 aa, Artificial Sequence
  Death-inducer obliterator 1 (941-951)
SPLEDLSPCPA

SEQ ID NO: 9498 - protein, 11 aa, Artificial Sequence
  Glycogen debranching enzyme (980-990)
TIAEVGKWLQA

SEQ ID NO: 9499 - protein, 9 aa, Artificial Sequence
  Inositol 1,4,5-trisphosphate receptor type 3 (2354-2362)
TLFNVIKSV

SEQ ID NO: 9500 - protein, 9 aa, Artificial Sequence
  Transmembrane protein 181 (304-312)
TYNPAFSRL

SEQ ID NO: 9501 - protein, 10 aa, Artificial Sequence
  A-kinase anchor protein 9 (1398-1407)
VDSVVITESD

SEQ ID NO: 9502 - protein, 9 aa, Artificial Sequence
  Signal peptidase complex catalytic subunit SEC11A (146-154)
VPYIGIVTI

SEQ ID NO: 9503 - protein, 9 aa, Artificial Sequence
  E3 ubiquitin-protein ligase MYLIP (431-439)
VYLPTHTSL

SEQ ID NO: 9504 - protein, 9 aa, Artificial Sequence
  Guanine nucleotide-binding protein G(i) subunit alpha-2 (155-163)
YYLNDLERI

SEQ ID NO: 9505 - protein, 9 aa, Artificial Sequence
  Peptidyl-prolyl cis-trans isomerase FKBP4 (372-380)
ARADFQKVL

SEQ ID NO: 9506 - protein, 9 aa, Artificial Sequence
  Metaxin-1 (300-308)
ARAPGTRTL

SEQ ID NO: 9507 - protein, 9 aa, Artificial Sequence
  Exosome component 10 (437-445)
ARDDTHYLL

SEQ ID NO: 9508 - protein, 11 aa, Artificial Sequence
  Annexin A2 (195-205)
ARDLYDAGVKR

SEQ ID NO: 9509 - protein, 9 aa, Artificial Sequence
  Coronin-1C (333-341)
ARFFKLHER

SEQ ID NO: 9510 - protein, 9 aa, Artificial Sequence
  Uncharacterized protein KIAA1143 (19-27)
ARFKERVGY

SEQ ID NO: 9511 - protein, 10 aa, Artificial Sequence
  Disabled homolog 2 (41-50)
ARFKGDGVKY

SEQ ID NO: 9512 - protein, 10 aa, Artificial Sequence
  Serine/threonine-protein kinase tousled-like 2 (17-26)
ARFTGVGVSK

SEQ ID NO: 9513 - protein, 9 aa, Artificial Sequence
  ER degradation-enhancing alpha-mannosidase-like protein 1 (134-142)
ARGMFVFGY

SEQ ID NO: 9514 - protein, 12 aa, Artificial Sequence
  Lon protease homolog 2, peroxisomal (291-302)
ARILLDNDHYAM

SEQ ID NO: 9515 - protein, 9 aa, Artificial Sequence
  Chromodomain-helicase-DNA-binding protein 4 (1901-1909)
ARIPPVAVR

SEQ ID NO: 9516 - protein, 10 aa, Artificial Sequence
  Actin-related protein 2/3 complex subunit 4 (157-166)
ARIVAEEFLK

SEQ ID NO: 9517 - protein, 9 aa, Artificial Sequence
  Coiled-coil domain-containing protein 85B (34-42)
ARLAALVQR

SEQ ID NO: 9518 - protein, 11 aa, Artificial Sequence
  THO complex subunit 5 homolog (189-199)
ARLDWELEQRK

SEQ ID NO: 9519 - protein, 10 aa, Artificial Sequence
  Squamous cell carcinoma antigen recognized by T-cells 3 (242-251)
ARLEKVHSLF

SEQ ID NO: 9520 - protein, 9 aa, Artificial Sequence
  G patch domain-containing protein 4 (161-169)
ARLGITMKA

SEQ ID NO: 9521 - protein, 9 aa, Artificial Sequence
  Natural resistance-associated macrophage protein 2 (119-127)
ARLGVVTGL

SEQ ID NO: 9522 - protein, 10 aa, Artificial Sequence
  WD repeat-containing protein 36 (93-102)
ARNKEIVHTF

SEQ ID NO: 9523 - protein, 9 aa, Artificial Sequence
  General transcription factor 3C polypeptide 1 (196-204)
ARSELLTTV

SEQ ID NO: 9524 - protein, 9 aa, Artificial Sequence
  Nucleolin (392-400)
ARTLLAKNL

SEQ ID NO: 9525 - protein, 9 aa, Artificial Sequence
  S-adenosyl-L-methionine-dependent tRNA 4-demethylwyosine synthase (634-642)
ARTPHWALF

SEQ ID NO: 9526 - protein, 9 aa, Artificial Sequence
  Puromycin-sensitive aminopeptidase (236-244)
ARTPVMSTY

SEQ ID NO: 9527 - protein, 9 aa, Artificial Sequence
  Puromycin-sensitive aminopeptidase-like protein (236-244)
ARTPVTSTY

SEQ ID NO: 9528 - protein, 9 aa, Artificial Sequence
  Protocadherin gamma-A11 (880-888)
ARYGPQFTL

SEQ ID NO: 9529 - protein, 9 aa, Artificial Sequence
  Protein ELYS (743-751)
ERIEKLWKR

SEQ ID NO: 9530 - protein, 9 aa, Artificial Sequence
  Unconventional myosin-Ic (223-231)
ERNPQSYLY

SEQ ID NO: 9531 - protein, 9 aa, Artificial Sequence
  TRPM8 channel-associated factor 1 (164-172)
FRGPLVINR

SEQ ID NO: 9532 - protein, 9 aa, Artificial Sequence
  Translocon-associated protein subunit alpha (124-132)
FRYPQDYQF

SEQ ID NO: 9533 - protein, 10 aa, Artificial Sequence
  Protein DEK (128-137)
GQFSGFPFEK

SEQ ID NO: 9534 - protein, 9 aa, Artificial Sequence
  DAZ-associated protein 2 (5-13)
GQYPTQPTY

SEQ ID NO: 9535 - protein, 10 aa, Artificial Sequence
  Sorting and assembly machinery component 50 homolog (154-163)
GRAEKVTFQF

SEQ ID NO: 9536 - protein, 10 aa, Artificial Sequence
  Replication protein A 32 kDa subunit (83-92)
GRAPISNPGM

SEQ ID NO: 9537 - protein, 9 aa, Artificial Sequence
  Eukaryotic peptide chain release factor GTP-binding subunit ERF3A (142-150)
GRAYFETEK

SEQ ID NO: 9538 - protein, 9 aa, Artificial Sequence
  Actin, gamma-enteric smooth muscle (140-148)
GRDLTDYLM

SEQ ID NO: 9539 - protein, 9 aa, Artificial Sequence
  Protocadherin Fat 1 (1957-1965)
GRFAGLTSV

SEQ ID NO: 9540 - protein, 10 aa, Artificial Sequence
  H(+)/Cl(-) exchange transporter 7 (345-354)
GRFDSEKMAY

SEQ ID NO: 9541 - protein, 10 aa, Artificial Sequence
  Zinc finger protein 407 (271-280)
GRFDSSIIRI

SEQ ID NO: 9542 - protein, 10 aa, Artificial Sequence
  U2 small nuclear ribonucleoprotein B'' (185-194)
GRHDIAFVEF

SEQ ID NO: 9543 - protein, 11 aa, Artificial Sequence
  40S ribosomal protein S4, X isoform (171-181)
GRIGVITNRER

SEQ ID NO: 9544 - protein, 11 aa, Artificial Sequence
  40S ribosomal protein S11 (70-80)
GRILSGVVTKM

SEQ ID NO: 9545 - protein, 11 aa, Artificial Sequence
  Desmoplakin (1624-1634)
GRISTEEAIRK

SEQ ID NO: 9546 - protein, 9 aa, Artificial Sequence
  Protein PML (295-303)
GRLDAVLQR

SEQ ID NO: 9547 - protein, 10 aa, Artificial Sequence
  Plectin (581-590)
GRLDLQYAKL

SEQ ID NO: 9548 - protein, 9 aa, Artificial Sequence
  Kelch-like protein 7 (492-500)
GRLGHILEY

SEQ ID NO: 9549 - protein, 9 aa, Artificial Sequence
  H(+)/Cl(-) exchange transporter 3 (772-780)
GRLLGIITK

SEQ ID NO: 9550 - protein, 11 aa, Artificial Sequence
  Heat shock cognate 71 kDa protein (508-518)
GRLSKEDIERM

SEQ ID NO: 9551 - protein, 10 aa, Artificial Sequence
  Protein phosphatase 1 regulatory subunit 3C (303-312)
GRMENLASYR

SEQ ID NO: 9552 - protein, 9 aa, Artificial Sequence
  Integrin-linked protein kinase (45-53)
GRSAVVEML

SEQ ID NO: 9553 - protein, 9 aa, Artificial Sequence
  Interleukin-17 receptor C (13-21)
GRSPVVLSL

SEQ ID NO: 9554 - protein, 10 aa, Artificial Sequence
  Solute carrier family 22 member 18 (21-30)
GRSSVILLTY

SEQ ID NO: 9555 - protein, 11 aa, Artificial Sequence
  Insulin receptor substrate 2 (717-727)
GRTFPASGGGY

SEQ ID NO: 9556 - protein, 9 aa, Artificial Sequence
  Sodium/potassium-transporting ATPase subunit beta-1 (26-34)
GRTGGSWFK

SEQ ID NO: 9557 - protein, 9 aa, Artificial Sequence
  ATP-binding cassette sub-family B member 8, mitochondrial (643-651)
GRTVLVIAH

SEQ ID NO: 9558 - protein, 9 aa, Artificial Sequence
  ATP-dependent RNA helicase A (565-573)
GRTYPVQEY

SEQ ID NO: 9559 - protein, 10 aa, Artificial Sequence
  Sorbin and SH3 domain-containing protein 2 (299-308)
GRVGIFPISY

SEQ ID NO: 9560 - protein, 11 aa, Artificial Sequence
  Poly (ADP-ribose) polymerase 1 (590-600)
GRVGTVIGSNK

SEQ ID NO: 9561 - protein, 9 aa, Artificial Sequence
  Intraflagellar transport protein 172 homolog (293-301)
GRWEQAHKL

SEQ ID NO: 9562 - protein, 9 aa, Artificial Sequence
  Histidine-tRNA ligase, cytoplasmic (247-255)
GRYDGLVGM

SEQ ID NO: 9563 - protein, 10 aa, Artificial Sequence
  DNA mismatch repair protein Msh6 (337-346)
GRYSDSLVQK

SEQ ID NO: 9564 - protein, 11 aa, Artificial Sequence
  Anion exchange protein 2 (262-272)
HRFEDVPGVRR

SEQ ID NO: 9565 - protein, 9 aa, Artificial Sequence
  Probable cation-transporting ATPase 13A2 (626-634)
HRFPFSSAL

SEQ ID NO: 9566 - protein, 9 aa, Artificial Sequence
  26S proteasome non-ATPase regulatory subunit 13 (23-31)
HRLEELYTK

SEQ ID NO: 9567 - protein, 10 aa, Artificial Sequence
  26S proteasome non-ATPase regulatory subunit 13 (23-32)
HRLEELYTKK

SEQ ID NO: 9568 - protein, 9 aa, Artificial Sequence
  40S ribosomal protein S16 (83-91)
IRQSISKAL

SEQ ID NO: 9569 - protein, 9 aa, Artificial Sequence
  RNA-binding motif protein 22 (258-266)
IRTITVVQR

SEQ ID NO: 9570 - protein, 9 aa, Artificial Sequence
  Protein MCM10 homolog (426-434)
KRADLQSTF

SEQ ID NO: 9571 - protein, 10 aa, Artificial Sequence
  Signal peptidase complex subunit 2 (164-173)
KRFDDKYTLK

SEQ ID NO: 9572 - protein, 11 aa, Artificial Sequence
  Unconventional myosin-Ib (37-47)
KRFDHSEIYTY

SEQ ID NO: 9573 - protein, 9 aa, Artificial Sequence
  Eukaryotic translation initiation factor 3 subunit C-like protein (55-63)
KRFEELTNL

SEQ ID NO: 9574 - protein, 9 aa, Artificial Sequence
  KIF1-binding protein (201-209)
KRFEKVYTH

SEQ ID NO: 9575 - protein, 9 aa, Artificial Sequence
  NADH dehydrogenase (ubiquinone) iron-sulfur protein 5 (8-16)
KRFGLNIDR

SEQ ID NO: 9576 - protein, 9 aa, Artificial Sequence
  Peptidyl-prolyl cis-trans isomerase FKBP3 (70-78)
KRFKGTESI

SEQ ID NO: 9577 - protein, 10 aa, Artificial Sequence
  Intron-binding protein aquarius (24-33)
KRHDLVKLGF

SEQ ID NO: 9578 - protein, 9 aa, Artificial Sequence
  THO complex subunit 5 homolog (342-350)
KRHPLSVML

SEQ ID NO: 9579 - protein, 9 aa, Artificial Sequence
  MAP/microtubule affinity-regulating kinase 3 (330-338)
KRIDIMVGM

SEQ ID NO: 9580 - protein, 10 aa, Artificial Sequence
  NADH dehydrogenase (ubiquinone) flavoprotein 2, mitochondrial (61-70)
KRIEAIVKNY

SEQ ID NO: 9581 - protein, 9 aa, Artificial Sequence
  ATP-binding cassette sub-family F member 2 (275-283)
KRILVLVSH

SEQ ID NO: 9582 - protein, 9 aa, Artificial Sequence
  Ceramide synthase 5 (210-218)
KRKDFLIMF

SEQ ID NO: 9583 - protein, 9 aa, Artificial Sequence
  Probable ATP-dependent RNA helicase DDX47 (296-304)
KRLGSLNKF

SEQ ID NO: 9584 - protein, 9 aa, Artificial Sequence
  Transcription intermediary factor 1-beta (207-215)
KRVQVDVKM

SEQ ID NO: 9585 - protein, 9 aa, Artificial Sequence
  Arginine-tRNA ligase, cytoplasmic (579-587)
LRFPEILQK

SEQ ID NO: 9586 - protein, 9 aa, Artificial Sequence
  Neurosecretory protein VGF (4-12)
LRLSASALF

SEQ ID NO: 9587 - protein, 9 aa, Artificial Sequence
  Large proline-rich protein BAG6 (1102-1110)
LRSDIQKRL

SEQ ID NO: 9588 - protein, 11 aa, Artificial Sequence
  Ribonucleoside-diphosphate reductase subunit M2 (271-281)
LRWIGDKEATY

SEQ ID NO: 9589 - protein, 10 aa, Artificial Sequence
  T-complex protein 1 subunit gamma (305-314)
MRANITAIRR

SEQ ID NO: 9590 - protein, 9 aa, Artificial Sequence
  U8 snoRNA-decapping enzyme (48-56)
MRFDGRLGF

SEQ ID NO: 9591 - protein, 9 aa, Artificial Sequence
  Epididymal secretory protein E1 (1-9)
MRFLAATFL

SEQ ID NO: 9592 - protein, 9 aa, Artificial Sequence
  26S proteasome non-ATPase regulatory subunit 2 (477-485)
MRLGSIFGL

SEQ ID NO: 9593 - protein, 9 aa, Artificial Sequence
  Translocon-associated protein subunit alpha (1-9)
MRLLPRLLL

SEQ ID NO: 9594 - protein, 10 aa, Artificial Sequence
  Phenylalanine-tRNA ligase alpha subunit (94-103)
MRLPSGKVGF

SEQ ID NO: 9595 - protein, 9 aa, Artificial Sequence
  Dipeptidyl peptidase 8 (31-39)
NRFKGVKYF

SEQ ID NO: 9596 - protein, 9 aa, Artificial Sequence
  E3 ubiquitin-protein ligase UHRF1 (553-561)
NRYDGIYKV

SEQ ID NO: 9597 - protein, 9 aa, Artificial Sequence
  ATP-dependent RNA helicase DDX19B (371-379)
QRAAVIERF

SEQ ID NO: 9598 - protein, 9 aa, Artificial Sequence
  V-type proton ATPase subunit H (106-114)
QRVSIFFDY

SEQ ID NO: 9599 - protein, 9 aa, Artificial Sequence
  Zinc finger protein 536 (380-388)
RRFKEPWFL

SEQ ID NO: 9600 - protein, 9 aa, Artificial Sequence
  F-box only protein 25 (53-61)
RRFNYVVKL

SEQ ID NO: 9601 - protein, 9 aa, Artificial Sequence
  Myosin-9 (1209-1217)
RRGDLPFVV

SEQ ID NO: 9602 - protein, 11 aa, Artificial Sequence
  Plectin (1853-1863)
RRLAEDEAFQR

SEQ ID NO: 9603 - protein, 11 aa, Artificial Sequence
  60S ribosomal protein L15 (143-153)
RRNPDTQWITK

SEQ ID NO: 9604 - protein, 9 aa, Artificial Sequence
  E3 SUMO-protein ligase RanBP2 (1126-1134)
RRSDDMFTF

SEQ ID NO: 9605 - protein, 9 aa, Artificial Sequence
  F-box only protein 21 (295-303)
RRTGIPISM

SEQ ID NO: 9606 - protein, 9 aa, Artificial Sequence
  Prelamin-A/C (40-48)
RRVDAENRL

SEQ ID NO: 9607 - protein, 10 aa, Artificial Sequence
  Polymerase I and transcript release factor (137-146)
RRVDDFKKAF

SEQ ID NO: 9608 - protein, 12 aa, Artificial Sequence
  Polymerase I and transcript release factor (137-148)
RRVDDFKKAFSK

SEQ ID NO: 9609 - protein, 10 aa, Artificial Sequence
  Hsp90 co-chaperone Cdc37 (166-175)
RRWDDSQKYL

SEQ ID NO: 9610 - protein, 9 aa, Artificial Sequence
  Vascular endothelial growth factor A (62-70)
SRFGGAVVR

SEQ ID NO: 9611 - protein, 9 aa, Artificial Sequence
  Lysosomal protective protein (472-480)
SRFLNKQPY

SEQ ID NO: 9612 - protein, 9 aa, Artificial Sequence
  Decapping and exoribonuclease protein (154-162)
SRFQGTLYL

SEQ ID NO: 9613 - protein, 10 aa, Artificial Sequence
  Glia-derived nexin (207-216)
SRFQPENTKK

SEQ ID NO: 9614 - protein, 9 aa, Artificial Sequence
  Signal transducer and activator of transcription 1-alpha/beta (69-77)
SRFSLENNF

SEQ ID NO: 9615 - protein, 9 aa, Artificial Sequence
  PITH domain-containing protein 1 (143-151)
SRFSNVYHL

SEQ ID NO: 9616 - protein, 9 aa, Artificial Sequence
  Gamma-aminobutyric acid receptor subunit beta-3 (452-460)
SRIVFPFTF

SEQ ID NO: 9617 - protein, 8 aa, Artificial Sequence
  Probable dolichyl pyrophosphate Glc1Man9GlcNAc2 alpha-1,3-glucosyltransferase (267-274)
SRLFPFKR

SEQ ID NO: 9618 - protein, 9 aa, Artificial Sequence
  Lysine-specific demethylase 3B (1181-1189)
SRLPSYFVR

SEQ ID NO: 9619 - protein, 9 aa, Artificial Sequence
  Arginine-tRNA ligase, cytoplasmic (78-86)
SRLQEVFGH

SEQ ID NO: 9620 - protein, 10 aa, Artificial Sequence
  Myeloid leukemia factor 2 (28-37)
SRMLSGGFGY

SEQ ID NO: 9621 - protein, 9 aa, Artificial Sequence
  Protein diaphanous homolog 2 (855-863)
SRNAQSLGF

SEQ ID NO: 9622 - protein, 9 aa, Artificial Sequence
  Catenin beta-1 (646-654)
SRNEGVATY

SEQ ID NO: 9623 - protein, 9 aa, Artificial Sequence
  Nuclear protein localization protein 4 homolog (328-336)
SRNKDTYFL

SEQ ID NO: 9624 - protein, 11 aa, Artificial Sequence
  TOX high mobility group box family member 4 (588-598)
SRNSNTVVFVK

SEQ ID NO: 9625 - protein, 9 aa, Artificial Sequence
  Spectrin beta chain, non-erythrocytic 1 (903-911)
SRVAVVNQI

SEQ ID NO: 9626 - protein, 10 aa, Artificial Sequence
  Aldehyde dehydrogenase family 1 member A3 (318-327)
SRVFVEEQVY

SEQ ID NO: 9627 - protein, 9 aa, Artificial Sequence
  Dystonin (6683-6691)
SRWEKVVQR

SEQ ID NO: 9628 - protein, 11 aa, Artificial Sequence
  Phosphatidylinositol-binding clathrin assembly protein (128-138)
SRYLNEKAVSY

SEQ ID NO: 9629 - protein, 10 aa, Artificial Sequence
  TRPM8 channel-associated factor 1 (46-55)
SRYRLPVATR

SEQ ID NO: 9630 - protein, 9 aa, Artificial Sequence
  Protein yippee-like 5 (33-41)
TRFTGATGR

SEQ ID NO: 9631 - protein, 9 aa, Artificial Sequence
  78 kDa glucose-regulated protein (364-372)
TRIPKIQQL

SEQ ID NO: 9632 - protein, 9 aa, Artificial Sequence
  Ubiquitin-like protein 5 (37-45)
TRWNKIVLK

SEQ ID NO: 9633 - protein, 9 aa, Artificial Sequence
  Zinc finger BED domain-containing protein 5 (574-582)
VRNPFTVTV

SEQ ID NO: 9634 - protein, 10 aa, Artificial Sequence
  Proteasome subunit beta type-4 (223-232)
YRDARSYNRF

SEQ ID NO: 9635 - protein, 10 aa, Artificial Sequence
  Proteasome subunit beta type-4 (22-31)
YRIPSTPDSF

SEQ ID NO: 9636 - protein, 10 aa, Artificial Sequence
  Rho GTPase-activating protein 5 (1010-1019)
YRLDLEGNEY

SEQ ID NO: 9637 - protein, 9 aa, Artificial Sequence
  Pre-mRNA-processing-splicing factor 8 (1786-1794)
YRVTIHKTF

SEQ ID NO: 9638 - protein, 9 aa, Artificial Sequence
  Arginine-glutamic acid dipeptide repeats protein (336-344)
AAAYPHTSL

SEQ ID NO: 9639 - protein, 10 aa, Artificial Sequence
  Lon protease homolog 2, peroxisomal (789-798)
AAFDGGFTVK

SEQ ID NO: 9640 - protein, 9 aa, Artificial Sequence
  Double-stranded RNA-binding protein Staufen homolog 2 (139-147)
AAMKALQAL

SEQ ID NO: 9641 - protein, 10 aa, Artificial Sequence
  26S proteasome non-ATPase regulatory subunit 14 (301-310)
AAMLDTVVFK

SEQ ID NO: 9642 - protein, 9 aa, Artificial Sequence
  40S ribosomal protein S17 (12-20)
AARVIIEKY

SEQ ID NO: 9643 - protein, 9 aa, Artificial Sequence
  Endoplasmic reticulum resident protein 29 (3-11)
AAVPRAAFL

SEQ ID NO: 9644 - protein, 9 aa, Artificial Sequence
  Tyrosine-protein phosphatase non-receptor type 1 (264-272)
ADQLRFSYL

SEQ ID NO: 9645 - protein, 9 aa, Artificial Sequence
  ATP-dependent RNA helicase DDX18 (335-343)
ADRILDVGF

SEQ ID NO: 9646 - protein, 9 aa, Artificial Sequence
  Spectrin alpha chain, non-erythrocytic 1 (781-789)
ADSLRLQQL

SEQ ID NO: 9647 - protein, 8 aa, Artificial Sequence
  Exosome complex exonuclease RRP44 (753-760)
ADVIVHRL

SEQ ID NO: 9648 - protein, 9 aa, Artificial Sequence
  Trafficking protein particle complex subunit 4 (26-34)
AEAEKTFSY

SEQ ID NO: 9649 - protein, 9 aa, Artificial Sequence
  Plectin (2624-2632)
AEAEPEHSF

SEQ ID NO: 9650 - protein, 10 aa, Artificial Sequence
  Spectrin beta chain, non-erythrocytic 1 (1181-1190)
AEAFLNNQEY

SEQ ID NO: 9651 - protein, 11 aa, Artificial Sequence
  Structural maintenance of chromosomes protein 2 (370-380)
AEALAAAQQHF

SEQ ID NO: 9652 - protein, 9 aa, Artificial Sequence
  Coatomer subunit alpha (1048-1056)
AEAQQLITI

SEQ ID NO: 9653 - protein, 11 aa, Artificial Sequence
  Dihydropyrimidinase-related protein 1 (233-243)
AEAVFRAITIA

SEQ ID NO: 9654 - protein, 9 aa, Artificial Sequence
  Mitochondrial import receptor subunit TOM20 homolog (63-71)
AEAVQKFFL

SEQ ID NO: 9655 - protein, 11 aa, Artificial Sequence
  ADP-ribosylation factor 3 (112-122)
AEDELRDAVLL

SEQ ID NO: 9656 - protein, 10 aa, Artificial Sequence
  WD repeat-containing protein 26 (246-255)
AEDLRAKAEW

SEQ ID NO: 9657 - protein, 9 aa, Artificial Sequence
  Mitogen-activated protein kinase kinase kinase 3 (613-621)
AEELLTHHF

SEQ ID NO: 9658 - protein, 10 aa, Artificial Sequence
  LisH domain-containing protein ARMC9 (22-31)
AEFEDTLKTF

SEQ ID NO: 9659 - protein, 10 aa, Artificial Sequence
  RNA-binding protein 28 (545-554)
AEFQEHEHAL

SEQ ID NO: 9660 - protein, 9 aa, Artificial Sequence
  Tubulin alpha-1C chain (243-251)
AEKAYHEQL

SEQ ID NO: 9661 - protein, 9 aa, Artificial Sequence
  Junction plakoglobin (137-145)
AELATRALP

SEQ ID NO: 9662 - protein, 9 aa, Artificial Sequence
  Zinc finger protein 579 (465-473)
AELERAAAL

SEQ ID NO: 9663 - protein, 10 aa, Artificial Sequence
  Myosin-9 (780-789)
AELERLNKQF

SEQ ID NO: 9664 - protein, 9 aa, Artificial Sequence
  F-box/LRR-repeat protein 5 (165-173)
AELLRGLSL

SEQ ID NO: 9665 - protein, 11 aa, Artificial Sequence
  Cyclin-dependent kinase inhibitor 1C (51-61)
AELNAEDQNRW

SEQ ID NO: 9666 - protein, 10 aa, Artificial Sequence
  Calmodulin (104-113)
AELRHVMTNL

SEQ ID NO: 9667 - protein, 9 aa, Artificial Sequence
  Uridine phosphorylase 1 (195-203)
AELSEFTTV

SEQ ID NO: 9668 - protein, 9 aa, Artificial Sequence
  U5 small nuclear ribonucleoprotein 200 kDa helicase (318-326)
AELTGDHQL

SEQ ID NO: 9669 - protein, 9 aa, Artificial Sequence
  E3 ubiquitin/ISG15 ligase TRIM25 (482-490)
AEMPQNYRP

SEQ ID NO: 9670 - protein, 9 aa, Artificial Sequence
  Heterogeneous nuclear ribonucleoprotein U (399-407)
AENPGKYNI

SEQ ID NO: 9671 - protein, 9 aa, Artificial Sequence
  Nuclear pore complex protein Nup160 (377-385)
AENQTVVKY

SEQ ID NO: 9672 - protein, 9 aa, Artificial Sequence
  MORF4 family-associated protein 1 (10-18)
AEPEEVEVL

SEQ ID NO: 9673 - protein, 10 aa, Artificial Sequence
  Matrin-3 (229-238)
AEPYGKIKNY

SEQ ID NO: 9674 - protein, 9 aa, Artificial Sequence
  Exocyst complex component 1 (513-521)
AEQDFISKF

SEQ ID NO: 9675 - protein, 11 aa, Artificial Sequence
  Keratin, type I cytoskeletal 10 (133-143)
AEQNRKDAEAW

SEQ ID NO: 9676 - protein, 10 aa, Artificial Sequence
  14 kDa phosphohistidine phosphatase (38-47)
AESKEIVRGY

SEQ ID NO: 9677 - protein, 9 aa, Artificial Sequence
  Heterogeneous nuclear ribonucleoproteins A2/B1 (61-69)
AEVDAAMAA

SEQ ID NO: 9678 - protein, 9 aa, Artificial Sequence
  Rho GTPase-activating protein 18 (654-662)
AEWVIKSKP

SEQ ID NO: 9679 - protein, 9 aa, Artificial Sequence
  RNA-binding protein 8A (94-102)
AEYGEIKNI

SEQ ID NO: 9680 - protein, 10 aa, Artificial Sequence
  Mitotic checkpoint serine/threonine-protein kinase BUB1 (76-85)
AEYNSDLHQF

SEQ ID NO: 9681 - protein, 11 aa, Artificial Sequence
  T-complex protein 1 subunit eta (249-259)
AGFDATNILNK

SEQ ID NO: 9682 - protein, 9 aa, Artificial Sequence
  Eukaryotic translation initiation factor 4 gamma 1 (1268-1276)
AGHLSTAQY

SEQ ID NO: 9683 - protein, 12 aa, Artificial Sequence
  Cytoplasmic dynein 1 heavy chain 1 (3396-3407)
AIAQLNYADMLK

SEQ ID NO: 9684 - protein, 11 aa, Artificial Sequence
  Transmembrane protein 131 (804-814)
AIFEVNTDLQK

SEQ ID NO: 9685 - protein, 9 aa, Artificial Sequence
  Mortality factor 4-like protein 1 (34-42)
AIKDKQVKY

SEQ ID NO: 9686 - protein, 9 aa, Artificial Sequence
  Endoribonuclease Dicer (608-616)
AILDYLITK

SEQ ID NO: 9687 - protein, 9 aa, Artificial Sequence
  Ceramide synthase 6 (81-89)
AILEKVFTA

SEQ ID NO: 9688 - protein, 11 aa, Artificial Sequence
  Aryl hydrocarbon receptor (422-432)
AIMDPLPLRTK

SEQ ID NO: 9689 - protein, 9 aa, Artificial Sequence
  MICOS complex subunit MIC25 (96-104)
AIQDKLFQV

SEQ ID NO: 9690 - protein, 9 aa, Artificial Sequence
  DNA mismatch repair protein Msh2 (765-773)
AISEYIATK

SEQ ID NO: 9691 - protein, 10 aa, Artificial Sequence
  Cytochrome b-c1 complex subunit 9 (42-51)
AIYDHINEGK

SEQ ID NO: 9692 - protein, 12 aa, Artificial Sequence
  Cytochrome c oxidase subunit 7A2, mitochondrial (69-80)
AIYELAVASFPK

SEQ ID NO: 9693 - protein, 11 aa, Artificial Sequence
  BCL-6 corepressor (147-157)
AIYKTPPGIQK

SEQ ID NO: 9694 - protein, 9 aa, Artificial Sequence
  Apolipoprotein L2 (101-109)
ALAEEVEQV

SEQ ID NO: 9695 - protein, 10 aa, Artificial Sequence
  Epidermal growth factor receptor substrate 15 (283-292)
ALAFHLISQK

SEQ ID NO: 9696 - protein, 9 aa, Artificial Sequence
  E3 ubiquitin-protein ligase RNF114 (70-78)
ALAPGVRAV

SEQ ID NO: 9697 - protein, 9 aa, Artificial Sequence
  Neudesin (124-132)
ALDEVFTKV

SEQ ID NO: 9698 - protein, 9 aa, Artificial Sequence
  JNK1/MAPK8-associated membrane protein (109-117)
ALFQHITAL

SEQ ID NO: 9699 - protein, 9 aa, Artificial Sequence
  Set1/Ash2 histone methyltransferase complex subunit ASH2 (290-298)
ALHDRAPQL

SEQ ID NO: 9700 - protein, 9 aa, Artificial Sequence
  Coiled-coil domain-containing protein 14 (24-32)
ALIEDEHNL

SEQ ID NO: 9701 - protein, 9 aa, Artificial Sequence
  Clustered mitochondria protein homolog (826-834)
ALLDNNIGL

SEQ ID NO: 9702 - protein, 10 aa, Artificial Sequence
  Lysine-specific demethylase 5C (683-692)
ALLEKGITEA

SEQ ID NO: 9703 - protein, 9 aa, Artificial Sequence
  Cleft lip and palate transmembrane protein 1 (348-356)
ALLETNPYL

SEQ ID NO: 9704 - protein, 9 aa, Artificial Sequence
  S100P-binding protein (349-357)
ALMDQVHHM

SEQ ID NO: 9705 - protein, 9 aa, Artificial Sequence
  Brefeldin A-inhibited guanine nucleotide-exchange protein 2 (869-877)
ALMEAVSHA

SEQ ID NO: 9706 - protein, 9 aa, Artificial Sequence
  Exosome complex component MTR3 (214-222)
ALMPVLNQV

SEQ ID NO: 9707 - protein, 11 aa, Artificial Sequence
  Endoplasmic reticulum resident protein 29 (38-48)
ALPLDTVTFYK

SEQ ID NO: 9708 - protein, 9 aa, Artificial Sequence
  Vimentin (268-276)
ALRDVRQQY

SEQ ID NO: 9709 - protein, 9 aa, Artificial Sequence
  Interferon regulatory factor 2-binding protein 1 (300-308)
ALREPGKAL

SEQ ID NO: 9710 - protein, 9 aa, Artificial Sequence
  PR domain zinc finger protein 4 (284-292)
ALSDSIHTV

SEQ ID NO: 9711 - protein, 9 aa, Artificial Sequence
  Annexin A2 (108-116)
ALSGHLETV

SEQ ID NO: 9712 - protein, 9 aa, Artificial Sequence
  Protein CutA (89-97)
ALTDFVRSV

SEQ ID NO: 9713 - protein, 10 aa, Artificial Sequence
  Trafficking protein particle complex subunit 2-like protein (19-28)
ALVDQRELYL

SEQ ID NO: 9714 - protein, 9 aa, Artificial Sequence
  Flap endonuclease 1 (165-173)
ALVKAGKVY

SEQ ID NO: 9715 - protein, 10 aa, Artificial Sequence
  Cofilin-1 (83-92)
ALYDATYETK

SEQ ID NO: 9716 - protein, 9 aa, Artificial Sequence
  COP9 signalosome complex subunit 2 (216-224)
ALYEQSLHI

SEQ ID NO: 9717 - protein, 13 aa, Artificial Sequence
  TGF-beta-activated kinase 1 and MAP3K7-binding protein 1 (311-323)
AMIDTEFAKQTSL

SEQ ID NO: 9718 - protein, 14 aa, Artificial Sequence
  Cyclin-dependent kinase 2-associated protein 2 (6-19)
AMKPPGAQGSQSTY

SEQ ID NO: 9719 - protein, 9 aa, Artificial Sequence
  Poly(rC)-binding protein 1 (249-257)
AMMHGGTGF

SEQ ID NO: 9720 - protein, 9 aa, Artificial Sequence
  Eyes absent homolog 3 (200-208)
APAPAAQRL

SEQ ID NO: 9721 - protein, 9 aa, Artificial Sequence
  Homocysteine-responsive endoplasmic reticulum-resident ubiquitin-like domain member 1 protein (211-219)
APAPIHNQF

SEQ ID NO: 9722 - protein, 9 aa, Artificial Sequence
  Wings apart-like protein homolog (598-606)
APAPPSKVI

SEQ ID NO: 9723 - protein, 9 aa, Artificial Sequence
  Pre-mRNA-splicing factor ATP-dependent RNA helicase PRP16 (41-49)
APAPRPSLL

SEQ ID NO: 9724 - protein, 9 aa, Artificial Sequence
  Two pore calcium channel protein 1 (59-67)
APAVPALRL

SEQ ID NO: 9725 - protein, 9 aa, Artificial Sequence
  Structural maintenance of chromosomes protein 3 (150-158)
APDSQRLKL

SEQ ID NO: 9726 - protein, 9 aa, Artificial Sequence
  Integrator complex subunit 3 (30-38)
APGGGRLLL

SEQ ID NO: 9727 - protein, 17 aa, Artificial Sequence
  Fructose-bisphosphate aldolase A (79-95)
APGKGILAADESTGSIA

SEQ ID NO: 9728 - protein, 9 aa, Artificial Sequence
  DNA/RNA-binding protein KIN17 (338-346)
APGKRILVL

SEQ ID NO: 9729 - protein, 10 aa, Artificial Sequence
  Ribonucleoprotein PTB-binding 1 (298-307)
APGPPGRSML

SEQ ID NO: 9730 - protein, 9 aa, Artificial Sequence
  Sterol regulatory element-binding protein 1 (1104-1112)
APGQRVGML

SEQ ID NO: 9731 - protein, 9 aa, Artificial Sequence
  E3 ubiquitin-protein ligase RNF114 (72-80)
APGVRAVEL

SEQ ID NO: 9732 - protein, 9 aa, Artificial Sequence
  LIM domain and actin-binding protein 1 (397-405)
APIAKVGVL

SEQ ID NO: 9733 - protein, 9 aa, Artificial Sequence
  Destrin (109-117)
APLKSKMIY

SEQ ID NO: 9734 - protein, 11 aa, Artificial Sequence
  Talin-1 (1688-1698)
APREGISQEAL

SEQ ID NO: 9735 - protein, 10 aa, Artificial Sequence
  NADH dehydrogenase (ubiquinone) 1 alpha subcomplex assembly factor 4 (30-39)
APRHPSTNSL

SEQ ID NO: 9736 - protein, 11 aa, Artificial Sequence
  Proline-rich nuclear receptor coactivator 2 (5-15)
APRLNSADRPM

SEQ ID NO: 9737 - protein, 9 aa, Artificial Sequence
  Zinc finger protein 526 (559-567)
APRLPITGL

SEQ ID NO: 9738 - protein, 9 aa, Artificial Sequence
  Protein Wiz (126-134)
APRPGLLSL

SEQ ID NO: 9739 - protein, 11 aa, Artificial Sequence
  Coiled-coil-helix-coiled-coil-helix domain-containing protein 2 (49-59)
APRQPGLMAQM

SEQ ID NO: 9740 - protein, 11 aa, Artificial Sequence
  PHD finger protein 23 (80-90)
APSDLRTIQTF

SEQ ID NO: 9741 - protein, 10 aa, Artificial Sequence
  Aladin (253-262)
APSGGRLLSA

SEQ ID NO: 9742 - protein, 9 aa, Artificial Sequence
  SWI/SNF-related matrix-associated actin-dependent regulator of chromatin subfamily A member 5 (16-24)
APSKPAASI

SEQ ID NO: 9743 - protein, 9 aa, Artificial Sequence
  Pre-mRNA-processing-splicing factor 8 (2018-2026)
APSQQRQQI

SEQ ID NO: 9744 - protein, 10 aa, Artificial Sequence
  Dolichyl-diphosphooligosaccharide-proteinosyltransferase 48 kDa subunit (183-192)
APTIVGKSSL

SEQ ID NO: 9745 - protein, 13 aa, Artificial Sequence
  Eukaryotic initiation factor 4A-II (75-87)
AQAQSGTGKTATF

SEQ ID NO: 9746 - protein, 15 aa, Artificial Sequence
  Crooked neck-like protein 1 (704-718)
AQFELSSGKEGSLTK

SEQ ID NO: 9747 - protein, 9 aa, Artificial Sequence
  Carboxymethylenebutenolidase homolog (123-131)
AQKIGIVGF

SEQ ID NO: 9748 - protein, 9 aa, Artificial Sequence
  Suppressor of SWI4 1 homolog (17-25)
AQLRNLEAY

SEQ ID NO: 9749 - protein, 10 aa, Artificial Sequence
  Hsc70-interacting protein (339-348)
AQNPANMSKY

SEQ ID NO: 9750 - protein, 9 aa, Artificial Sequence
  Protein phosphatase 1 regulatory subunit 15B (54-62)
AQPETRVSY

SEQ ID NO: 9751 - protein, 12 aa, Artificial Sequence
  Putative PIP5K1A and PSMD4-like protein (282-293)
AQREPLSSETQY

SEQ ID NO: 9752 - protein, 9 aa, Artificial Sequence
  Ras-related C3 botulinum toxin substrate 1 (44-52)
ASFENVRAK

SEQ ID NO: 9753 - protein, 10 aa, Artificial Sequence
  Dynein light chain roadblock-type 1 (43-52)
ASLMHSFILK

SEQ ID NO: 9754 - protein, 11 aa, Artificial Sequence
  Heterogeneous nuclear ribonucleoprotein H (160-170)
ASQEIAEKALK

SEQ ID NO: 9755 - protein, 9 aa, Artificial Sequence
  VPS53 protein (19-27)
ASYTKIVVK

SEQ ID NO: 9756 - protein, 11 aa, Artificial Sequence
  Catenin alpha-1 (826-836)
ASYVASTKYQK

SEQ ID NO: 9757 - protein, 9 aa, Artificial Sequence
  Acyl-protein thioesterase 1 (20-28)
ATAAVIFLH

SEQ ID NO: 9758 - protein, 12 aa, Artificial Sequence
  Prohibitin (229-240)
ATAGDGLIELRK

SEQ ID NO: 9759 - protein, 10 aa, Artificial Sequence
  Major facilitator superfamily domain-containing protein 10 (72-81)
ATAIGMPVEK

SEQ ID NO: 9760 - protein, 9 aa, Artificial Sequence
  Biogenesis of lysosome-related organelles complex 1 subunit 1 (109-117)
ATALEYVYK

SEQ ID NO: 9761 - protein, 13 aa, Artificial Sequence
  E3 ubiquitin-protein ligase BRE1A (84-96)
ATDDASLLIVNRY

SEQ ID NO: 9762 - protein, 9 aa, Artificial Sequence
  Alpha-1,2-mannosyltransferase ALG9 (450-458)
ATDPTIHTV

SEQ ID NO: 9763 - protein, 11 aa, Artificial Sequence
  Probable ATP-dependent RNA helicase DDX56 (198-208)
ATFNEDVQALK

SEQ ID NO: 9764 - protein, 9 aa, Artificial Sequence
  Major facilitator superfamily domain-containing protein 10 (320-328)
ATIQGAYAR

SEQ ID NO: 9765 - protein, 9 aa, Artificial Sequence
  E3 ubiquitin-protein ligase MYLIP (151-159)
ATLNSIVAK

SEQ ID NO: 9766 - protein, 9 aa, Artificial Sequence
  Ankyrin repeat domain-containing protein 10 (82-90)
ATLNVSTTR

SEQ ID NO: 9767 - protein, 10 aa, Artificial Sequence
  Filamin-A (829-838)
ATPTSPIRVK

SEQ ID NO: 9768 - protein, 11 aa, Artificial Sequence
  Nucleolar protein 14 (841-851)
ATQEGEWKALK

SEQ ID NO: 9769 - protein, 9 aa, Artificial Sequence
  Cullin-7 (1690-1698)
ATQSFSTFR

SEQ ID NO: 9770 - protein, 10 aa, Artificial Sequence
  Gamma-interferon-inducible protein 16 (234-243)
ATQTQFFHVK

SEQ ID NO: 9771 - protein, 9 aa, Artificial Sequence
  Vesicle transport protein SEC20 (257-265)
ATVLYIVKK

SEQ ID NO: 9772 - protein, 12 aa, Artificial Sequence
  Glycerol-3-phosphate dehydrogenase, mitochondrial (373-384)
ATYGDKAFEVAK

SEQ ID NO: 9773 - protein, 9 aa, Artificial Sequence
  DNA (cytosine-5)-methyltransferase 3A (168-176)
ATYNKQPMY

SEQ ID NO: 9774 - protein, 9 aa, Artificial Sequence
  Cytoplasmic dynein 1 heavy chain 1 (156-164)
AVAPFFKSY

SEQ ID NO: 9775 - protein, 9 aa, Artificial Sequence
  Triple functional domain protein (2585-2593)
AVATKFVNK

SEQ ID NO: 9776 - protein, 9 aa, Artificial Sequence
  Cleavage stimulation factor subunit 1 (359-367)
AVFNHTEDY

SEQ ID NO: 9777 - protein, 10 aa, Artificial Sequence
  Inositol hexakisphosphate and diphosphoinositol-pentakisphosphate kinase 1 (189-198)
AVFPKPFVEK

SEQ ID NO: 9778 - protein, 11 aa, Artificial Sequence
  POTE ankyrin domain family member F (729-739)
AVFPSIVGRPR

SEQ ID NO: 9779 - protein, 9 aa, Artificial Sequence
  Probable ATP-dependent RNA helicase DDX10 (63-71)
AVIENLPKK

SEQ ID NO: 9780 - protein, 11 aa, Artificial Sequence
  Zinc finger protein 292 (1897-1907)
AVIPEKQLVEK

SEQ ID NO: 9781 - protein, 9 aa, Artificial Sequence
  Leucine-rich repeat and calponin homology domain-containing protein 3 (504-512)
AVLDFVKQK

SEQ ID NO: 9782 - protein, 11 aa, Artificial Sequence
  Calcium-binding protein 39 (24-34)
AVLEKQDISDK

SEQ ID NO: 9783 - protein, 9 aa, Artificial Sequence
  Small integral membrane protein 15 (38-46)
AVLSWKLAK

SEQ ID NO: 9784 - protein, 11 aa, Artificial Sequence
  Cytoskeleton-associated protein 5 (403-413)
AVMDNKNPTIK

SEQ ID NO: 9785 - protein, 13 aa, Artificial Sequence
  MICOS complex subunit MIC60 (234-246)
AVQAVNAHSNILK

SEQ ID NO: 9786 - protein, 12 aa, Artificial Sequence
  Ran GTPase-activating protein 1 (489-500)
AVQDAVDALMQK

SEQ ID NO: 9787 - protein, 9 aa, Artificial Sequence
  PRELI domain-containing protein 1, mitochondrial (142-150)
AVQEFGLAR

SEQ ID NO: 9788 - protein, 10 aa, Artificial Sequence
  V-type proton ATPase subunit E 1 (147-156)
AVQKAIPMYK

SEQ ID NO: 9789 - protein, 9 aa, Artificial Sequence
  Lamin-B receptor (364-372)
AVYDFFIGR

SEQ ID NO: 9790 - protein, 13 aa, Artificial Sequence
  Protein phosphatase 1A (57-69)
AVYDGHAGSQVAK

SEQ ID NO: 9791 - protein, 9 aa, Artificial Sequence
  ATPase family AAA domain-containing protein 2 (1085-1093)
AYAIIKEEL

SEQ ID NO: 9792 - protein, 9 aa, Artificial Sequence
  ATP-dependent RNA helicase DHX29 (855-863)
AYLDKSPQF

SEQ ID NO: 9793 - protein, 9 aa, Artificial Sequence
  Structural maintenance of chromosomes protein 6 (494-502)
AYRQGHFTY

SEQ ID NO: 9794 - protein, 9 aa, Artificial Sequence
  Protein PRRC2C (846-854)
AYSVEHNQL

SEQ ID NO: 9795 - protein, 8 aa, Artificial Sequence
  Coatomer subunit alpha (194-201)
DAVVKHVL

SEQ ID NO: 9796 - protein, 8 aa, Artificial Sequence
  Talin-1 (1943-1950)
DAYTKKEL

SEQ ID NO: 9797 - protein, 8 aa, Artificial Sequence
  Spindlin-1 (249-256)
DDFHIYVY

SEQ ID NO: 9798 - protein, 9 aa, Artificial Sequence
  Caldesmon (92-100)
DEAAFLERL

SEQ ID NO: 9799 - protein, 11 aa, Artificial Sequence
  E3 ubiquitin-protein ligase CHIP (39-49)
DEAIANLQRAY

SEQ ID NO: 9800 - protein, 10 aa, Artificial Sequence
  REST corepressor 1 (472-481)
DEAPVLDVRY

SEQ ID NO: 9801 - protein, 9 aa, Artificial Sequence
  Peptidyl-prolyl cis-trans isomerase-like 2 (267-275)
DEDVLRYQF

SEQ ID NO: 9802 - protein, 9 aa, Artificial Sequence
  Annexin A5 (190-198)
DEEKFITIF

SEQ ID NO: 9803 - protein, 9 aa, Artificial Sequence
  Coatomer subunit gamma-1 (781-789)
DEFEKEETF

SEQ ID NO: 9804 - protein, 9 aa, Artificial Sequence
  Pre-mRNA-splicing factor ATP-dependent RNA helicase PRP16 (334-342)
DEFHNPLAY

SEQ ID NO: 9805 - protein, 9 aa, Artificial Sequence
  Calmodulin-like protein 4 (136-144)
DEFIHKITL

SEQ ID NO: 9806 - protein, 8 aa, Artificial Sequence
  Coatomer subunit gamma-1 (373-380)
DEFKVVVV

SEQ ID NO: 9807 - protein, 9 aa, Artificial Sequence
  Eukaryotic translation initiation factor 4 gamma 3 (1231-1239)
DEFLHINDF

SEQ ID NO: 9808 - protein, 9 aa, Artificial Sequence
  F-box/WD repeat-containing protein 5 (42-50)
DEFLWREQF

SEQ ID NO: 9809 - protein, 9 aa, Artificial Sequence
  Calreticulin (166-174)
DEFTHLYTL

SEQ ID NO: 9810 - protein, 8 aa, Artificial Sequence
  Zinc finger RNA-binding protein (575-582)
DEGKVIRF

SEQ ID NO: 9811 - protein, 9 aa, Artificial Sequence
  Sterol O-acyltransferase 1 (163-171)
DEGRLVLEF

SEQ ID NO: 9812 - protein, 8 aa, Artificial Sequence
  L-aminoadipate-semialdehyde dehydrogenase-phosphopantetheinyl transferase (236-243)
DEHHFVAV

SEQ ID NO: 9813 - protein, 9 aa, Artificial Sequence
  Menin (320-328)
DEHIYPYMY

SEQ ID NO: 9814 - protein, 8 aa, Artificial Sequence
  U5 small nuclear ribonucleoprotein 200 kDa helicase (1248-1255)
DEHLITFF

SEQ ID NO: 9815 - protein, 8 aa, Artificial Sequence
  Oxysterol-binding protein-related protein 9 (560-567)
DEHYILTF

SEQ ID NO: 9816 - protein, 10 aa, Artificial Sequence
  Ras GTPase-activating-like protein IQGAP1 (124-133)
DEIGLPKIFY

SEQ ID NO: 9817 - protein, 9 aa, Artificial Sequence
  Hom s 5 (293-301)
DEINFLRAL

SEQ ID NO: 9818 - protein, 10 aa, Artificial Sequence
  Hom s 5 (293-302)
DEINFLRALY

SEQ ID NO: 9819 - protein, 9 aa, Artificial Sequence
  Harmonin (132-140)
DEIVRINGY

SEQ ID NO: 9820 - protein, 9 aa, Artificial Sequence
  Splicing factor 3B subunit 4 (112-120)
DEKLLYDTF

SEQ ID NO: 9821 - protein, 8 aa, Artificial Sequence
  Plectin (380-387)
DEKSIITY

SEQ ID NO: 9822 - protein, 11 aa, Artificial Sequence
  60 kDa heat shock protein, mitochondrial (209-219)
DELEIIEGMKF

SEQ ID NO: 9823 - protein, 9 aa, Artificial Sequence
  tRNA selenocysteine 1-associated protein 1 (146-154)
DELEQKRAL

SEQ ID NO: 9824 - protein, 9 aa, Artificial Sequence
  Vacuolar protein sorting-associated protein 35 (72-80)
DELHYLEVY

SEQ ID NO: 9825 - protein, 8 aa, Artificial Sequence
  Exocyst complex component 4 (59-66)
DELIVQHY

SEQ ID NO: 9826 - protein, 9 aa, Artificial Sequence
  Signal transducer and activator of transcription 2 (704-712)
DELQQPLEL

SEQ ID NO: 9827 - protein, 8 aa, Artificial Sequence
  Spectrin beta chain, non-erythrocytic 1 (545-552)
DEMKVLVL

SEQ ID NO: 9828 - protein, 8 aa, Artificial Sequence
  Eukaryotic initiation factor 4A-I (185-192)
DEMLSRGF

SEQ ID NO: 9829 - protein, 8 aa, Artificial Sequence
  Myosin light polypeptide 6 (58-65)
DEMNVKVL

SEQ ID NO: 9830 - protein, 9 aa, Artificial Sequence
  Ras GTPase-activating protein-binding protein 2 (343-351)
DENELKEFF

SEQ ID NO: 9831 - protein, 9 aa, Artificial Sequence
  Pyruvate kinase PKM (153-161)
DENILWLDY

SEQ ID NO: 9832 - protein, 9 aa, Artificial Sequence
  Argininosuccinate synthase (182-190)
DENLMHISY

SEQ ID NO: 9833 - protein, 10 aa, Artificial Sequence
  HLA class II histocompatibility antigen, DR alpha chain (196-205)
DEPLLKHWEF

SEQ ID NO: 9834 - protein, 9 aa, Artificial Sequence
  RNA-binding protein 3 (18-26)
DEQALEDHF

SEQ ID NO: 9835 - protein, 9 aa, Artificial Sequence
  40S ribosomal protein S6 (20-28)
DERKLRTFY

SEQ ID NO: 9836 - protein, 9 aa, Artificial Sequence
  Myosin-11 (1867-1875)
DERKMAEQY

SEQ ID NO: 9837 - protein, 9 aa, Artificial Sequence
  Carbonic anhydrase 12 (281-289)
DERLVYTSF

SEQ ID NO: 9838 - protein, 9 aa, Artificial Sequence
  Myosin-10 (277-285)
DERTFHIFY

SEQ ID NO: 9839 - protein, 9 aa, Artificial Sequence
  Carboxy-terminal domain RNA polymerase II polypeptide A small phosphatase 2 (109-117)
DETLVHSSF

SEQ ID NO: 9840 - protein, 11 aa, Artificial Sequence
  Alpha-ketoglutarate-dependent dioxygenase FTO (189-199)
DEVDIKSRAAY

SEQ ID NO: 9841 - protein, 8 aa, Artificial Sequence
  FACT complex subunit SPT16 (838-845)
DEVELIHF

SEQ ID NO: 9842 - protein, 9 aa, Artificial Sequence
  Electrogenic sodium bicarbonate cotransporter 1 (306-314)
DEVFHDIAY

SEQ ID NO: 9843 - protein, 8 aa, Artificial Sequence
  Annexin A4 (191-198)
DEVKFLTV

SEQ ID NO: 9844 - protein, 9 aa, Artificial Sequence
  Annexin A4 (191-199)
DEVKFLTVL

SEQ ID NO: 9845 - protein, 9 aa, Artificial Sequence
  Polymerase I and transcript release factor (158-166)
DEVKLPAKL

SEQ ID NO: 9846 - protein, 8 aa, Artificial Sequence
  Protein arginine N-methyltransferase 1 (69-76)
DEVRTLTY

SEQ ID NO: 9847 - protein, 14 aa, Artificial Sequence
  Annexin A2 (52-65)
DEVTIVNILTNRSN

SEQ ID NO: 9848 - protein, 9 aa, Artificial Sequence
  Deoxyribose-phosphate aldolase (278-286)
DEWLKPELF

SEQ ID NO: 9849 - protein, 9 aa, Artificial Sequence
  Cell cycle progression protein 1 (726-734)
DEYIYRHFF

SEQ ID NO: 9850 - protein, 10 aa, Artificial Sequence
  Epidermal growth factor receptor (1014-1023)
DEYLIPQQGF

SEQ ID NO: 9851 - protein, 9 aa, Artificial Sequence
  39S ribosomal protein L49, mitochondrial (43-51)
DEYQFVERL

SEQ ID NO: 9852 - protein, 9 aa, Artificial Sequence
  Talin-1 (125-133)
DEYSLVREL

SEQ ID NO: 9853 - protein, 15 aa, Artificial Sequence
  Peptidyl-prolyl cis-trans isomerase A (9-23)
DIAVDGEPLGRVSFE

SEQ ID NO: 9854 - protein, 9 aa, Artificial Sequence
  DNA (cytosine-5)-methyltransferase 1 (811-819)
DLDSRVLYY

SEQ ID NO: 9855 - protein, 9 aa, Artificial Sequence
  ELKS/Rab6-interacting/CAST family member 1 (356-364)
DLKEKVSLL

SEQ ID NO: 9856 - protein, 9 aa, Artificial Sequence
  Alpha-taxilin (480-488)
DLNKRVQDL

SEQ ID NO: 9857 - protein, 8 aa, Artificial Sequence
  DnaJ homolog subfamily A member 1 (244-251)
DQKDHAVF

SEQ ID NO: 9858 - protein, 9 aa, Artificial Sequence
  Statherin (20-28)
DSSEEKFLR

SEQ ID NO: 9859 - protein, 10 aa, Artificial Sequence
  Protein S100-A9 (67-76)
DTNADKQLSF

SEQ ID NO: 9860 - protein, 8 aa, Artificial Sequence
  Myosin light polypeptide 6 (148-155)
EAFVRHIL

SEQ ID NO: 9861 - protein, 10 aa, Artificial Sequence
  ATP-dependent RNA helicase DDX1 (481-490)
EAIKILKGEY

SEQ ID NO: 9862 - protein, 9 aa, Artificial Sequence
  6-phosphofructo-2-kinase/fructose-2,6-bisphosphatase 3 (57-65)
EAVKQYSSY

SEQ ID NO: 9863 - protein, 9 aa, Artificial Sequence
  Formin-like protein 3 (893-901)
EAYNAVVRY

SEQ ID NO: 9864 - protein, 9 aa, Artificial Sequence
  Elongator complex protein 2 (246-254)
EDWIRGVEW

SEQ ID NO: 9865 - protein, 10 aa, Artificial Sequence
  Vimentin (197-206)
EEAENTLQSF

SEQ ID NO: 9866 - protein, 9 aa, Artificial Sequence
  X-ray repair cross-complementing protein 5 (699-707)
EEAKKFLAP

SEQ ID NO: 9867 - protein, 9 aa, Artificial Sequence
  Prostaglandin G/H synthase 1 (266-274)
EEAPVLMHY

SEQ ID NO: 9868 - protein, 10 aa, Artificial Sequence
  ATP-dependent DNA helicase Q5 (961-970)
EEAQNLIRHF

SEQ ID NO: 9869 - protein, 10 aa, Artificial Sequence
  Chromodomain-helicase-DNA-binding protein 4 (166-175)
EEDYRTLTNY

SEQ ID NO: 9870 - protein, 10 aa, Artificial Sequence
  Nucleolar protein 10 (434-443)
EEEEKQKSTW

SEQ ID NO: 9871 - protein, 9 aa, Artificial Sequence
  Thioredoxin-like protein 1 (254-262)
EEETTRISY

SEQ ID NO: 9872 - protein, 9 aa, Artificial Sequence
  ETS translocation variant 3 (48-56)
EEFRHVIAW

SEQ ID NO: 9873 - protein, 10 aa, Artificial Sequence
  Pre-mRNA-processing-splicing factor 8 (1205-1214)
EEFTHKDGVW

SEQ ID NO: 9874 - protein, 8 aa, Artificial Sequence
  Interferon-induced transmembrane protein 1 (4-11)
EEHEVAVL

SEQ ID NO: 9875 - protein, 10 aa, Artificial Sequence
  Actin, alpha skeletal muscle (101-110)
EEHPTLLTEA

SEQ ID NO: 9876 - protein, 9 aa, Artificial Sequence
  KAT8 regulatory NSL complex subunit 3 (37-45)
EEHVNRTGW

SEQ ID NO: 9877 - protein, 8 aa, Artificial Sequence
  General transcription factor II-I (535-542)
EEIFNLKF

SEQ ID NO: 9878 - protein, 9 aa, Artificial Sequence
  Neutral and basic amino acid transport protein rBAT (294-302)
EEIKEILRF

SEQ ID NO: 9879 - protein, 10 aa, Artificial Sequence
  Calmodulin (87-96)
EEIREAFRVF

SEQ ID NO: 9880 - protein, 9 aa, Artificial Sequence
  Protein PRR14L (198-206)
EEIYTNKNY

SEQ ID NO: 9881 - protein, 11 aa, Artificial Sequence
  Choline-phosphate cytidylyltransferase A (268-278)
EEKSIDLIQKW

SEQ ID NO: 9882 - protein, 9 aa, Artificial Sequence
  Myotubularin-related protein 2 (253-261)
EELKRVASF

SEQ ID NO: 9883 - protein, 10 aa, Artificial Sequence
  Glutathione S-transferase Mu 4 (129-138)
EELPTMMQHF

SEQ ID NO: 9884 - protein, 8 aa, Artificial Sequence
  DNA polymerase epsilon subunit 3 (74-81)
EEMEFQRF

SEQ ID NO: 9885 - protein, 9 aa, Artificial Sequence
  DNA replication licensing factor MCM3 (760-768)
EEMPQVHTP

SEQ ID NO: 9886 - protein, 9 aa, Artificial Sequence
  Serine hydroxymethyltransferase, cytosolic (187-195)
EENARLFHP

SEQ ID NO: 9887 - protein, 8 aa, Artificial Sequence
  Vimentin (348-355)
EENFAVEA

SEQ ID NO: 9888 - protein, 9 aa, Artificial Sequence
  ADP-ribosylation factor-like protein 2-binding protein (56-64)
EENKLIYTP

SEQ ID NO: 9889 - protein, 8 aa, Artificial Sequence
  Signal transducer and activator of transcription 3 (306-313)
EERIVELF

SEQ ID NO: 9890 - protein, 9 aa, Artificial Sequence
  A-kinase-interacting protein 1 (76-84)
EERPPTLSA

SEQ ID NO: 9891 - protein, 9 aa, Artificial Sequence
  Calnexin (478-486)
EERPWLWVV

SEQ ID NO: 9892 - protein, 9 aa, Artificial Sequence
  WASH complex subunit strumpellin (506-514)
EEVQEFHQL

SEQ ID NO: 9893 - protein, 9 aa, Artificial Sequence
  Cytoplasmic FMR1-interacting protein 2 (432-440)
EEYERATRY

SEQ ID NO: 9894 - protein, 11 aa, Artificial Sequence
  Sorting nexin-7 (294-304)
ELDSKVEVLTY

SEQ ID NO: 9895 - protein, 9 aa, Artificial Sequence
  Serine-protein kinase ATM (744-752)
ELFQKAKSL

SEQ ID NO: 9896 - protein, 15 aa, Artificial Sequence
  Heat shock cognate 71 kDa protein (446-460)
ERAMTKDNNLLGKFE

SEQ ID NO: 9897 - protein, 20 aa, Artificial Sequence
  Heat shock protein beta-1 (186-205)
ESRAQLGGPEAAKSDETAAK

SEQ ID NO: 9898 - protein, 9 aa, Artificial Sequence
  40S ribosomal protein S7 (169-177)
ETFSGVYKK

SEQ ID NO: 9899 - protein, 9 aa, Artificial Sequence
  Kelch-like protein 15 (308-316)
ETFYSTERY

SEQ ID NO: 9900 - protein, 9 aa, Artificial Sequence
  Poly (ADP-ribose) polymerase (202-210)
EYNTIKDKF

SEQ ID NO: 9901 - protein, 9 aa, Artificial Sequence
  Dynamin-like 120 kDa protein, mitochondrial (717-725)
FAEDSLRVI

SEQ ID NO: 9902 - protein, 9 aa, Artificial Sequence
  Transcription factor AP-1 (110-118)
FAEGFVRAL

SEQ ID NO: 9903 - protein, 9 aa, Artificial Sequence
  Piezo-type mechanosensitive ion channel component 1 (1665-1673)
FAEGQGRAL

SEQ ID NO: 9904 - protein, 9 aa, Artificial Sequence
  Sister chromatid cohesion protein PDS5 homolog A (273-281)
FAIDPHLLL

SEQ ID NO: 9905 - protein, 9 aa, Artificial Sequence
  Spermatid perinuclear RNA-binding protein (7-15)
FANDDRHVM

SEQ ID NO: 9906 - protein, 9 aa, Artificial Sequence
  Multidrug resistance-associated protein 1 (1201-1209)
FAVISRHSL

SEQ ID NO: 9907 - protein, 10 aa, Artificial Sequence
  Glutathione-specific gamma-glutamylcyclotransferase 1 (89-98)
FAYSDSRVGF

SEQ ID NO: 9908 - protein, 15 aa, Artificial Sequence
  Peptidyl-prolyl cis-trans isomerase A (8-22)
FDIAVDGEPLGRVSF

SEQ ID NO: 9909 - protein, 17 aa, Artificial Sequence
  Peptidyl-prolyl cis-trans isomerase A (8-24)
FDIAVDGEPLGRVSFEL

SEQ ID NO: 9910 - protein, 10 aa, Artificial Sequence
  Probable ATP-dependent RNA helicase DDX56 (464-473)
FEDNPRDLQL

SEQ ID NO: 9911 - protein, 9 aa, Artificial Sequence
  Inhibitor of growth protein 4 (19-27)
FELQRNFQL

SEQ ID NO: 9912 - protein, 10 aa, Artificial Sequence
  Macrophage metalloelastase (449-458)
FEYDFLLQRI

SEQ ID NO: 9913 - protein, 9 aa, Artificial Sequence
  SURP and G-patch domain-containing protein 1 (604-612)
FGIDRPAEL

SEQ ID NO: 9914 - protein, 9 aa, Artificial Sequence
  Signal-induced proliferation-associated 1-like protein 2 (760-768)
FGPPIPKGV

SEQ ID NO: 9915 - protein, 8 aa, Artificial Sequence
  Factor VIII intron 22 protein (50-57)
FGQLGREL

SEQ ID NO: 9916 - protein, 9 aa, Artificial Sequence
  Disintegrin and metalloproteinase domain-containing protein 10 (19-27)
FIQTRGGTF

SEQ ID NO: 9917 - protein, 9 aa, Artificial Sequence
  2'-5'-oligoadenylate synthase 1 (278-286)
FKNPIIEKY

SEQ ID NO: 9918 - protein, 19 aa, Artificial Sequence
  Alpha-enolase (261-279)
FKSPDDPSRYISPDQLADL

SEQ ID NO: 9919 - protein, 9 aa, Artificial Sequence
  Sacsin (89-97)
FLADIVQKL

SEQ ID NO: 9920 - protein, 9 aa, Artificial Sequence
  Serine-protein kinase ATM (1077-1085)
FLADNHHQV

SEQ ID NO: 9921 - protein, 10 aa, Artificial Sequence
  Epithelial discoidin domain-containing receptor 1 (885-894)
FLAEDALNTV

SEQ ID NO: 9922 - protein, 9 aa, Artificial Sequence
  T-complex protein 1 subunit theta (105-113)
FLAKLIAQA

SEQ ID NO: 9923 - protein, 10 aa, Artificial Sequence
  Phospholipid transfer protein (8-17)
FLALLAGAHA

SEQ ID NO: 9924 - protein, 9 aa, Artificial Sequence
  Pseudouridylate synthase 7 homolog-like protein (128-136)
FLDEKTHEL

SEQ ID NO: 9925 - protein, 11 aa, Artificial Sequence
  RuvB-like 2 (433-443)
FLDESRSTQYM

SEQ ID NO: 9926 - protein, 10 aa, Artificial Sequence
  La-related protein 1 (530-539)
FLFDEEMEQM

SEQ ID NO: 9927 - protein, 9 aa, Artificial Sequence
  Alpha-2-macroglobulin receptor-associated protein (22-30)
FLGPWPAAS

SEQ ID NO: 9928 - protein, 9 aa, Artificial Sequence
  Sterol regulatory element-binding protein 2 (1033-1041)
FLHEATVRL

SEQ ID NO: 9929 - protein, 10 aa, Artificial Sequence
  Adenylate kinase 2, mitochondrial (96-105)
FLLDGFPRTV

SEQ ID NO: 9930 - protein, 11 aa, Artificial Sequence
  ATR-interacting protein (164-174)
FLLEQEKTQAL

SEQ ID NO: 9931 - protein, 9 aa, Artificial Sequence
  YY1-associated protein 1 (323-331)
FLNPLISKY

SEQ ID NO: 9932 - protein, 11 aa, Artificial Sequence
  BRCA1-A complex subunit BRE (92-102)
FLPDPSALQNL

SEQ ID NO: 9933 - protein, 9 aa, Artificial Sequence
  Nesprin-2 (5714-5722)
FLTDTSHLL

SEQ ID NO: 9934 - protein, 9 aa, Artificial Sequence
  Transmembrane protein 41B (141-149)
FLYPFPLAL

SEQ ID NO: 9935 - protein, 9 aa, Artificial Sequence
  Zinc finger RNA-binding protein (569-577)
FNDPNAKEM

SEQ ID NO: 9936 - protein, 9 aa, Artificial Sequence
  Fc receptor-like A (169-177)
FPAPILRAV

SEQ ID NO: 9937 - protein, 9 aa, Artificial Sequence
  Sphingolipid delta(4)-desaturase DES1 (265-273)
FPNIPGKSL

SEQ ID NO: 9938 - protein, 11 aa, Artificial Sequence
  Protein SZT2 (903-913)
FPRSPGQPSSL

SEQ ID NO: 9939 - protein, 10 aa, Artificial Sequence
  Dipeptidyl peptidase 8 (180-189)
FQAGSGIYHV

SEQ ID NO: 9940 - protein, 9 aa, Artificial Sequence
  Transient receptor potential cation channel subfamily V member 2 (517-525)
FQHTGIYSV

SEQ ID NO: 9941 - protein, 8 aa, Artificial Sequence
  Elongation factor 1-gamma (423-430)
FQHVGKAF

SEQ ID NO: 9942 - protein, 9 aa, Artificial Sequence
  Phosphatidylcholine translocator ABCB4 (241-249)
FSDKELAAY

SEQ ID NO: 9943 - protein, 8 aa, Artificial Sequence
  Ras GTPase-activating-like protein IQGAP2 (196-203)
FSKIGGIL

SEQ ID NO: 9944 - protein, 9 aa, Artificial Sequence
  RNA-binding protein 4B (186-194)
FTEQYNEQY

SEQ ID NO: 9945 - protein, 9 aa, Artificial Sequence
  F-box DNA helicase 1 (553-561)
FTVPHTHVF

SEQ ID NO: 9946 - protein, 10 aa, Artificial Sequence
  Fas apoptotic inhibitory molecule 1 (167-176)
FVDDGTETHF

SEQ ID NO: 9947 - protein, 9 aa, Artificial Sequence
  DNA damage-binding protein 1 (451-459)
FVDDQQTFF

SEQ ID NO: 9948 - protein, 9 aa, Artificial Sequence
  Interferon regulatory factor 2-binding protein 2 (51-59)
FVIETARQL

SEQ ID NO: 9949 - protein, 9 aa, Artificial Sequence
  Inactive serine/threonine-protein kinase VRK3 (37-45)
FVNPHVSSF

SEQ ID NO: 9950 - protein, 9 aa, Artificial Sequence
  DNA polymerase epsilon catalytic subunit A (732-740)
FYVDTVRAF

SEQ ID NO: 9951 - protein, 11 aa, Artificial Sequence
  NADH dehydrogenase (ubiquinone) flavoprotein 2, mitochondrial (33-43)
GAGGALFVHRD

SEQ ID NO: 9952 - protein, 9 aa, Artificial Sequence
  Complement C1q tumor necrosis factor-related protein 3 (229-237)
GDHQRFSTF

SEQ ID NO: 9953 - protein, 9 aa, Artificial Sequence
  Deoxyribose-phosphate aldolase (201-209)
GEAHLKTIL

SEQ ID NO: 9954 - protein, 11 aa, Artificial Sequence
  ATPase family AAA domain-containing protein 2 (286-296)
GEEENQKRYYL

SEQ ID NO: 9955 - protein, 9 aa, Artificial Sequence
  Interferon regulatory factor 2-binding protein-like (561-569)
GEEQQRQQW

SEQ ID NO: 9956 - protein, 9 aa, Artificial Sequence
  NADPH-cytochrome P450 reductase (240-248)
GEESSIRQY

SEQ ID NO: 9957 - protein, 10 aa, Artificial Sequence
  Coiled-coil domain-containing protein 106 (234-243)
GEFDPSKERL

SEQ ID NO: 9958 - protein, 9 aa, Artificial Sequence
  LIM and senescent cell antigen-like-containing domain protein 1 (75-83)
GEFIIGRVI

SEQ ID NO: 9959 - protein, 11 aa, Artificial Sequence
  Thioredoxin (66-76)
GEFSGANKEKL

SEQ ID NO: 9960 - protein, 12 aa, Artificial Sequence
  Fibrinogen alpha chain (23-34)
GEGDFLAEGGGV

SEQ ID NO: 9961 - protein, 9 aa, Artificial Sequence
  Cytospin-B (579-587)
GEIKHVSSL

SEQ ID NO: 9962 - protein, 9 aa, Artificial Sequence
  Filamin-B (1758-1766)
GEITGEVHM

SEQ ID NO: 9963 - protein, 9 aa, Artificial Sequence
  DNA-directed RNA polymerase III subunit RPC7 (24-32)
GEKLPDVVL

SEQ ID NO: 9964 - protein, 11 aa, Artificial Sequence
  Regulator of nonsense transcripts 1 (585-595)
GELSSADEKRY

SEQ ID NO: 9965 - protein, 12 aa, Artificial Sequence
  Heat shock protein HSP 90-beta (172-183)
GEPIGRGTKVIL

SEQ ID NO: 9966 - protein, 10 aa, Artificial Sequence
  60S ribosomal protein L4 (15-24)
GESSGKNVTL

SEQ ID NO: 9967 - protein, 9 aa, Artificial Sequence
  Prefoldin subunit 6 (11-19)
GEVEKYQQL

SEQ ID NO: 9968 - protein, 10 aa, Artificial Sequence
  60S ribosomal protein L3 (319-328)
GEVTNDFVML

SEQ ID NO: 9969 - protein, 9 aa, Artificial Sequence
  Eukaryotic translation initiation factor 3 subunit L (258-266)
GEYGRHSLY

SEQ ID NO: 9970 - protein, 16 aa, Artificial Sequence
  Keratin, type II cytoskeletal 2 epidermal (142-157)
GGPGGFGPGGYPGGIH

SEQ ID NO: 9971 - protein, 11 aa, Artificial Sequence
  Actin, cytoplasmic 2 (12-22)
GIHETTFNSIM

SEQ ID NO: 9972 - protein, 11 aa, Artificial Sequence
  Glyceraldehyde-3-phosphate dehydrogenase (2-12)
GKVKVGVNGFG

SEQ ID NO: 9973 - protein, 9 aa, Artificial Sequence
  E3 ubiquitin-protein ligase RNF213 (2847-2855)
GLAEDSPKM

SEQ ID NO: 9974 - protein, 9 aa, Artificial Sequence
  Gem-associated protein 4 (541-549)
GLAKAVASV

SEQ ID NO: 9975 - protein, 9 aa, Artificial Sequence
  Histone-lysine N-methyltransferase ASH1L (2026-2034)
GLFPAPIHV

SEQ ID NO: 9976 - protein, 9 aa, Artificial Sequence
  Signal-induced proliferation-associated 1-like protein 2 (957-965)
GLGQLGFHV

SEQ ID NO: 9977 - protein, 9 aa, Artificial Sequence
  Plectin (4147-4155)
GLIDHQTYL

SEQ ID NO: 9978 - protein, 10 aa, Artificial Sequence
  Protein strawberry notch homolog 1 (1078-1087)
GLIGVGLINV

SEQ ID NO: 9979 - protein, 9 aa, Artificial Sequence
  Elongation factor 2 (343-351)
GLKEGIPAL

SEQ ID NO: 9980 - protein, 9 aa, Artificial Sequence
  Coatomer subunit alpha (991-999)
GLKNGVPAV

SEQ ID NO: 9981 - protein, 9 aa, Artificial Sequence
  Serine/threonine-protein kinase 17A (41-49)
GLLTEIRAV

SEQ ID NO: 9982 - protein, 9 aa, Artificial Sequence
  Nuclear receptor corepressor 2 (413-421)
GLMADPMKV

SEQ ID NO: 9983 - protein, 9 aa, Artificial Sequence
  Serine/threonine-protein kinase Sgk1 (62-70)
GLNDFIQKI

SEQ ID NO: 9984 - protein, 9 aa, Artificial Sequence
  MORC family CW-type zinc finger protein 4 (519-527)
GLNNKTIGY

SEQ ID NO: 9985 - protein, 11 aa, Artificial Sequence
  DNA polymerase alpha subunit B (470-480)
GLTSTDLLFHL

SEQ ID NO: 9986 - protein, 11 aa, Artificial Sequence
  C-terminal-binding protein 2 (814-824)
GLVDEKALAQA

SEQ ID NO: 9987 - protein, 10 aa, Artificial Sequence
  Staphylococcal nuclease domain-containing protein 1 (829-838)
GLVKEGLVMV

SEQ ID NO: 9988 - protein, 10 aa, Artificial Sequence
  Basic salivary proline-rich protein 2 (70-79)
GPPPPPGKPQ

SEQ ID NO: 9989 - protein, 11 aa, Artificial Sequence
  Salivary acidic proline-rich phosphoprotein 1/2 (137-147)
GPPPPPPGKPQ

SEQ ID NO: 9990 - protein, 12 aa, Artificial Sequence
  Salivary acidic proline-rich phosphoprotein 1/2 (110-121)
GPPQQGGHPRPP

SEQ ID NO: 9991 - protein, 9 aa, Artificial Sequence
  Nuclear receptor corepressor 1 (1455-1463)
GPSVLRSTL

SEQ ID NO: 9992 - protein, 9 aa, Artificial Sequence
  Histone chaperone ASF1A (103-111)
GQEFIRVGY

SEQ ID NO: 9993 - protein, 9 aa, Artificial Sequence
  Beclin-1 (280-288)
GQFGTINNF

SEQ ID NO: 9994 - protein, 12 aa, Artificial Sequence
  Putative methyltransferase-like protein 15P1 (77-88)
GQFSQAEALLMK

SEQ ID NO: 9995 - protein, 9 aa, Artificial Sequence
  Dual specificity tyrosine-phosphorylation-regulated kinase 1A (32-40)
GQMPHSHQY

SEQ ID NO: 9996 - protein, 11 aa, Artificial Sequence
  Myosin light polypeptide 6 (46-56)
GQNPTNAEVLK

SEQ ID NO: 9997 - protein, 12 aa, Artificial Sequence
  RNA-binding protein EWS (221-232)
GQQSSYGQQSSY

SEQ ID NO: 9998 - protein, 9 aa, Artificial Sequence
  Putative peripheral benzodiazepine receptor-related protein (21-29)
GQWGGGSHY

SEQ ID NO: 9999 - protein, 11 aa, Artificial Sequence
  Store-operated calcium entry-associated regulatory factor (197-207)
GQYSPPPYSEY

SEQ ID NO: 10000 - protein, 10 aa, Artificial Sequence
  EH domain-containing protein 1 (65-74)
GQYSTGKTTF

SEQ ID NO: 10001 - protein, 9 aa, Artificial Sequence
  Protein FAM216A (60-68)
GSDRIKDGY

SEQ ID NO: 10002 - protein, 9 aa, Artificial Sequence
  Splicing factor 3B subunit 1 (46-54)
GSDSRFAGY

SEQ ID NO: 10003 - protein, 9 aa, Artificial Sequence
  AP-2 complex subunit beta (568-576)
GSLASVYHK

SEQ ID NO: 10004 - protein, 9 aa, Artificial Sequence
  L-lactate dehydrogenase A chain (68-76)
GSLFLRTPK

SEQ ID NO: 10005 - protein, 9 aa, Artificial Sequence
  PHD and RING finger domain-containing protein 1 (519-527)
GSSDVIIHR

SEQ ID NO: 10006 - protein, 10 aa, Artificial Sequence
  E3 ubiquitin-protein ligase TRAF7 (378-387)
GSYDPQQIFK

SEQ ID NO: 10007 - protein, 11 aa, Artificial Sequence
  Voltage-dependent anion-selective channel protein 3 (187-197)
GTEFGGSIYQK

SEQ ID NO: 10008 - protein, 11 aa, Artificial Sequence
  Iron-responsive element-binding protein 2 (740-750)
GTFANIKLFNK

SEQ ID NO: 10009 - protein, 11 aa, Artificial Sequence
  Cyclin-dependent kinase 1 (191-201)
GTIFAELATKK

SEQ ID NO: 10010 - protein, 9 aa, Artificial Sequence
  AP-1 complex subunit beta-1 (568-576)
GTLASVYHK

SEQ ID NO: 10011 - protein, 9 aa, Artificial Sequence
  Alpha-ketoglutarate-dependent dioxygenase FTO (329-337)
GTLDYILQR

SEQ ID NO: 10012 - protein, 12 aa, Artificial Sequence
  Structural maintenance of chromosomes protein 4 (663-674)
GTMTGGGSKVMK

SEQ ID NO: 10013 - protein, 9 aa, Artificial Sequence
  Sigma non-opioid intracellular receptor 1 (31-39)
GTQSFVFQR

SEQ ID NO: 10014 - protein, 9 aa, Artificial Sequence
  F-box/WD repeat-containing protein 11 (19-27)
GTSSVIVSR

SEQ ID NO: 10015 - protein, 11 aa, Artificial Sequence
  Protein O-GlcNAcase (729-739)
GTVDVTPFIKK

SEQ ID NO: 10016 - protein, 10 aa, Artificial Sequence
  Transcription factor BTF3 (75-84)
GTVIHFNNPK

SEQ ID NO: 10017 - protein, 9 aa, Artificial Sequence
  Peptidyl-prolyl cis-trans isomerase FKBP4 (277-285)
GTVYFKEGK

SEQ ID NO: 10018 - protein, 9 aa, Artificial Sequence
  Tubulin-folding cofactor B (7-15)
GVDDKFYSK

SEQ ID NO: 10019 - protein, 11 aa, Artificial Sequence
  Activating signal cointegrator 1 complex subunit 1 (166-176)
GVDSSIFQNPK

SEQ ID NO: 10020 - protein, 9 aa, Artificial Sequence
  Eukaryotic translation initiation factor 4 gamma 1 (757-765)
GVIDLIFEK

SEQ ID NO: 10021 - protein, 9 aa, Artificial Sequence
  40S ribosomal protein S19 (86-94)
GVMPSHFSR

SEQ ID NO: 10022 - protein, 9 aa, Artificial Sequence
  Heat shock cognate 71 kDa protein (408-416)
GVMTVLIKR

SEQ ID NO: 10023 - protein, 9 aa, Artificial Sequence
  Polypyrimidine tract-binding protein 3 (285-293)
GVYGDVHRV

SEQ ID NO: 10024 - protein, 10 aa, Artificial Sequence
  Polypyrimidine tract-binding protein 2 (308-317)
GVYGDVQRVK

SEQ ID NO: 10025 - protein, 9 aa, Artificial Sequence
  Mitochondrial genome maintenance exonuclease 1 (204-212)
GYIESVQHI

SEQ ID NO: 10026 - protein, 9 aa, Artificial Sequence
  Catenin beta-1 (186-194)
HAIMRSPQM

SEQ ID NO: 10027 - protein, 9 aa, Artificial Sequence
  Adenylyl cyclase-associated protein 1 (417-425)
HAYLSKNSL

SEQ ID NO: 10028 - protein, 9 aa, Artificial Sequence
  Surfeit locus protein 4 (232-240)
HDFLKYDFF

SEQ ID NO: 10029 - protein, 9 aa, Artificial Sequence
  NEDD4-binding protein 2-like 1 (64-72)
HDFPRALIF

SEQ ID NO: 10030 - protein, 9 aa, Artificial Sequence
  Cold shock domain-containing protein E1 (507-515)
HDKEIFFHY

SEQ ID NO: 10031 - protein, 9 aa, Artificial Sequence
  Protein Niban (200-208)
HDYMKQMTF

SEQ ID NO: 10032 - protein, 9 aa, Artificial Sequence
  Zinc finger and BTB domain-containing protein 38 (210-218)
HEAEPVRTL

SEQ ID NO: 10033 - protein, 10 aa, Artificial Sequence
  Synaptic vesicle membrane protein VAT-1 homolog (222-231)
HEALKENGVT

SEQ ID NO: 10034 - protein, 9 aa, Artificial Sequence
  Protein sel-1 homolog 3 (891-899)
HEALLYYVL

SEQ ID NO: 10035 - protein, 10 aa, Artificial Sequence
  Nuclear migration protein nudC (79-88)
HEAQLKNGSL

SEQ ID NO: 10036 - protein, 9 aa, Artificial Sequence
  EH domain-containing protein 1 (210-218)
HEDKIRVVL

SEQ ID NO: 10037 - protein, 9 aa, Artificial Sequence
  Exosome complex exonuclease RRP44 (679-687)
HEEFSEHAL

SEQ ID NO: 10038 - protein, 9 aa, Artificial Sequence
  Repressor of RNA polymerase III transcription MAF1 homolog (116-124)
HEFSREPSL

SEQ ID NO: 10039 - protein, 9 aa, Artificial Sequence
  Versican core protein (1534-1542)
HEHTEPVSL

SEQ ID NO: 10040 - protein, 9 aa, Artificial Sequence
  Sphingolipid delta(4)-desaturase DES1 (89-97)
HEIAHNAAF

SEQ ID NO: 10041 - protein, 10 aa, Artificial Sequence
  Histone-lysine N-methyltransferase 2E (353-362)
HEIQDGTIHL

SEQ ID NO: 10042 - protein, 9 aa, Artificial Sequence
  Endothelial PAS domain-containing protein 1 (39-47)
HELPLPHSV

SEQ ID NO: 10043 - protein, 10 aa, Artificial Sequence
  ATP-dependent RNA helicase DHX8 (1152-1161)
HELVLTTKEY

SEQ ID NO: 10044 - protein, 8 aa, Artificial Sequence
  E3 ubiquitin-protein ligase RNF213 (1247-1254)
HEMIILKL

SEQ ID NO: 10045 - protein, 9 aa, Artificial Sequence
  Histone-lysine N-methyltransferase NSD2 (449-457)
HENDITHFY

SEQ ID NO: 10046 - protein, 9 aa, Artificial Sequence
  Sorting nexin-6 (212-220)
HERTFLLEY

SEQ ID NO: 10047 - protein, 9 aa, Artificial Sequence
  Heterogeneous nuclear ribonucleoprotein K (415-423)
HESGASIKI

SEQ ID NO: 10048 - protein, 9 aa, Artificial Sequence
  Amyloid-like protein 2 (692-700)
HGYENPTYK

SEQ ID NO: 10049 - protein, 9 aa, Artificial Sequence
  Transcription initiation factor TFIID subunit 4 (42-50)
HLAPRTPEV

SEQ ID NO: 10050 - protein, 9 aa, Artificial Sequence
  Cysteine and histidine-rich protein 1 (106-114)
HLGPEGRSV

SEQ ID NO: 10051 - protein, 10 aa, Artificial Sequence
  Formin-like protein 2 (244-253)
HPHAVNEIAL

SEQ ID NO: 10052 - protein, 9 aa, Artificial Sequence
  KRR1 small subunit processome component homolog (214-222)
HPIYNIKSL

SEQ ID NO: 10053 - protein, 10 aa, Artificial Sequence
  HLA class I histocompatibility antigen, Cw-7 alpha chain (216-225)
HPLSDHEATL

SEQ ID NO: 10054 - protein, 9 aa, Artificial Sequence
  V-type proton ATPase 116 kDa subunit a isoform 3 (715-723)
HQAIHTIEF

SEQ ID NO: 10055 - protein, 9 aa, Artificial Sequence
  Dymeclin (278-286)
HQNSNIRTY

SEQ ID NO: 10056 - protein, 8 aa, Artificial Sequence
  WD repeat-containing protein 1 (59-66)
HQVVVAKY

SEQ ID NO: 10057 - protein, 9 aa, Artificial Sequence
  HLA class I histocompatibility antigen, A-2 alpha chain (73-81)
HRVDLGTLR

SEQ ID NO: 10058 - protein, 8 aa, Artificial Sequence
  Endoplasmic reticulum resident protein 44 (95-102)
HSDIAQRY

SEQ ID NO: 10059 - protein, 9 aa, Artificial Sequence
  Histone deacetylase 4 (715-723)
HSEAHTLLY

SEQ ID NO: 10060 - protein, 9 aa, Artificial Sequence
  Nucleolar protein 10 (122-130)
HSQSGFYYK

SEQ ID NO: 10061 - protein, 8 aa, Artificial Sequence
  Eukaryotic translation initiation factor 3 subunit F (182-189)
HSVLIHEY

SEQ ID NO: 10062 - protein, 9 aa, Artificial Sequence
  Dual specificity protein phosphatase 5 (234-242)
HTADISSHF

SEQ ID NO: 10063 - protein, 10 aa, Artificial Sequence
  AP-3 complex subunit delta-1 (383-392)
HVDKAEGTTY

SEQ ID NO: 10064 - protein, 9 aa, Artificial Sequence
  Rac GTPase-activating protein 1 (480-488)
HVIENSNAF

SEQ ID NO: 10065 - protein, 9 aa, Artificial Sequence
  T-complex protein 1 subunit epsilon (135-143)
HVIETLIGK

SEQ ID NO: 10066 - protein, 9 aa, Artificial Sequence
  Triple functional domain protein (477-485)
HVLDVIHEV

SEQ ID NO: 10067 - protein, 9 aa, Artificial Sequence
  Manganese-transporting ATPase 13A1 (956-964)
IAAPFTSKL

SEQ ID NO: 10068 - protein, 15 aa, Artificial Sequence
  Solute carrier family 2, facilitated glucose transporter member 1 (21-35)
IAQVFGLDSIMGNKD

SEQ ID NO: 10069 - protein, 8 aa, Artificial Sequence
  Insulin receptor substrate 2 (1323-1330)
IDFLSHHL

SEQ ID NO: 10070 - protein, 8 aa, Artificial Sequence
  Neuroblast differentiation-associated protein AHNAK (4419-4426)
IDIKGPSL

SEQ ID NO: 10071 - protein, 9 aa, Artificial Sequence
  Tripeptidyl-peptidase 2 (1087-1095)
IDQTALAVY

SEQ ID NO: 10072 - protein, 11 aa, Artificial Sequence
  U5 small nuclear ribonucleoprotein 200 kDa helicase (803-813)
IEEPSAKINVL

SEQ ID NO: 10073 - protein, 9 aa, Artificial Sequence
  Structural maintenance of chromosomes protein 1A (7-15)
IEIENFKSY

SEQ ID NO: 10074 - protein, 8 aa, Artificial Sequence
  Casein kinase I isoform delta (51-58)
IESKIYKM

SEQ ID NO: 10075 - protein, 8 aa, Artificial Sequence
  Protein S100-A9 (12-19)
IETIINTF

SEQ ID NO: 10076 - protein, 10 aa, Artificial Sequence
  Probable UDP-sugar transporter protein SLC35A5 (264-273)
IFIQNSKLYF

SEQ ID NO: 10077 - protein, 10 aa, Artificial Sequence
  Pre-mRNA-processing-splicing factor 8 (1809-1818)
IFNPRTGQLF

SEQ ID NO: 10078 - protein, 13 aa, Artificial Sequence
  ATP synthase-coupling factor 6, mitochondrial (25-37)
IGVTAVAFNKELD

SEQ ID NO: 10079 - protein, 9 aa, Artificial Sequence
  DNA damage-binding protein 1 (793-801)
IIDQHTFEV

SEQ ID NO: 10080 - protein, 9 aa, Artificial Sequence
  26S proteasome non-ATPase regulatory subunit 2 (809-817)
IILGKSHYV

SEQ ID NO: 10081 - protein, 12 aa, Artificial Sequence
  Elongation factor 1-alpha 1 (178-189)
IKKIGYNPDTVA

SEQ ID NO: 10082 - protein, 11 aa, Artificial Sequence
  Probable ATP-dependent RNA helicase DDX60-like (1497-1507)
ILAELPEDFKA

SEQ ID NO: 10083 - protein, 9 aa, Artificial Sequence
  Interferon-induced GTP-binding protein Mx2 (436-444)
ILATNTQKV

SEQ ID NO: 10084 - protein, 11 aa, Artificial Sequence
  Eukaryotic translation initiation factor 4 gamma 3 (389-399)
ILENPPEEMKL

SEQ ID NO: 10085 - protein, 9 aa, Artificial Sequence
  ATP-dependent RNA helicase DDX42 (333-341)
ILIDPIRVV

SEQ ID NO: 10086 - protein, 9 aa, Artificial Sequence
  Phosphorylated CTD-interacting factor 1 (267-275)
IMNDIPIRL

SEQ ID NO: 10087 - protein, 9 aa, Artificial Sequence
  RNA polymerase-associated protein CTR9 homolog (124-132)
IMYDQNHLL

SEQ ID NO: 10088 - protein, 17 aa, Artificial Sequence
  Cystatin-A (2-18)
IPGGLSEAKPATPEIQE

SEQ ID NO: 10089 - protein, 10 aa, Artificial Sequence
  Splicing factor U2AF 65 kDa subunit (413-422)
IPRPVDGVEV

SEQ ID NO: 10090 - protein, 9 aa, Artificial Sequence
  Membrane-bound transcription factor site-1 protease (189-197)
IPRQVAQTL

SEQ ID NO: 10091 - protein, 11 aa, Artificial Sequence
  Cytospin-A (862-872)
IPRTPLSPSPM

SEQ ID NO: 10092 - protein, 11 aa, Artificial Sequence
  Filamin-A (1569-1579)
IQDNHDGTYTV

SEQ ID NO: 10093 - protein, 11 aa, Artificial Sequence
  UBX domain-containing protein 4 (322-332)
IQFRLPDGSSF

SEQ ID NO: 10094 - protein, 10 aa, Artificial Sequence
  Thyroid receptor-interacting protein 11 (87-96)
IQIKQQSTSY

SEQ ID NO: 10095 - protein, 9 aa, Artificial Sequence
  Coatomer subunit delta (393-401)
IQVTKVTQV

SEQ ID NO: 10096 - protein, 9 aa, Artificial Sequence
  Kinesin-like protein KIF11 (400-408)
ISEENFRVM

SEQ ID NO: 10097 - protein, 14 aa, Artificial Sequence
  FAST kinase domain-containing protein 2 (542-555)
ISELLTSDDMKNAY

SEQ ID NO: 10098 - protein, 9 aa, Artificial Sequence
  LEM domain-containing protein 2 (23-31)
ITDTTRDVY

SEQ ID NO: 10099 - protein, 16 aa, Artificial Sequence
  Galectin-3 (132-147)
ITILGTVKPNANRIAL

SEQ ID NO: 10100 - protein, 9 aa, Artificial Sequence
  NADH dehydrogenase (ubiquinone) 1 beta subcomplex subunit 10 (34-42)
IVDRPVTLV

SEQ ID NO: 10101 - protein, 9 aa, Artificial Sequence
  Cell division cycle protein 27 homolog (695-703)
IVIDPKNPL

SEQ ID NO: 10102 - protein, 14 aa, Artificial Sequence
  Macrophage migration inhibitory factor (3-16)
IVNTNVPRASVPDG

SEQ ID NO: 10103 - protein, 10 aa, Artificial Sequence
  Solute carrier family 12 member 6 (219-228)
IYAGAIKSSF

SEQ ID NO: 10104 - protein, 9 aa, Artificial Sequence
  ATP-dependent RNA helicase DHX29 (1317-1325)
IYFQAPVKI

SEQ ID NO: 10105 - protein, 9 aa, Artificial Sequence
  Tripeptidyl-peptidase 2 (478-486)
IYLRDPVQV

SEQ ID NO: 10106 - protein, 9 aa, Artificial Sequence
  BCL2/adenovirus E1B 19 kDa protein-interacting protein 3 (38-46)
IYNGDMEKI

SEQ ID NO: 10107 - protein, 9 aa, Artificial Sequence
  Serine/threonine-protein phosphatase 2A 56 kDa regulatory subunit gamma isoform (91-99)
IYPEVVHMF

SEQ ID NO: 10108 - protein, 11 aa, Artificial Sequence
  Flotillin-2 (104-114)
IYQDRDQFAKL

SEQ ID NO: 10109 - protein, 9 aa, Artificial Sequence
  Bardet-Biedl syndrome 4 protein (45-53)
IYQKAFEHL

SEQ ID NO: 10110 - protein, 9 aa, Artificial Sequence
  Signal transducer and activator of transcription 6 (87-95)
IYQRDPLKL

SEQ ID NO: 10111 - protein, 9 aa, Artificial Sequence
  Progestin and adipoQ receptor family member 4 (52-60)
IYTHGLALL

SEQ ID NO: 10112 - protein, 8 aa, Artificial Sequence
  40S ribosomal protein S23 (29-36)
KAHLGTAL

SEQ ID NO: 10113 - protein, 9 aa, Artificial Sequence
  Peroxisomal membrane protein PMP34 (213-221)
KAIATTVTY

SEQ ID NO: 10114 - protein, 9 aa, Artificial Sequence
  Protein PRRC2C (2255-2263)
KAWENSPNV

SEQ ID NO: 10115 - protein, 10 aa, Artificial Sequence
  Polycystic kidney disease and receptor for egg jelly-related protein (701-710)
KDFLPAGYLL

SEQ ID NO: 10116 - protein, 9 aa, Artificial Sequence
  FERM domain-containing protein 6 (545-553)
KDFLRIAGL

SEQ ID NO: 10117 - protein, 11 aa, Artificial Sequence
  Microtubule-actin cross-linking factor 1, isoforms 1/2/3/5 (2405-2415)
KDKLKDATERY

SEQ ID NO: 10118 - protein, 9 aa, Artificial Sequence
  Calcium-binding protein 39 (189-197)
KDLLTRHKL

SEQ ID NO: 10119 - protein, 9 aa, Artificial Sequence
  Ribonucleoside-diphosphate reductase subunit M2 B (73-81)
KDLPHWNKL

SEQ ID NO: 10120 - protein, 9 aa, Artificial Sequence
  Spectrin beta chain, non-erythrocytic 1 (655-663)
KDLTSVMRL

SEQ ID NO: 10121 - protein, 9 aa, Artificial Sequence
  Plastin-3 (18-26)
KEAFAKVDL

SEQ ID NO: 10122 - protein, 9 aa, Artificial Sequence
  Protein Red (496-504)
KEALPKAAF

SEQ ID NO: 10123 - protein, 10 aa, Artificial Sequence
  Protein KHNYN (158-167)
KEALQDPFTL

SEQ ID NO: 10124 - protein, 9 aa, Artificial Sequence
  40S ribosomal protein S15 (65-73)
KEAPPMEKP

SEQ ID NO: 10125 - protein, 9 aa, Artificial Sequence
  Protein transport protein Sec23B (564-572)
KEDPTSFRL

SEQ ID NO: 10126 - protein, 11 aa, Artificial Sequence
  Tropomyosin alpha-4 chain (228-238)
KEENVGLHQTL

SEQ ID NO: 10127 - protein, 10 aa, Artificial Sequence
  Putative methyltransferase NSUN6 (163-172)
KEFDGTKVFL

SEQ ID NO: 10128 - protein, 10 aa, Artificial Sequence
  Sin3 histone deacetylase corepressor complex component SDS3 (137-146)
KEFEDKKVEL

SEQ ID NO: 10129 - protein, 9 aa, Artificial Sequence
  Heat shock protein HSP 90-alpha (656-664)
KEFEGKTLV

SEQ ID NO: 10130 - protein, 9 aa, Artificial Sequence
  Protein S100-A10 (37-45)
KEFPGFLEN

SEQ ID NO: 10131 - protein, 12 aa, Artificial Sequence
  Serine palmitoyltransferase 2 (526-537)
KEIDEVGDLLQL

SEQ ID NO: 10132 - protein, 9 aa, Artificial Sequence
  Melanoma-associated antigen D4 (471-479)
KEIDKEEHL

SEQ ID NO: 10133 - protein, 13 aa, Artificial Sequence
  Spectrin beta chain, non-erythrocytic 1 (1434-1446)
KEIEELQSQAQAL

SEQ ID NO: 10134 - protein, 12 aa, Artificial Sequence
  Calcium/calmodulin-dependent protein kinase type IV (135-146)
KEIFETPTEISL

SEQ ID NO: 10135 - protein, 9 aa, Artificial Sequence
  E3 ubiquitin-protein ligase RNF19B (187-195)
KEISDLHYL

SEQ ID NO: 10136 - protein, 9 aa, Artificial Sequence
  Centromere protein F (392-400)
KEKEFQEEL

SEQ ID NO: 10137 - protein, 10 aa, Artificial Sequence
  Girdin (728-737)
KELESEKEQL

SEQ ID NO: 10138 - protein, 10 aa, Artificial Sequence
  Testin (173-182)
KEMEQFVKKY

SEQ ID NO: 10139 - protein, 10 aa, Artificial Sequence
  Leucine-tRNA ligase, cytoplasmic (775-784)
KEMVANWDSL

SEQ ID NO: 10140 - protein, 10 aa, Artificial Sequence
  SWI/SNF-related matrix-associated actin-dependent regulator of chromatin subfamily B member 1 (277-286)
KENSPEKFAL

SEQ ID NO: 10141 - protein, 11 aa, Artificial Sequence
  Squalene monooxygenase (157-167)
KEPDRIVGEFL

SEQ ID NO: 10142 - protein, 9 aa, Artificial Sequence
  Calcium uptake protein 2, mitochondrial (204-212)
KEPEINTTL

SEQ ID NO: 10143 - protein, 9 aa, Artificial Sequence
  Farnesyl pyrophosphate synthase (39-47)
KEVLEYNAI

SEQ ID NO: 10144 - protein, 8 aa, Artificial Sequence
  Tetratricopeptide repeat protein 25 (351-358)
KEYDLPDA

SEQ ID NO: 10145 - protein, 10 aa, Artificial Sequence
  Inhibitor of growth protein 5 (76-85)
KEYSDDKVQL

SEQ ID NO: 10146 - protein, 9 aa, Artificial Sequence
  Son of sevenless homolog 2 (677-685)
KEYVQPVQL

SEQ ID NO: 10147 - protein, 9 aa, Artificial Sequence
  Nodal modulator 2 (392-400)
KIAPNTPQL

SEQ ID NO: 10148 - protein, 10 aa, Artificial Sequence
  Trans-Golgi network integral membrane protein 2 (408-417)
KIIAFVLEGK

SEQ ID NO: 10149 - protein, 9 aa, Artificial Sequence
  Interleukin enhancer-binding factor 2 (127-135)
KILPTLEAV

SEQ ID NO: 10150 - protein, 9 aa, Artificial Sequence
  Insulin-like growth factor 2 mRNA-binding protein 3 (552-560)
KIQEILTQV

SEQ ID NO: 10151 - protein, 10 aa, Artificial Sequence
  WD repeat-containing protein 1 (119-128)
KIWDVSVNSV

SEQ ID NO: 10152 - protein, 9 aa, Artificial Sequence
  Transcription factor SOX-8 (1-9)
KLADQYPHL

SEQ ID NO: 10153 - protein, 9 aa, Artificial Sequence
  14-3-3 protein theta (11-19)
KLAEQAERY

SEQ ID NO: 10154 - protein, 9 aa, Artificial Sequence
  Akirin-1 (163-171)
KLAEQYESF

SEQ ID NO: 10155 - protein, 11 aa, Artificial Sequence
  Akirin-1 (163-173)
KLAEQYESFVK

SEQ ID NO: 10156 - protein, 9 aa, Artificial Sequence
  V-type proton ATPase subunit C 1 (25-33)
KLDAFVEGV

SEQ ID NO: 10157 - protein, 9 aa, Artificial Sequence
  Kinetochore-associated protein 1 (1298-1306)
KLFGETTLV

SEQ ID NO: 10158 - protein, 9 aa, Artificial Sequence
  Heterogeneous nuclear ribonucleoprotein A0 (8-16)
KLFIGGLNV

SEQ ID NO: 10159 - protein, 9 aa, Artificial Sequence
  Heterogeneous nuclear ribonucleoprotein A1 (15-23)
KLFIGGLSF

SEQ ID NO: 10160 - protein, 10 aa, Artificial Sequence
  Serine/threonine-protein kinase DCLK2 (534-543)
KLGDFGLATV

SEQ ID NO: 10161 - protein, 9 aa, Artificial Sequence
  TRPM8 channel-associated factor 1 (199-207)
KLGSVPVTV

SEQ ID NO: 10162 - protein, 9 aa, Artificial Sequence
  Transformation/transcription domain-associated protein (911-919)
KLHYVVTEV

SEQ ID NO: 10163 - protein, 11 aa, Artificial Sequence
  E3 ubiquitin-protein ligase UBR4 (1375-1385)
KLIDETQDMLL

SEQ ID NO: 10164 - protein, 9 aa, Artificial Sequence
  Pericentriolar material 1 protein (412-420)
KLLGELHTL

SEQ ID NO: 10165 - protein, 9 aa, Artificial Sequence
  Peptidyl-prolyl cis-trans isomerase FKBP3 (42-50)
KLLGNIKNV

SEQ ID NO: 10166 - protein, 9 aa, Artificial Sequence
  Calnexin (166-174)
KLLSKTPEL

SEQ ID NO: 10167 - protein, 9 aa, Artificial Sequence
  Golgin subfamily A member 5 (484-492)
KLMGQIHQL

SEQ ID NO: 10168 - protein, 9 aa, Artificial Sequence
  TBC1 domain family member 13 (39-47)
KLNPGIAYV

SEQ ID NO: 10169 - protein, 9 aa, Artificial Sequence
  E3 ubiquitin-protein ligase TRIP12 (912-920)
KLPDIFSVY

SEQ ID NO: 10170 - protein, 10 aa, Artificial Sequence
  Kelch-like protein 24 (347-356)
KLPEFTKSEY

SEQ ID NO: 10171 - protein, 9 aa, Artificial Sequence
  Transmembrane and coiled-coil domain-containing protein 1 (116-124)
KLPFTPLSY

SEQ ID NO: 10172 - protein, 10 aa, Artificial Sequence
  HLA class II histocompatibility antigen, DR beta 5 chain (5-14)
KLPGGSYMAK

SEQ ID NO: 10173 - protein, 9 aa, Artificial Sequence
  Fanconi anemia group I protein (16-24)
KLQEFLQTL

SEQ ID NO: 10174 - protein, 9 aa, Artificial Sequence
  Tyrosine-protein kinase BAZ1B (379-387)
KLSEIPLTL

SEQ ID NO: 10175 - protein, 9 aa, Artificial Sequence
  E3 SUMO-protein ligase CBX4 (347-355)
KLSPTKEAF

SEQ ID NO: 10176 - protein, 9 aa, Artificial Sequence
  PWWP domain-containing protein MUM1 (574-582)
KLVEYIVKA

SEQ ID NO: 10177 - protein, 9 aa, Artificial Sequence
  Minor histocompatibility protein HA-1 (532-540)
KLYDPGQQY

SEQ ID NO: 10178 - protein, 9 aa, Artificial Sequence
  Replication factor C subunit 5 (304-312)
KMADIEYRL

SEQ ID NO: 10179 - protein, 12 aa, Artificial Sequence
  Interferon-induced transmembrane protein 2 (87-98)
KMVGDVTGAQAY

SEQ ID NO: 10180 - protein, 11 aa, Artificial Sequence
  U1 small nuclear ribonucleoprotein 70 kDa (87-97)
KMWDPHNDPNA

SEQ ID NO: 10181 - protein, 11 aa, Artificial Sequence
  Myosin-9 (517-527)
KPAGPPGILAL

SEQ ID NO: 10182 - protein, 10 aa, Artificial Sequence
  Transketolase (6-15)
KPDQQKLQAL

SEQ ID NO: 10183 - protein, 10 aa, Artificial Sequence
  Calponin-3 (156-165)
KPFDQTTISL

SEQ ID NO: 10184 - protein, 11 aa, Artificial Sequence
  DNA polymerase kappa (36-46)
KPIAVGSMSML

SEQ ID NO: 10185 - protein, 9 aa, Artificial Sequence
  Elongation factor 2 (445-453)
KPIQRTILM

SEQ ID NO: 10186 - protein, 9 aa, Artificial Sequence
  Galectin-3 (139-147)
KPNANRIAL

SEQ ID NO: 10187 - protein, 11 aa, Artificial Sequence
  Spectrin beta chain, non-erythrocytic 1 (1939-1949)
KPRDVSSVELL

SEQ ID NO: 10188 - protein, 10 aa, Artificial Sequence
  Methionine synthase (342-351)
KPRVPPATAF

SEQ ID NO: 10189 - protein, 9 aa, Artificial Sequence
  Peroxisomal multifunctional enzyme type 2 (565-573)
KPVYPGQTL

SEQ ID NO: 10190 - protein, 8 aa, Artificial Sequence
  SWI/SNF-related matrix-associated actin-dependent regulator of chromatin subfamily A containing DEAD/H box 1 (68-75)
KPYQKVGL

SEQ ID NO: 10191 - protein, 9 aa, Artificial Sequence
  Programmed cell death protein 6 (116-124)
KQALSGFGY

SEQ ID NO: 10192 - protein, 9 aa, Artificial Sequence
  Ubiquitin-associated protein 2-like (939-947)
KQHGVNVSV

SEQ ID NO: 10193 - protein, 9 aa, Artificial Sequence
  DnaJ homolog subfamily A member 1 (46-54)
KQISQAYEV

SEQ ID NO: 10194 - protein, 9 aa, Artificial Sequence
  E3 ubiquitin-protein ligase MGRN1 (240-248)
KQIVDRVSY

SEQ ID NO: 10195 - protein, 10 aa, Artificial Sequence
  MICOS complex subunit MIC60 (724-733)
KQIVEILTAY

SEQ ID NO: 10196 - protein, 9 aa, Artificial Sequence
  Transgelin-2 (88-96)
KQMEQISQF

SEQ ID NO: 10197 - protein, 10 aa, Artificial Sequence
  Transgelin-2 (88-97)
KQMEQISQFL

SEQ ID NO: 10198 - protein, 9 aa, Artificial Sequence
  Zinc finger MIZ domain-containing protein 2 (174-182)
KQSQELSQY

SEQ ID NO: 10199 - protein, 9 aa, Artificial Sequence
  Heat shock cognate 71 kDa protein (423-431)
KQTQTFTTY

SEQ ID NO: 10200 - protein, 9 aa, Artificial Sequence
  Heterogeneous nuclear ribonucleoprotein K (456-464)
KQYADVEGF

SEQ ID NO: 10201 - protein, 9 aa, Artificial Sequence
  T-complex protein 1 subunit theta (98-106)
KQYGNEVFL

SEQ ID NO: 10202 - protein, 9 aa, Artificial Sequence
  Coatomer subunit beta' (386-394)
KSFGSAQEF

SEQ ID NO: 10203 - protein, 11 aa, Artificial Sequence
  Elongation factor 1-alpha 1 (20-30)
KSTTTGHLIYK

SEQ ID NO: 10204 - protein, 9 aa, Artificial Sequence
  Translocation protein SEC63 homolog (95-103)
KTDREYQEY

SEQ ID NO: 10205 - protein, 9 aa, Artificial Sequence
  E3 ubiquitin-protein ligase RBBP6 (1474-1482)
KTDYDTREY

SEQ ID NO: 10206 - protein, 11 aa, Artificial Sequence
  Probable ATP-dependent RNA helicase DDX47 (195-205)
KTFLFSATMTK

SEQ ID NO: 10207 - protein, 9 aa, Artificial Sequence
  Cytoplasmic dynein 1 heavy chain 1 (872-880)
KTFSEILNR

SEQ ID NO: 10208 - protein, 9 aa, Artificial Sequence
  Chromodomain Y-like protein (93-101)
KTSPKALVI

SEQ ID NO: 10209 - protein, 12 aa, Artificial Sequence
  Protein polybromo-1 (260-271)
KTYNEPGSQVFK

SEQ ID NO: 10210 - protein, 9 aa, Artificial Sequence
  60S ribosomal protein L7a (11-19)
KVAPAPAVV

SEQ ID NO: 10211 - protein, 9 aa, Artificial Sequence
  Procollagen-lysine,2-oxoglutarate 5-dioxygenase 2 (109-117)
KVFAGYYTK

SEQ ID NO: 10212 - protein, 9 aa, Artificial Sequence
  Nucleolin (370-378)
KVFGNEIKL

SEQ ID NO: 10213 - protein, 9 aa, Artificial Sequence
  F-box only protein 28 (103-111)
KVIDEIYRV

SEQ ID NO: 10214 - protein, 9 aa, Artificial Sequence
  Trafficking protein particle complex subunit 5 (81-89)
KVLGALLFV

SEQ ID NO: 10215 - protein, 10 aa, Artificial Sequence
  Long-chain-fatty-acid-CoA ligase 4 (347-356)
KVQEMNYIQK

SEQ ID NO: 10216 - protein, 9 aa, Artificial Sequence
  78 kDa glucose-regulated protein (146-154)
KVTHAVVTV

SEQ ID NO: 10217 - protein, 9 aa, Artificial Sequence
  26S proteasome non-ATPase regulatory subunit 11 (409-417)
KVVDSLYNK

SEQ ID NO: 10218 - protein, 9 aa, Artificial Sequence
  Tripartite motif-containing protein 34 (162-170)
KYGVFEESL

SEQ ID NO: 10219 - protein, 9 aa, Artificial Sequence
  Tubulin-tyrosine ligase (184-192)
KYLEHPLLL

SEQ ID NO: 10220 - protein, 9 aa, Artificial Sequence
  DNA topoisomerase 3-beta-1 (425-433)
KYLQSTISF

SEQ ID NO: 10221 - protein, 9 aa, Artificial Sequence
  Lysine-specific demethylase 2A (48-56)
KYNANFVTF

SEQ ID NO: 10222 - protein, 9 aa, Artificial Sequence
  Hermansky-Pudlak syndrome 3 protein (16-24)
KYQIINEEF

SEQ ID NO: 10223 - protein, 9 aa, Artificial Sequence
  G/T mismatch-specific thymine DNAosylase (221-229)
KYQPRIAVF

SEQ ID NO: 10224 - protein, 9 aa, Artificial Sequence
  Casein kinase II subunit alpha (49-57)
KYSEVFEAI

SEQ ID NO: 10225 - protein, 12 aa, Artificial Sequence
  Eukaryotic translation initiation factor 3 subunit D (58-69)
KYSSQFGGGSQY

SEQ ID NO: 10226 - protein, 9 aa, Artificial Sequence
  E3 ubiquitin-protein ligase listerin (1408-1416)
KYVSSVLSF

SEQ ID NO: 10227 - protein, 17 aa, Artificial Sequence
  Glutathione S-transferase P (194-210)
LASPEYVNLPINGNGKQ

SEQ ID NO: 10228 - protein, 9 aa, Artificial Sequence
  Msx2-interacting protein (2085-2093)
LAVDKSASL

SEQ ID NO: 10229 - protein, 8 aa, Artificial Sequence
  Transducin beta-like protein 3 (781-788)
LDFLWHNM

SEQ ID NO: 10230 - protein, 9 aa, Artificial Sequence
  Negative regulator of reactive oxygen species (186-194)
LDLQRNYIF

SEQ ID NO: 10231 - protein, 9 aa, Artificial Sequence
  Protein S100-A9 (66-74)
LDTNADKQL

SEQ ID NO: 10232 - protein, 10 aa, Artificial Sequence
  Ubiquitin-60S ribosomal protein L40 (55-64)
LEDGRTLSDY

SEQ ID NO: 10233 - protein, 9 aa, Artificial Sequence
  Microtubule-actin cross-linking factor 1 isoform X1 (2426-2434)
LEEDSAREI

SEQ ID NO: 10234 - protein, 8 aa, Artificial Sequence
  Coatomer subunit zeta-1 (62-69)
LEGLTVVY

SEQ ID NO: 10235 - protein, 9 aa, Artificial Sequence
  Phosphatidylinositol 4-kinase alpha (113-121)
LEIQDKEYL

SEQ ID NO: 10236 - protein, 8 aa, Artificial Sequence
  Vimentin (220-227)
LERKVESL

SEQ ID NO: 10237 - protein, 9 aa, Artificial Sequence
  BAG family molecular chaperone regulator 2 (29-37)
LESLDQLEL

SEQ ID NO: 10238 - protein, 9 aa, Artificial Sequence
  Ubiquitin carboxyl-terminal hydrolase 11 (266-274)
LETGQLIIM

SEQ ID NO: 10239 - protein, 9 aa, Artificial Sequence
  ATP-dependent RNA helicase DDX1 (284-292)
LIVEPSREL

SEQ ID NO: 10240 - protein, 9 aa, Artificial Sequence
  60S acidic ribosomal protein P0 (102-110)
LLANKVPAA

SEQ ID NO: 10241 - protein, 9 aa, Artificial Sequence
  Ras GTPase-activating-like protein IQGAP2 (984-992)
LLAPVVKEI

SEQ ID NO: 10242 - protein, 9 aa, Artificial Sequence
  Nucleolar complex protein 4 homolog (333-341)
LLDPSVFHV

SEQ ID NO: 10243 - protein, 9 aa, Artificial Sequence
  Inositol hexakisphosphate kinase 2 (76-84)
LLEPFVHQV

SEQ ID NO: 10244 - protein, 9 aa, Artificial Sequence
  TBC1 domain family member 9B (211-219)
LLFPESIRV

SEQ ID NO: 10245 - protein, 9 aa, Artificial Sequence
  Ganglioside GM2 activator (15-23)
LLLAAPAQA

SEQ ID NO: 10246 - protein, 9 aa, Artificial Sequence
  DNA damage-binding protein 1 (1050-1058)
LLLDMQNRL

SEQ ID NO: 10247 - protein, 9 aa, Artificial Sequence
  Retinoblastoma-associated protein (476-484)
LLNDNIFHM

SEQ ID NO: 10248 - protein, 10 aa, Artificial Sequence
  RNA-binding protein 12B (432-441)
LLYDDKGVGL

SEQ ID NO: 10249 - protein, 9 aa, Artificial Sequence
  Beta-galactoside alpha-2,6-sialyltransferase 1 (371-379)
LLYEKNLVK

SEQ ID NO: 10250 - protein, 11 aa, Artificial Sequence
  Junction plakoglobin (16-26)
LLYQEGAKMAV

SEQ ID NO: 10251 - protein, 12 aa, Artificial Sequence
  General transcription factor IIH subunit 5 (60-71)
LMDQNAFSLTQK

SEQ ID NO: 10252 - protein, 10 aa, Artificial Sequence
  Dynactin subunit 5 (164-173)
LMIDVTKSYY

SEQ ID NO: 10253 - protein, 9 aa, Artificial Sequence
  Protein SSXT (79-87)
LPAPPTQNM

SEQ ID NO: 10254 - protein, 9 aa, Artificial Sequence
  N-terminal Xaa-Pro-Lys N-methyltransferase 1 (211-219)
LPDEIYHVY

SEQ ID NO: 10255 - protein, 9 aa, Artificial Sequence
  Ran-binding protein 9 (350-358)
LPKQPPLAL

SEQ ID NO: 10256 - protein, 9 aa, Artificial Sequence
  E3 ubiquitin-protein ligase RNF216 (406-414)
LPRPVPQNL

SEQ ID NO: 10257 - protein, 10 aa, Artificial Sequence
  SET domain-containing protein 5 (1382-1391)
LPSDLRTISL

SEQ ID NO: 10258 - protein, 9 aa, Artificial Sequence
  Anaphase-promoting complex subunit 7 (132-140)
LPSEIEVKY

SEQ ID NO: 10259 - protein, 9 aa, Artificial Sequence
  F-box/WD repeat-containing protein 7 (467-475)
LQFDGIHVV

SEQ ID NO: 10260 - protein, 13 aa, Artificial Sequence
  Keratin, type I cytoskeletal 10 (222-234)
LQIDNARLAADDF

SEQ ID NO: 10261 - protein, 10 aa, Artificial Sequence
  Double-stranded RNA-binding protein Staufen homolog 1 (119-128)
LQNEPLPERL

SEQ ID NO: 10262 - protein, 15 aa, Artificial Sequence
  HLA class I histocompatibility antigen, Cw-3 alpha chain (296-310)
LRWEPSSQPTIPIVG

SEQ ID NO: 10263 - protein, 8 aa, Artificial Sequence
  TRIO and F-actin-binding protein (42-49)
LTDSSLKY

SEQ ID NO: 10264 - protein, 9 aa, Artificial Sequence
  Pleckstrin homology domain-containing family A member 2 (315-323)
LTRPGSSSL

SEQ ID NO: 10265 - protein, 9 aa, Artificial Sequence
  DNA topoisomerase 2-beta (566-574)
LTYNDFINK

SEQ ID NO: 10266 - protein, 9 aa, Artificial Sequence
  Suppressor of SWI4 1 homolog (117-125)
LVRDVVSSL

SEQ ID NO: 10267 - protein, 10 aa, Artificial Sequence
  Leucine-rich repeat-containing protein 20 (34-43)
LVSFPIGIYK

SEQ ID NO: 10268 - protein, 11 aa, Artificial Sequence
  Beta-actin-like protein 2 (9-19)
LVVDNGSGMCK

SEQ ID NO: 10269 - protein, 9 aa, Artificial Sequence
  Peptidyl-prolyl cis-trans isomerase FKBP4 (410-418)
LYANMFERL

SEQ ID NO: 10270 - protein, 9 aa, Artificial Sequence
  AKT-interacting protein (201-209)
LYEKDIQLF

SEQ ID NO: 10271 - protein, 9 aa, Artificial Sequence
  Serine palmitoyltransferase 2 (282-290)
LYLDEAHSI

SEQ ID NO: 10272 - protein, 9 aa, Artificial Sequence
  DNA-dependent protein kinase catalytic subunit (3377-3385)
LYQRAFQHL

SEQ ID NO: 10273 - protein, 9 aa, Artificial Sequence
  Stimulator of interferon genes protein (214-222)
MADPNIRFL

SEQ ID NO: 10274 - protein, 8 aa, Artificial Sequence
  Putative V-set and immunoglobulin domain-containing-like protein IGHV4OR15-8 (1-8)
MDLLHKNM

SEQ ID NO: 10275 - protein, 9 aa, Artificial Sequence
  Ig kappa chain V-I region HK102 (1-9)
MDMRVPAQL

SEQ ID NO: 10276 - protein, 9 aa, Artificial Sequence
  Hypoxia-inducible factor 1-alpha (632-640)
MEDIKILIA

SEQ ID NO: 10277 - protein, 8 aa, Artificial Sequence
  Ras GTPase-activating protein-binding protein 1 (183-190)
MEEHLEEP

SEQ ID NO: 10278 - protein, 9 aa, Artificial Sequence
  Vimentin (347-355)
MEENFAVEA

SEQ ID NO: 10279 - protein, 10 aa, Artificial Sequence
  Protein S100-A10 (5-14)
MEHAMETMMF

SEQ ID NO: 10280 - protein, 9 aa, Artificial Sequence
  Actin, alpha skeletal muscle (84-92)
MEKIWHHTF

SEQ ID NO: 10281 - protein, 9 aa, Artificial Sequence
  Arachidonate 5-lipoxygenase (186-194)
MENLFINRF

SEQ ID NO: 10282 - protein, 9 aa, Artificial Sequence
  Protein diaphanous homolog 1 (496-504)
MESDFEQKL

SEQ ID NO: 10283 - protein, 9 aa, Artificial Sequence
  Cytochrome c oxidase subunit 2 (20-28)
METVWTILP

SEQ ID NO: 10284 - protein, 9 aa, Artificial Sequence
  Poly(A)-specific ribonuclease PARN (243-251)
MLLDVMHTV

SEQ ID NO: 10285 - protein, 9 aa, Artificial Sequence
  DNA ligase 1 (393-401)
MLPPPPLTA

SEQ ID NO: 10286 - protein, 10 aa, Artificial Sequence
  Eukaryotic translation initiation factor 3 subunit A (514-523)
MPSEQIRNQL

SEQ ID NO: 10287 - protein, 9 aa, Artificial Sequence
  U2 snRNP-associated SURP motif-containing protein (392-400)
MTESKFSKY

SEQ ID NO: 10288 - protein, 9 aa, Artificial Sequence
  Probable ATP-dependent RNA helicase DDX6 (168-176)
MVIVPTREL

SEQ ID NO: 10289 - protein, 9 aa, Artificial Sequence
  Staphylococcal nuclease domain-containing protein 1 (327-335)
NADAIVVKL

SEQ ID NO: 10290 - protein, 10 aa, Artificial Sequence
  Ceruloplasmin (651-660)
NEADVHGIYF

SEQ ID NO: 10291 - protein, 9 aa, Artificial Sequence
  HLA class I histocompatibility antigen, A-3 alpha chain (151-159)
NEDLRSWTA

SEQ ID NO: 10292 - protein, 11 aa, Artificial Sequence
  Nuclear pore complex protein Nup50 (371-381)
NEFKEKGIGTL

SEQ ID NO: 10293 - protein, 8 aa, Artificial Sequence
  40S ribosomal protein S3 (22-29)
NEFLTREL

SEQ ID NO: 10294 - protein, 9 aa, Artificial Sequence
  Adenylyl cyclase-associated protein 1 (449-457)
NEFPVPEQF

SEQ ID NO: 10295 - protein, 10 aa, Artificial Sequence
  Protein C-ets-1 (86-95)
NEFSLKGVDF

SEQ ID NO: 10296 - protein, 9 aa, Artificial Sequence
  Midasin (329-337)
NEILGSLRW

SEQ ID NO: 10297 - protein, 8 aa, Artificial Sequence
  Guanine nucleotide-binding protein-like 3-like protein (192-199)
NELPTVAF

SEQ ID NO: 10298 - protein, 10 aa, Artificial Sequence
  Trinucleotide repeat-containing gene 6B protein (723-732)
NENPSKDQGW

SEQ ID NO: 10299 - protein, 10 aa, Artificial Sequence
  DNA dC-dU-editing enzyme APOBEC-3B (23-32)
NEPILYGRSY

SEQ ID NO: 10300 - protein, 9 aa, Artificial Sequence
  Catenin alpha-1 (169-177)
NEQDLGIQY

SEQ ID NO: 10301 - protein, 10 aa, Artificial Sequence
  Cytoplasmic FMR1-interacting protein 2 (99-108)
NEQPNRVEIY

SEQ ID NO: 10302 - protein, 9 aa, Artificial Sequence
  Four and a half LIM domains protein 2 (121-129)
NESLFGKKY

SEQ ID NO: 10303 - protein, 8 aa, Artificial Sequence
  Protein disulfide-isomerase (430-437)
NEVEAVKV

SEQ ID NO: 10304 - protein, 9 aa, Artificial Sequence
  Radial spoke head protein 3 homolog (440-448)
NEVEKTMEY

SEQ ID NO: 10305 - protein, 8 aa, Artificial Sequence
  Nucleosome assembly protein 1-like 1 (226-233)
NEVLTKTY

SEQ ID NO: 10306 - protein, 9 aa, Artificial Sequence
  Collagen alpha-3(VI) chain (2246-2254)
NEVTTEIRF

SEQ ID NO: 10307 - protein, 8 aa, Artificial Sequence
  60S ribosomal protein L31 (18-25)
NEVVTREY

SEQ ID NO: 10308 - protein, 9 aa, Artificial Sequence
  Synaptobrevin homolog YKT6 (83-91)
NEYPSRVAF

SEQ ID NO: 10309 - protein, 9 aa, Artificial Sequence
  26S proteasome non-ATPase regulatory subunit 4 (18-26)
NGDFLPTRL

SEQ ID NO: 10310 - protein, 13 aa, Artificial Sequence
  Eukaryotic translation initiation factor 3 subunit D (57-69)
NKYSSQFGGGSQY

SEQ ID NO: 10311 - protein, 10 aa, Artificial Sequence
  Structural maintenance of chromosomes protein 4 (634-643)
NLDQATRVAY

SEQ ID NO: 10312 - protein, 9 aa, Artificial Sequence
  Heterogeneous nuclear ribonucleoprotein U-like protein 2 (358-366)
NPEKRYNVL

SEQ ID NO: 10313 - protein, 9 aa, Artificial Sequence
  2'-5'-oligoadenylate synthase 1 (128-136)
NPRALSFVL

SEQ ID NO: 10314 - protein, 10 aa, Artificial Sequence
  Cleavage and polyadenylation specificity factor subunit 3 (308-317)
NPRNTEAVTL

SEQ ID NO: 10315 - protein, 9 aa, Artificial Sequence
  ETS translocation variant 5 (210-218)
NQYPSEQRF

SEQ ID NO: 10316 - protein, 9 aa, Artificial Sequence
  Protein TASOR (346-354)
NTDRNIDKY

SEQ ID NO: 10317 - protein, 17 aa, Artificial Sequence
  Actin, cytoplasmic 2 (35-51)
NTVLSGGTTMYPGIADR

SEQ ID NO: 10318 - protein, 9 aa, Artificial Sequence
  ORM1-like protein 2 (53-61)
NVIHNLATY

SEQ ID NO: 10319 - protein, 9 aa, Artificial Sequence
  Unconventional myosin-Ic (852-860)
NYPQSVPRL

SEQ ID NO: 10320 - protein, 9 aa, Artificial Sequence
  Myotubularin-related protein 6 (104-112)
NYSNIRFQF

SEQ ID NO: 10321 - protein, 9 aa, Artificial Sequence
  Actin-related protein 2/3 complex subunit 3 (2-10)
PAYHSSLMD

SEQ ID NO: 10322 - protein, 10 aa, Artificial Sequence
  NADH dehydrogenase (ubiquinone) 1 beta subcomplex subunit 11, mitochondrial (144-153)
PSKIQLPEDE

SEQ ID NO: 10323 - protein, 9 aa, Artificial Sequence
  Probable helicase with zinc finger domain (955-963)
PYADQVFRI

SEQ ID NO: 10324 - protein, 9 aa, Artificial Sequence
  Polypeptide N-acetylgalactosaminyltransferase 2 (407-415)
PYGNIQSRL

SEQ ID NO: 10325 - protein, 9 aa, Artificial Sequence
  Nucleolin (401-409)
PYKVTQDEL

SEQ ID NO: 10326 - protein, 16 aa, Artificial Sequence
  Cytochrome c oxidase subunit 5B, mitochondrial (61-76)
PYNVLAPKGASGTRED

SEQ ID NO: 10327 - protein, 9 aa, Artificial Sequence
  Dol-P-Man:Man(7)GlcNAc(2)-PP-Dol alpha-1,6-mannosyltransferase (29-37)
PYTKVEESF

SEQ ID NO: 10328 - protein, 9 aa, Artificial Sequence
  Serglycin (81-89)
QDLNRIFPL

SEQ ID NO: 10329 - protein, 9 aa, Artificial Sequence
  Paraneoplastic antigen Ma1 (117-125)
QDVARVLGF

SEQ ID NO: 10330 - protein, 9 aa, Artificial Sequence
  UDP-glucuronic acid decarboxylase 1 (248-256)
QEGVEVRVA

SEQ ID NO: 10331 - protein, 9 aa, Artificial Sequence
  Talin-1 (1707-1715)
QEISHLIEP

SEQ ID NO: 10332 - protein, 9 aa, Artificial Sequence
  Integrin beta-2 (422-430)
QEQSFVIRA

SEQ ID NO: 10333 - protein, 9 aa, Artificial Sequence
  Forkhead-associated domain-containing protein 1 (519-527)
QLIEKITQV

SEQ ID NO: 10334 - protein, 9 aa, Artificial Sequence
  Integrin alpha-V (217-225)
QVAEIVSKY

SEQ ID NO: 10335 - protein, 9 aa, Artificial Sequence
  Biogenesis of lysosome-related organelles complex 1 subunit 1 (64-72)
QVQAAQFAK

SEQ ID NO: 10336 - protein, 9 aa, Artificial Sequence
  CCR4-NOT transcription complex subunit 1 (465-473)
QYEQVKQLF

SEQ ID NO: 10337 - protein, 9 aa, Artificial Sequence
  Phosphatidylinositol 3,4,5-trisphosphate-dependent Rac exchanger 1 protein (1095-1103)
QYVTQINRL

SEQ ID NO: 10338 - protein, 12 aa, Artificial Sequence
  Non-POU domain-containing octamer-binding protein (367-378)
RAAPGAEFAPNK

SEQ ID NO: 10339 - protein, 9 aa, Artificial Sequence
  SWI/SNF-related matrix-associated actin-dependent regulator of chromatin subfamily E member 1-related (135-143)
RAYQQSEAY

SEQ ID NO: 10340 - protein, 8 aa, Artificial Sequence
  Zinc finger protein 36, C3H1 type-like 2 (239-246)
RDALHLGF

SEQ ID NO: 10341 - protein, 9 aa, Artificial Sequence
  Chloride intracellular channel protein 6 (640-648)
RDFEFPSEM

SEQ ID NO: 10342 - protein, 8 aa, Artificial Sequence
  Rab3 GTPase-activating protein non-catalytic subunit (18-25)
RDFLFPHL

SEQ ID NO: 10343 - protein, 8 aa, Artificial Sequence
  60S ribosomal protein L9 (36-43)
RDFNHINV

SEQ ID NO: 10344 - protein, 9 aa, Artificial Sequence
  Guanylate-binding protein 4 (196-204)
RDFTLELKL

SEQ ID NO: 10345 - protein, 9 aa, Artificial Sequence
  Alkyldihydroxyacetonephosphate synthase, peroxisomal (515-523)
RDLALEYYV

SEQ ID NO: 10346 - protein, 8 aa, Artificial Sequence
  Cell division control protein 42 homolog (147-154)
RDLKAVKY

SEQ ID NO: 10347 - protein, 8 aa, Artificial Sequence
  40S ribosomal protein S27-like (5-12)
RDLLHPSL

SEQ ID NO: 10348 - protein, 9 aa, Artificial Sequence
  Septin-9 (519-527)
RDLLIRTHM

SEQ ID NO: 10349 - protein, 9 aa, Artificial Sequence
  Eukaryotic translation initiation factor 3 subunit C (586-594)
RDLMLMSHL

SEQ ID NO: 10350 - protein, 11 aa, Artificial Sequence
  Macrosialin (238-248)
RDLQAPLGQSF

SEQ ID NO: 10351 - protein, 9 aa, Artificial Sequence
  E3 ubiquitin-protein ligase RNF213 (160-168)
RDLSHILGI

SEQ ID NO: 10352 - protein, 9 aa, Artificial Sequence
  Serine/threonine-protein kinase RIO1 (201-209)
RDMDIIMKL

SEQ ID NO: 10353 - protein, 9 aa, Artificial Sequence
  Transcription factor 25 (650-658)
RDMMANFHL

SEQ ID NO: 10354 - protein, 8 aa, Artificial Sequence
  Transcription elongation factor A protein 1 (123-130)
RDTYVSSF

SEQ ID NO: 10355 - protein, 9 aa, Artificial Sequence
  Growth arrest and DNA damage-inducible protein GADD45 alpha (67-75)
RDVALQIHF

SEQ ID NO: 10356 - protein, 8 aa, Artificial Sequence
  Transmembrane protein 14A (51-58)
RDVKVSLF

SEQ ID NO: 10357 - protein, 9 aa, Artificial Sequence
  TraB domain-containing protein (259-267)
RDVYLTYML

SEQ ID NO: 10358 - protein, 10 aa, Artificial Sequence
  Pyruvate kinase PKM (383-392)
REAEAAIYHL

SEQ ID NO: 10359 - protein, 9 aa, Artificial Sequence
  Protein nepro homolog (226-234)
REAESFTQL

SEQ ID NO: 10360 - protein, 10 aa, Artificial Sequence
  40S ribosomal protein S4, X isoform (39-48)
RECLPLIIFL

SEQ ID NO: 10361 - protein, 9 aa, Artificial Sequence
  T-complex protein 1 subunit gamma (260-268)
REEDFTRIL

SEQ ID NO: 10362 - protein, 11 aa, Artificial Sequence
  Transcription factor E2F7 (433-443)
REEQGSGGYSL

SEQ ID NO: 10363 - protein, 8 aa, Artificial Sequence
  Ribonucleoside-diphosphate reductase subunit M2 (190-197)
REFLFNAI

SEQ ID NO: 10364 - protein, 9 aa, Artificial Sequence
  DNA-dependent protein kinase catalytic subunit (1087-1095)
REFREEESL

SEQ ID NO: 10365 - protein, 8 aa, Artificial Sequence
  Vacuolar protein sorting-associated protein 51 homolog (490-497)
REGLIVGF

SEQ ID NO: 10366 - protein, 9 aa, Artificial Sequence
  Torsin-4A (350-358)
REHPLWQAA

SEQ ID NO: 10367 - protein, 9 aa, Artificial Sequence
  Vimentin (186-194)
REKLQEEML

SEQ ID NO: 10368 - protein, 9 aa, Artificial Sequence
  Protein CEBPZOS (68-76)
RELDQKTWL

SEQ ID NO: 10369 - protein, 9 aa, Artificial Sequence
  Extended synaptotagmin-1 (125-133)
RELPAWVSF

SEQ ID NO: 10370 - protein, 9 aa, Artificial Sequence
  DNA-directed RNA polymerase II subunit RPB1 (1380-1388)
RELYHVISF

SEQ ID NO: 10371 - protein, 8 aa, Artificial Sequence
  HLA class I histocompatibility antigen, B-57 alpha chain (99-106)
RENLRIAL

SEQ ID NO: 10372 - protein, 9 aa, Artificial Sequence
  Ras-related protein M-Ras (116-124)
RESFPMILV

SEQ ID NO: 10373 - protein, 9 aa, Artificial Sequence
  Large proline-rich protein BAG6 (814-822)
RESFSLVQV

SEQ ID NO: 10374 - protein, 9 aa, Artificial Sequence
  Vimentin (424-432)
RETNLDSLP

SEQ ID NO: 10375 - protein, 10 aa, Artificial Sequence
  DNA polymerase delta subunit 2 (109-118)
REVSEEHNLL

SEQ ID NO: 10376 - protein, 9 aa, Artificial Sequence
  Zinc finger protein 343 (243-251)
REYEPDHNL

SEQ ID NO: 10377 - protein, 9 aa, Artificial Sequence
  Desmin (386-394)
REYQDLLNV

SEQ ID NO: 10378 - protein, 9 aa, Artificial Sequence
  ADP-ribosylation factor 6 (95-103)
RIDEARQEL

SEQ ID NO: 10379 - protein, 14 aa, Artificial Sequence
  Heat shock 70 kDa protein 1-like (173-186)
RIINEPTAAAIAYG

SEQ ID NO: 10380 - protein, 9 aa, Artificial Sequence
  Chromobox protein homolog 6 (91-99)
RISDVHFSV

SEQ ID NO: 10381 - protein, 9 aa, Artificial Sequence
  Vimentin (410-418)
RISLPLPNF

SEQ ID NO: 10382 - protein, 10 aa, Artificial Sequence
  Discoidin, CUB and LCCL domain-containing protein 2 (86-95)
RIYNGIGVSR

SEQ ID NO: 10383 - protein, 9 aa, Artificial Sequence
  Polyribonucleotide 5'-hydroxyl-kinase Clp1 (206-214)
RLADVFNQR

SEQ ID NO: 10384 - protein, 9 aa, Artificial Sequence
  Clathrin heavy chain 1 (1226-1234)
RLASTLVHL

SEQ ID NO: 10385 - protein, 9 aa, Artificial Sequence
  Transcription elongation factor SPT6 (292-300)
RLFEKMQAY

SEQ ID NO: 10386 - protein, 11 aa, Artificial Sequence
  Deoxyhypusine synthase (263-273)
RLINTQAIFAK

SEQ ID NO: 10387 - protein, 9 aa, Artificial Sequence
  Lysophospholipid acyltransferase 5 (293-301)
RLIQESPTL

SEQ ID NO: 10388 - protein, 9 aa, Artificial Sequence
  trabeculin-alpha (476-484)
RLQDELVTL

SEQ ID NO: 10389 - protein, 9 aa, Artificial Sequence
  Gamma-tubulin complex component 5 (326-334)
RLQEFIDEV

SEQ ID NO: 10390 - protein, 9 aa, Artificial Sequence
  Nuclear cap-binding protein subunit 1 (694-702)
RLQEKVESA

SEQ ID NO: 10391 - protein, 9 aa, Artificial Sequence
  Integrin beta-7 (181-189)
RLQEVTHSV

SEQ ID NO: 10392 - protein, 9 aa, Artificial Sequence
  40S ribosomal protein S27 (87-95)
RLVQSPNSY

SEQ ID NO: 10393 - protein, 10 aa, Artificial Sequence
  Serpin H1 (133-142)
RLYGPSSVSF

SEQ ID NO: 10394 - protein, 9 aa, Artificial Sequence
  Tetratricopeptide repeat protein 30A (82-90)
RLYQAQALY

SEQ ID NO: 10395 - protein, 9 aa, Artificial Sequence
  DNA mismatch repair protein Msh2 (406-414)
RLYQGINQL

SEQ ID NO: 10396 - protein, 9 aa, Artificial Sequence
  Probable 18S rRNA (guanine-N(7))-methyltransferase (31-39)
RMIDIQTRM

SEQ ID NO: 10397 - protein, 9 aa, Artificial Sequence
  26S protease regulatory subunit 4 (411-419)
RMKVTNEDF

SEQ ID NO: 10398 - protein, 9 aa, Artificial Sequence
  A-kinase anchor protein 8-like (199-207)
RMWEDPMGA

SEQ ID NO: 10399 - protein, 11 aa, Artificial Sequence
  Keratin, type I cytoskeletal 10 (99-109)
RNVSTGDVNVE

SEQ ID NO: 10400 - protein, 9 aa, Artificial Sequence
  Ubiquitin-like modifier-activating enzyme 1 (325-333)
RPAQLHIGF

SEQ ID NO: 10401 - protein, 11 aa, Artificial Sequence
  Eukaryotic translation initiation factor 4 gamma 1 (191-201)
RPDDRSQGAII

SEQ ID NO: 10402 - protein, 9 aa, Artificial Sequence
  Microtubule-associated protein 4 (670-678)
RPEEGRPVV

SEQ ID NO: 10403 - protein, 9 aa, Artificial Sequence
  Syntenin-1 (193-201)
RPFERTITM

SEQ ID NO: 10404 - protein, 9 aa, Artificial Sequence
  Cellular tumor antigen p53 (25-33)
RPILTIITL

SEQ ID NO: 10405 - protein, 9 aa, Artificial Sequence
  Methionine adenosyltransferase 2 subunit beta (277-285)
RPITDSPVL

SEQ ID NO: 10406 - protein, 9 aa, Artificial Sequence
  U2 snRNP-associated SURP motif-containing protein (430-438)
RPKKPGQSF

SEQ ID NO: 10407 - protein, 9 aa, Artificial Sequence
  Methionine-tRNA ligase, cytoplasmic (45-53)
RPKVPVLQL

SEQ ID NO: 10408 - protein, 9 aa, Artificial Sequence
  Actin-related protein 3 (262-270)
RPLYKNIVL

SEQ ID NO: 10409 - protein, 8 aa, Artificial Sequence
  Proline-rich nuclear receptor coactivator 2 (13-20)
RPMKTSVL

SEQ ID NO: 10410 - protein, 9 aa, Artificial Sequence
  DNA damage-binding protein 1 (753-761)
RPSASTQAL

SEQ ID NO: 10411 - protein, 10 aa, Artificial Sequence
  Inositol-tetrakisphosphate 1-kinase (256-265)
RPSDEVIREL

SEQ ID NO: 10412 - protein, 9 aa, Artificial Sequence
  Nucleoprotein TPR (1808-1816)
RPSTSTAVF

SEQ ID NO: 10413 - protein, 10 aa, Artificial Sequence
  Nuclear pore complex protein Nup214 (1284-1293)
RPVAPSGTAL

SEQ ID NO: 10414 - protein, 9 aa, Artificial Sequence
  60S ribosomal protein L15 (73-81)
RPVPKGATY

SEQ ID NO: 10415 - protein, 9 aa, Artificial Sequence
  STE20-related kinase adapter protein alpha (358-366)
RPVTPITNF

SEQ ID NO: 10416 - protein, 9 aa, Artificial Sequence
  Grancalcin (145-153)
RQAIGLMGY

SEQ ID NO: 10417 - protein, 10 aa, Artificial Sequence
  Transcriptional repressor p66-beta (415-424)
RQAPQPQSSL

SEQ ID NO: 10418 - protein, 12 aa, Artificial Sequence
  UBX domain-containing protein 4 (346-357)
RQFAAQTVGNTY

SEQ ID NO: 10419 - protein, 9 aa, Artificial Sequence
  Spectrin alpha chain, non-erythrocytic 1 (1012-1020)
RQGFVPAAY

SEQ ID NO: 10420 - protein, 8 aa, Artificial Sequence
  Fragile X mental retardation syndrome-related protein 1 (376-383)
RQIGSRSY

SEQ ID NO: 10421 - protein, 9 aa, Artificial Sequence
  Sialidase-1 (69-77)
RQIGSVDTF

SEQ ID NO: 10422 - protein, 9 aa, Artificial Sequence
  Cytochrome b-245 heavy chain (92-100)
RQLDRNLTF

SEQ ID NO: 10423 - protein, 9 aa, Artificial Sequence
  Vacuole membrane protein 1 (48-56)
RQPLITLQY

SEQ ID NO: 10424 - protein, 9 aa, Artificial Sequence
  Lanosterol synthase (234-242)
RQVYLPMSY

SEQ ID NO: 10425 - protein, 8 aa, Artificial Sequence
  Eukaryotic translation initiation factor 3 subunit L (38-45)
RQYEQQTY

SEQ ID NO: 10426 - protein, 9 aa, Artificial Sequence
  Protein CDV3 homolog (7-15)
RSLDNFFAK

SEQ ID NO: 10427 - protein, 11 aa, Artificial Sequence
  Cation-independent mannose-6-phosphate receptor (2345-2355)
RSSNVSYKYSK

SEQ ID NO: 10428 - protein, 9 aa, Artificial Sequence
  Protein phosphatase 1 regulatory subunit 12A (704-712)
RTYDETYQR

SEQ ID NO: 10429 - protein, 11 aa, Artificial Sequence
  Protein FAM168A (83-93)
RTYQASSAAFR

SEQ ID NO: 10430 - protein, 9 aa, Artificial Sequence
  Manganese-transporting ATPase 13A1 (839-847)
RVAPKQKEF

SEQ ID NO: 10431 - protein, 9 aa, Artificial Sequence
  Alpha-adducin (27-35)
RVDENNPEY

SEQ ID NO: 10432 - protein, 9 aa, Artificial Sequence
  DNA damage-binding protein 1 (263-271)
RVDPNGSRY

SEQ ID NO: 10433 - protein, 10 aa, Artificial Sequence
  Eukaryotic translation initiation factor 3 subunit C-like protein (873-882)
RVFDHKQGTY

SEQ ID NO: 10434 - protein, 13 aa, Artificial Sequence
  LIM and senescent cell antigen-like-containing domain protein 1 (319-331)
RVIEGDVVSALNK

SEQ ID NO: 10435 - protein, 9 aa, Artificial Sequence
  Ran GTPase-activating protein 1 (205-213)
RVIGTLEEV

SEQ ID NO: 10436 - protein, 9 aa, Artificial Sequence
  HLA class II histocompatibility antigen, DRB1-16 beta chain (89-97)
RVQPKVTVY

SEQ ID NO: 10437 - protein, 11 aa, Artificial Sequence
  Glucose-6-phosphate 1-dehydrogenase (240-250)
RVQPNEAVYTK

SEQ ID NO: 10438 - protein, 9 aa, Artificial Sequence
  Rotatin (803-811)
RVTDLFIGK

SEQ ID NO: 10439 - protein, 15 aa, Artificial Sequence
  Histone H2A type 1-B/E (100-114)
RVTIAQGGVLPNIQA

SEQ ID NO: 10440 - protein, 14 aa, Artificial Sequence
  SH3 domain-binding glutamic acid-rich-like protein (4-17)
RVYIASSSGSTAIK

SEQ ID NO: 10441 - protein, 11 aa, Artificial Sequence
  WD repeat domain phosphoinositide-interacting protein 3 (34-44)
RVYNTDPLKEK

SEQ ID NO: 10442 - protein, 10 aa, Artificial Sequence
  Serine/arginine-rich splicing factor 9 (181-190)
RVYPERSTSY

SEQ ID NO: 10443 - protein, 9 aa, Artificial Sequence
  Lysine-specific demethylase 6B (135-143)
RYGGSFAEL

SEQ ID NO: 10444 - protein, 9 aa, Artificial Sequence
  Ras GTPase-activating protein-binding protein 2 (293-301)
RYPDSHQLF

SEQ ID NO: 10445 - protein, 9 aa, Artificial Sequence
  Eukaryotic translation initiation factor 3 subunit L (328-336)
RYQDAIRVF

SEQ ID NO: 10446 - protein, 9 aa, Artificial Sequence
  Poly (ADP-ribose) polymerase 8 (33-41)
RYSDSTFTF

SEQ ID NO: 10447 - protein, 11 aa, Artificial Sequence
  ATPase family AAA domain-containing protein 2 (163-173)
RYSGVNQSMLF

SEQ ID NO: 10448 - protein, 9 aa, Artificial Sequence
  Heterogeneous nuclear ribonucleoprotein H (23-31)
SADEVQRFF

SEQ ID NO: 10449 - protein, 9 aa, Artificial Sequence
  Intraflagellar transport protein 25 homolog (121-129)
SAFDHFASV

SEQ ID NO: 10450 - protein, 9 aa, Artificial Sequence
  Histone-lysine N-methyltransferase setd3 (403-411)
SAIDRIFTL

SEQ ID NO: 10451 - protein, 9 aa, Artificial Sequence
  Rho guanine nucleotide exchange factor 12 (613-621)
SAIGRAMEL

SEQ ID NO: 10452 - protein, 9 aa, Artificial Sequence
  Cell division cycle protein 16 homolog (483-491)
SAIGYIHSL

SEQ ID NO: 10453 - protein, 9 aa, Artificial Sequence
  Transient receptor potential cation channel subfamily V member 2 (165-173)
SALHIAIEK

SEQ ID NO: 10454 - protein, 9 aa, Artificial Sequence
  ATP-dependent zinc metalloprotease YME1L1 (158-166)
SAQSFFENK

SEQ ID NO: 10455 - protein, 9 aa, Artificial Sequence
  Putative annexin A2-like protein (22-30)
SAYGSVKAY

SEQ ID NO: 10456 - protein, 9 aa, Artificial Sequence
  Guanine nucleotide-binding protein G(I)/G(S)/G(T) subunit beta-1 (245-253)
SDDATCRLF

SEQ ID NO: 10457 - protein, 9 aa, Artificial Sequence
  Ubiquitin thioesterase OTUB1 (215-223)
SDHIHIIAL

SEQ ID NO: 10458 - protein, 9 aa, Artificial Sequence
  Homeobox-containing protein 1 (316-324)
SDLERVTSL

SEQ ID NO: 10459 - protein, 9 aa, Artificial Sequence
  Protein FAM162A (32-40)
SDLKRINGF

SEQ ID NO: 10460 - protein, 9 aa, Artificial Sequence
  Group XIIB secretory phospholipase A2-like protein (142-150)
SDLKRSLGF

SEQ ID NO: 10461 - protein, 9 aa, Artificial Sequence
  SH3 domain-binding protein 2 (218-226)
SDMPRAHSF

SEQ ID NO: 10462 - protein, 11 aa, Artificial Sequence
  Vimentin (299-309)
SEAANRNNDAL

SEQ ID NO: 10463 - protein, 9 aa, Artificial Sequence
  14-3-3 protein eta (80-88)
SEAAYKEAF

SEQ ID NO: 10464 - protein, 9 aa, Artificial Sequence
  WD repeat-containing protein 6 (1032-1040)
SEDGSLHVF

SEQ ID NO: 10465 - protein, 10 aa, Artificial Sequence
  60S ribosomal protein L7a (85-94)
SEDKGALAKL

SEQ ID NO: 10466 - protein, 9 aa, Artificial Sequence
  Cofilin-1 (41-49)
SEDKKNIIL

SEQ ID NO: 10467 - protein, 9 aa, Artificial Sequence
  Coatomer subunit alpha (268-276)
SEDKSIRVW

SEQ ID NO: 10468 - protein, 11 aa, Artificial Sequence
  26S proteasome non-ATPase regulatory subunit 2 (436-446)
SEDYIKSGALL

SEQ ID NO: 10469 - protein, 9 aa, Artificial Sequence
  Calmodulin (82-90)
SEEEIREAF

SEQ ID NO: 10470 - protein, 10 aa, Artificial Sequence
  Nucleolar transcription factor 1 (115-124)
SEEGITKSTL

SEQ ID NO: 10471 - protein, 9 aa, Artificial Sequence
  Nucleoside diphosphate kinase 3 (61-69)
SEELLREHY

SEQ ID NO: 10472 - protein, 9 aa, Artificial Sequence
  A-kinase anchor protein 6 (991-999)
SEEQQQHLY

SEQ ID NO: 10473 - protein, 10 aa, Artificial Sequence
  14-3-3 protein zeta/delta (227-236)
SEESYKDSTL

SEQ ID NO: 10474 - protein, 10 aa, Artificial Sequence
  CTTNBP2 N-terminal-like protein (259-268)
SEFDIEREQL

SEQ ID NO: 10475 - protein, 9 aa, Artificial Sequence
  Alpha-enolase (79-87)
SEFFRSGKY

SEQ ID NO: 10476 - protein, 9 aa, Artificial Sequence
  Dynamin-like 120 kDa protein, mitochondrial (351-359)
SEGPHHVAL

SEQ ID NO: 10477 - protein, 10 aa, Artificial Sequence
  Cyclic AMP-dependent transcription factor ATF-6 beta (8-17)
SEIADPTRFF

SEQ ID NO: 10478 - protein, 9 aa, Artificial Sequence
  Claspin (704-712)
SEIGKAVGF

SEQ ID NO: 10479 - protein, 9 aa, Artificial Sequence
  ATP-dependent zinc metalloprotease YME1L1 (695-703)
SEKLGVMTY

SEQ ID NO: 10480 - protein, 8 aa, Artificial Sequence
  Protein yippee-like 5 (28-35)
SELISTRF

SEQ ID NO: 10481 - protein, 9 aa, Artificial Sequence
  Ubiquitin carboxyl-terminal hydrolase 7 (778-786)
SELPTAKEY

SEQ ID NO: 10482 - protein, 9 aa, Artificial Sequence
  Mitochondrial import receptor subunit TOM70 (577-585)
SEMEMAHLY

SEQ ID NO: 10483 - protein, 9 aa, Artificial Sequence
  ADP-ribosylation factor 4 (137-145)
SEMTDKLGL

SEQ ID NO: 10484 - protein, 9 aa, Artificial Sequence
  Geranylgeranyl transferase type-1 subunit beta (168-176)
SENDMRFVY

SEQ ID NO: 10485 - protein, 9 aa, Artificial Sequence
  Nuclear pore complex protein Nup153 (1194-1202)
SEQPAKATF

SEQ ID NO: 10486 - protein, 9 aa, Artificial Sequence
  Coatomer subunit gamma-1 (353-361)
SESSIDRLM

SEQ ID NO: 10487 - protein, 8 aa, Artificial Sequence
  T-complex protein 1 subunit zeta (155-162)
SETDTSLI

SEQ ID NO: 10488 - protein, 8 aa, Artificial Sequence
  Caprin-1 (287-294)
SEVESTEY

SEQ ID NO: 10489 - protein, 9 aa, Artificial Sequence
  Galectin-2 (80-88)
SEVKFTVTF

SEQ ID NO: 10490 - protein, 10 aa, Artificial Sequence
  Serpin B8 (75-84)
SEVNRTGTQY

SEQ ID NO: 10491 - protein, 9 aa, Artificial Sequence
  Protein yippee-like 5 (54-62)
SEVQDRVML

SEQ ID NO: 10492 - protein, 13 aa, Artificial Sequence
  Heterogeneous nuclear ribonucleoproteins A2/B1 (266-278)
SGNFGGSRNMGGP

SEQ ID NO: 10493 - protein, 9 aa, Artificial Sequence
  Protein PRRC2C (661-669)
SGYFKQFQK

SEQ ID NO: 10494 - protein, 9 aa, Artificial Sequence
  CAAX prenyl protease 1 homolog (244-252)
SIDFPLTKV

SEQ ID NO: 10495 - protein, 9 aa, Artificial Sequence
  Signal transducer and activator of transcription 2 (358-366)
SIDRNPPQL

SEQ ID NO: 10496 - protein, 12 aa, Artificial Sequence
  Phospholipase D1 (579-590)
SIDSTSSYFNHY

SEQ ID NO: 10497 - protein, 11 aa, Artificial Sequence
  Double-stranded RNA-specific adenosine deaminase (938-948)
SIFEPAKGGEK

SEQ ID NO: 10498 - protein, 12 aa, Artificial Sequence
  DNA-directed RNA polymerase III subunit RPC4 (107-118)
SIFEQGPAEMMK

SEQ ID NO: 10499 - protein, 9 aa, Artificial Sequence
  Serine/threonine-protein kinase MARK2 (578-586)
SIFSKFTSK

SEQ ID NO: 10500 - protein, 10 aa, Artificial Sequence
  Mortality factor 4-like protein 1 (192-201)
SILEDYANYK

SEQ ID NO: 10501 - protein, 9 aa, Artificial Sequence
  Transmembrane protein 41B (276-284)
SILPAIFQK

SEQ ID NO: 10502 - protein, 9 aa, Artificial Sequence
  DNA polymerase delta subunit 3 (419-427)
SITGFFQRK

SEQ ID NO: 10503 - protein, 12 aa, Artificial Sequence
  Double-stranded RNA-specific adenosine deaminase (134-145)
SIYQDQEQRILK

SEQ ID NO: 10504 - protein, 9 aa, Artificial Sequence
  Histone H2B type 2-E (14-22)
SIYVYKVLK

SEQ ID NO: 10505 - protein, 9 aa, Artificial Sequence
  Serine/threonine-protein kinase Nek6 (66-74)
SLADFQIEK

SEQ ID NO: 10506 - protein, 9 aa, Artificial Sequence
  Poly(rC)-binding protein 2 (315-323)
SLAQYLINV

SEQ ID NO: 10507 - protein, 9 aa, Artificial Sequence
  Eukaryotic translation initiation factor 3 subunit C-like protein (835-843)
SLDQPTQTV

SEQ ID NO: 10508 - protein, 9 aa, Artificial Sequence
  FGFR1 oncogene partner 2 (28-36)
SLIEQTTAL

SEQ ID NO: 10509 - protein, 9 aa, Artificial Sequence
  60S ribosomal protein L10a (115-123)
SLIKQIPRI

SEQ ID NO: 10510 - protein, 9 aa, Artificial Sequence
  Protein zyg-11 homolog B (362-370)
SLLDDLHSA

SEQ ID NO: 10511 - protein, 11 aa, Artificial Sequence
  4F2 cell-surface antigen heavy chain (289-299)
SLLESNKDLLL

SEQ ID NO: 10512 - protein, 10 aa, Artificial Sequence
  Homocysteine-responsive endoplasmic reticulum-resident ubiquitin-like domain member 1 protein (221-230)
SLLPEGPPAI

SEQ ID NO: 10513 - protein, 9 aa, Artificial Sequence
  Bromodomain-containing protein 8 (139-147)
SLLPTSPRL

SEQ ID NO: 10514 - protein, 13 aa, Artificial Sequence
  Mitochondrial coenzyme A transporter SLC25A42 (36-48)
SLLSGALAGALAK

SEQ ID NO: 10515 - protein, 9 aa, Artificial Sequence
  Mediator of RNA polymerase II transcription subunit 12 (1321-1329)
SLLSQQPFL

SEQ ID NO: 10516 - protein, 10 aa, Artificial Sequence
  Ganglioside GM2 activator (3-12)
SLMQAPLLIA

SEQ ID NO: 10517 - protein, 9 aa, Artificial Sequence
  Terminal uridylyltransferase 7 (826-834)
SLNHFTHSV

SEQ ID NO: 10518 - protein, 9 aa, Artificial Sequence
  Signal transducer and activator of transcription 6 (256-264)
SLTGRLDEV

SEQ ID NO: 10519 - protein, 9 aa, Artificial Sequence
  Hyccin (36-44)
SLVSSLYKV

SEQ ID NO: 10520 - protein, 10 aa, Artificial Sequence
  Keratin, type II cytoskeletal 2 epidermal (342-351)
SMDNSRNLDL

SEQ ID NO: 10521 - protein, 10 aa, Artificial Sequence
  Serine/threonine-protein phosphatase 2B catalytic subunit beta isoform (116-125)
SPANTRYLFL

SEQ ID NO: 10522 - protein, 9 aa, Artificial Sequence
  Treacle protein (700-708)
SPAQVKTSV

SEQ ID NO: 10523 - protein, 17 aa, Artificial Sequence
  Alpha-enolase (263-279)
SPDDPSRYISPDQLADL

SEQ ID NO: 10524 - protein, 9 aa, Artificial Sequence
  LIM domain and actin-binding protein 1 (264-272)
SPDSRASSL

SEQ ID NO: 10525 - protein, 9 aa, Artificial Sequence
  Sterol regulatory element-binding protein 2 (1098-1106)
SPGQRAVLL

SEQ ID NO: 10526 - protein, 9 aa, Artificial Sequence
  Midasin (1754-1762)
SPGVGKTSL

SEQ ID NO: 10527 - protein, 10 aa, Artificial Sequence
  Nucleophosmin (70-79)
SPIKVTLATL

SEQ ID NO: 10528 - protein, 11 aa, Artificial Sequence
  Cation-independent mannose-6-phosphate receptor (554-564)
SPMKEKGNIQL

SEQ ID NO: 10529 - protein, 9 aa, Artificial Sequence
  Transcription factor SOX-9 (199-207)
SPNAIFKAL

SEQ ID NO: 10530 - protein, 9 aa, Artificial Sequence
  F-box/LRR-repeat protein 6 (377-385)
SPNLRLLDL

SEQ ID NO: 10531 - protein, 9 aa, Artificial Sequence
  Adiponectin receptor protein 1 (231-239)
SPQPRLIYL

SEQ ID NO: 10532 - protein, 11 aa, Artificial Sequence
  Ribosomal protein S6 kinase beta-1 (418-428)
SPRTPVSPVKF

SEQ ID NO: 10533 - protein, 9 aa, Artificial Sequence
  Zinc finger protein 655 (12-20)
SPRVQFQSL

SEQ ID NO: 10534 - protein, 11 aa, Artificial Sequence
  Probable aminopeptidase NPEPL1 (88-98)
SPSAAHFITRL

SEQ ID NO: 10535 - protein, 11 aa, Artificial Sequence
  Activating transcription factor 7-interacting protein 1 (907-917)
SPSTNRGPIQM

SEQ ID NO: 10536 - protein, 10 aa, Artificial Sequence
  Protein transport protein Sec24A (613-622)
SPTGGRMSVF

SEQ ID NO: 10537 - protein, 8 aa, Artificial Sequence
  Exportin-5 (826-833)
SPVFKTVL

SEQ ID NO: 10538 - protein, 11 aa, Artificial Sequence
  Vacuolar protein sorting-associated protein 41 homolog (371-381)
SPYLPRGDPVL

SEQ ID NO: 10539 - protein, 10 aa, Artificial Sequence
  Dolichyl-diphosphooligosaccharide-proteinosyltransferase subunit 1 (164-173)
SPYPTKTQTM

SEQ ID NO: 10540 - protein, 11 aa, Artificial Sequence
  Cell division control protein 6 homolog (6-16)
SQAQATISFPK

SEQ ID NO: 10541 - protein, 10 aa, Artificial Sequence
  Nuclear transcription factor Y subunit gamma (290-299)
SQFTDGQQLY

SEQ ID NO: 10542 - protein, 9 aa, Artificial Sequence
  Inactive serine/threonine-protein kinase VRK3 (34-42)
SQTFVNPHV

SEQ ID NO: 10543 - protein, 9 aa, Artificial Sequence
  Vacuolar protein sorting-associated protein 13B (2936-2944)
SQWDSPMRV

SEQ ID NO: 10544 - protein, 12 aa, Artificial Sequence
  Zinc finger MIZ domain-containing protein 2 (180-191)
SQYGAMGAGQSF

SEQ ID NO: 10545 - protein, 9 aa, Artificial Sequence
  Methylsterol monooxygenase 1 (145-153)
SQYNAYNEK

SEQ ID NO: 10546 - protein, 10 aa, Artificial Sequence
  COUP transcription factor 2 (198-207)
SQYPNQPTRF

SEQ ID NO: 10547 - protein, 9 aa, Artificial Sequence
  SUN domain-containing protein 2 (62-70)
SSDAHTSYY

SEQ ID NO: 10548 - protein, 9 aa, Artificial Sequence
  E3 ISG15-protein ligase HERC5 (113-121)
SSDGKPFEY

SEQ ID NO: 10549 - protein, 9 aa, Artificial Sequence
  Serrate RNA effector molecule homolog (88-96)
SSDPYHSGY

SEQ ID NO: 10550 - protein, 9 aa, Artificial Sequence
  Chromodomain-helicase-DNA-binding protein 1 (1545-1553)
SSDRHLTQY

SEQ ID NO: 10551 - protein, 9 aa, Artificial Sequence
  Glycogen phosphorylase, brain form (813-821)
SSDRTITEY

SEQ ID NO: 10552 - protein, 9 aa, Artificial Sequence
  HMG box-containing protein 1 (78-86)
SSDVSHQEY

SEQ ID NO: 10553 - protein, 9 aa, Artificial Sequence
  Disintegrin and metalloproteinase domain-containing protein 23 (174-182)
SSDYVEIHY

SEQ ID NO: 10554 - protein, 9 aa, Artificial Sequence
  Insulin-like growth factor I (5-13)
SSLPTQLFK

SEQ ID NO: 10555 - protein, 11 aa, Artificial Sequence
  Keratin, type I cytoskeletal 10 (37-47)
SSSKGSLGGGF

SEQ ID NO: 10556 - protein, 21 aa, Artificial Sequence
  Keratin, type I cytoskeletal 10 (37-57)
SSSKGSLGGGFSSGGFSGGSF

SEQ ID NO: 10557 - protein, 15 aa, Artificial Sequence
  Keratin, type I cytoskeletal 10 (568-582)
SSSSGSVGESSSKGP

SEQ ID NO: 10558 - protein, 9 aa, Artificial Sequence
  40S ribosomal protein S19 (59-67)
STARHLYLR

SEQ ID NO: 10559 - protein, 9 aa, Artificial Sequence
  Putative elongation factor 1-alpha-like 3 (157-165)
STEPPYSQK

SEQ ID NO: 10560 - protein, 10 aa, Artificial Sequence
  DNA-dependent protein kinase catalytic subunit (1861-1870)
STFDTQITKK

SEQ ID NO: 10561 - protein, 9 aa, Artificial Sequence
  Sentrin-specific protease 2 (440-448)
STFFYPKLK

SEQ ID NO: 10562 - protein, 10 aa, Artificial Sequence
  Actin, alpha cardiac muscle 1 (22-31)
STFQQMWISK

SEQ ID NO: 10563 - protein, 9 aa, Artificial Sequence
  Transketolase (258-266)
STFSEIFKK

SEQ ID NO: 10564 - protein, 10 aa, Artificial Sequence
  Syntenin-1 (205-214)
STGHVGFIFK

SEQ ID NO: 10565 - protein, 9 aa, Artificial Sequence
  E3 ubiquitin-protein ligase HECTD1 (455-463)
STIFYYVQK

SEQ ID NO: 10566 - protein, 11 aa, Artificial Sequence
  Hexokinase-2 (408-418)
STIGVDGSVYK

SEQ ID NO: 10567 - protein, 9 aa, Artificial Sequence
  Heat shock protein HSP 90-beta (541-549)
STMGYMMAK

SEQ ID NO: 10568 - protein, 11 aa, Artificial Sequence
  Actin-related protein 2 (307-317)
STMYPGLPSRL

SEQ ID NO: 10569 - protein, 12 aa, Artificial Sequence
  Adenosylhomocysteinase (85-96)
STQDHAAAAIAK

SEQ ID NO: 10570 - protein, 11 aa, Artificial Sequence
  Apoptosis-inducing factor 1, mitochondrial (76-86)
STVGAGAYAYK

SEQ ID NO: 10571 - protein, 9 aa, Artificial Sequence
  Denticleless protein homolog (404-412)
STVGWASQK

SEQ ID NO: 10572 - protein, 9 aa, Artificial Sequence
  WD repeat-containing protein 48 (319-327)
STVNKWTLK

SEQ ID NO: 10573 - protein, 11 aa, Artificial Sequence
  Sarcoplasmic/endoplasmic reticulum calcium ATPase 2 (387-397)
STYAPIGEVHK

SEQ ID NO: 10574 - protein, 11 aa, Artificial Sequence
  Integrator complex subunit 11 (175-185)
STYATTIRDSK

SEQ ID NO: 10575 - protein, 11 aa, Artificial Sequence
  Nucleolar RNA helicase 2 (324-334)
STYEQVDLIGK

SEQ ID NO: 10576 - protein, 10 aa, Artificial Sequence
  Eukaryotic translation initiation factor 3 subunit H (119-128)
STYYGSFVTR

SEQ ID NO: 10577 - protein, 9 aa, Artificial Sequence
  Heterogeneous nuclear ribonucleoprotein A1-like 2 (5-13)
SVDKIVIQK

SEQ ID NO: 10578 - protein, 10 aa, Artificial Sequence
  Mitochondrial import inner membrane translocase subunit TIM50 (213-222)
SVDPHGFISY

SEQ ID NO: 10579 - protein, 9 aa, Artificial Sequence
  Lysine-tRNA ligase (98-106)
SVDPNQYYK

SEQ ID NO: 10580 - protein, 11 aa, Artificial Sequence
  39S ribosomal protein L43, mitochondrial (93-103)
SVEEISTLVQK

SEQ ID NO: 10581 - protein, 11 aa, Artificial Sequence
  Chromodomain-helicase-DNA-binding protein 3 (1189-1199)
SVEERITQVAK

SEQ ID NO: 10582 - protein, 13 aa, Artificial Sequence
  Cirhin (180-192)
SVFDVKSGSAVHK

SEQ ID NO: 10583 - protein, 12 aa, Artificial Sequence
  Histone-lysine N-methyltransferase EHMT1 (87-98)
SVIGSNGYILNK

SEQ ID NO: 10584 - protein, 10 aa, Artificial Sequence
  Integrin alpha-4 (81-90)
SVINPGAIYR

SEQ ID NO: 10585 - protein, 16 aa, Artificial Sequence
  Protein S100-A9 (23-38)
SVKLGHPDTLNQGEFK

SEQ ID NO: 10586 - protein, 9 aa, Artificial Sequence
  Mediator of RNA polymerase II transcription subunit 6 (28-36)
SVLDYFSER

SEQ ID NO: 10587 - protein, 13 aa, Artificial Sequence
  Gelsolin (378-390)
SVLPEGGETPLFK

SEQ ID NO: 10588 - protein, 11 aa, Artificial Sequence
  Heat shock 70 kDa protein 14 (206-216)
SVMEVNSGIYR

SEQ ID NO: 10589 - protein, 10 aa, Artificial Sequence
  Basic leucine zipper and W2 domain-containing protein 1 (215-224)
SVMSTVEWNK

SEQ ID NO: 10590 - protein, 9 aa, Artificial Sequence
  60S ribosomal protein L7 (149-157)
SVNELIYKR

SEQ ID NO: 10591 - protein, 12 aa, Artificial Sequence
  Chromatin complexes subunit BAP18 (122-133)
SVPEAGGPPIKK

SEQ ID NO: 10592 - protein, 9 aa, Artificial Sequence
  ADP/ATP translocase 2 (180-188)
SVQGIIIYR

SEQ ID NO: 10593 - protein, 9 aa, Artificial Sequence
  Anaphase-promoting complex subunit 16 (24-32)
SVSDLAPPR

SEQ ID NO: 10594 - protein, 9 aa, Artificial Sequence
  Nesprin-2 (1819-1827)
SVSDLFNTK

SEQ ID NO: 10595 - protein, 12 aa, Artificial Sequence
  A-kinase anchor protein 1, mitochondrial (874-885)
SVVGDEVVLINR

SEQ ID NO: 10596 - protein, 12 aa, Artificial Sequence
  Exocyst complex component 6 (35-46)
SVYDDQPNAHKK

SEQ ID NO: 10597 - protein, 10 aa, Artificial Sequence
  Dehydrodolichyl diphosphate syntase complex subunit NUS1 (133-142)
SVYDHQGIFK

SEQ ID NO: 10598 - protein, 11 aa, Artificial Sequence
  Dehydrodolichyl diphosphate syntase complex subunit NUS1 (133-143)
SVYDHQGIFKR

SEQ ID NO: 10599 - protein, 16 aa, Artificial Sequence
  Actin, alpha skeletal muscle (35-50)
SYELPDGQVITIGNER

SEQ ID NO: 10600 - protein, 10 aa, Artificial Sequence
  Tetratricopeptide repeat protein 27 (18-27)
SYLEKQVVTF

SEQ ID NO: 10601 - protein, 9 aa, Artificial Sequence
  U5 small nuclear ribonucleoprotein 200 kDa helicase (1958-1966)
SYLKQLPHF

SEQ ID NO: 10602 - protein, 9 aa, Artificial Sequence
  Intraflagellar transport protein 122 homolog (100-108)
SYNPITHQL

SEQ ID NO: 10603 - protein, 9 aa, Artificial Sequence
  Constitutive coactivator of peroxisome proliferator-activated receptor gamma (261-269)
SYTSVKENF

SEQ ID NO: 10604 - protein, 8 aa, Artificial Sequence
  60S ribosomal protein L24 (24-31)
TDGKVFQF

SEQ ID NO: 10605 - protein, 9 aa, Artificial Sequence
  DNA-directed RNA polymerase II subunit RPB11-b2 (113-121)
TDLIRELSL

SEQ ID NO: 10606 - protein, 9 aa, Artificial Sequence
  WD repeat-containing protein (630-638)
TDLMRLKEI

SEQ ID NO: 10607 - protein, 9 aa, Artificial Sequence
  Protein disulfide-isomerase (296-304)
TDNQRILEF

SEQ ID NO: 10608 - protein, 9 aa, Artificial Sequence
  Tensin-1 (1649-1657)
TDNQRKLFF

SEQ ID NO: 10609 - protein, 9 aa, Artificial Sequence
  Keratin, type I cytoskeletal 19 (327-335)
TEARFGAQL

SEQ ID NO: 10610 - protein, 9 aa, Artificial Sequence
  Nucleolin (584-592)
TEETLKESF

SEQ ID NO: 10611 - protein, 9 aa, Artificial Sequence
  UPF0568 protein C14orf166 (23-31)
TEFRNFIVW

SEQ ID NO: 10612 - protein, 9 aa, Artificial Sequence
  Cytoplasmic dynein 1 heavy chain 1 (1693-1701)
TEHPKINEW

SEQ ID NO: 10613 - protein, 9 aa, Artificial Sequence
  Disheveled-associated activator of morphogenesis 1 (629-637)
TEIDDTKVF

SEQ ID NO: 10614 - protein, 9 aa, Artificial Sequence
  Proteasome activator complex subunit 3 (207-215)
TEIDEKEYI

SEQ ID NO: 10615 - protein, 11 aa, Artificial Sequence
  Nucleolin (452-462)
TEIDGRSISLY

SEQ ID NO: 10616 - protein, 10 aa, Artificial Sequence
  Coatomer subunit alpha (1207-1216)
TEIGKDVIGL

SEQ ID NO: 10617 - protein, 9 aa, Artificial Sequence
  Thiopurine S-methyltransferase (113-121)
TEIPGTKVF

SEQ ID NO: 10618 - protein, 10 aa, Artificial Sequence
  Angiomotin (467-476)
TEIQRVSEAY

SEQ ID NO: 10619 - protein, 9 aa, Artificial Sequence
  Eukaryotic translation initiation factor 3 subunit C-like protein (323-331)
TEITHAVVI

SEQ ID NO: 10620 - protein, 9 aa, Artificial Sequence
  Fructose-bisphosphate aldolase A (206-214)
TEKVLAAVY

SEQ ID NO: 10621 - protein, 9 aa, Artificial Sequence
  Staphylococcal nuclease domain-containing protein 1 (260-268)
TELLLKEGF

SEQ ID NO: 10622 - protein, 9 aa, Artificial Sequence
  Sorting nexin-5 (292-300)
TELLRYYML

SEQ ID NO: 10623 - protein, 9 aa, Artificial Sequence
  Tuftelin (365-373)
TENPGSIRI

SEQ ID NO: 10624 - protein, 9 aa, Artificial Sequence
  KN motif and ankyrin repeat domain-containing protein 2 (612-620)
TERELKVAY

SEQ ID NO: 10625 - protein, 9 aa, Artificial Sequence
  Tensin-1 (19-27)
TERIIAVSF

SEQ ID NO: 10626 - protein, 10 aa, Artificial Sequence
  Microtubule-actin cross-linking factor 1, isoforms 1/2/3/5 (327-336)
TEVDSRWQEY

SEQ ID NO: 10627 - protein, 9 aa, Artificial Sequence
  Melanoma-associated antigen D2 (67-75)
TEVSKTPEA

SEQ ID NO: 10628 - protein, 11 aa, Artificial Sequence
  Cytoplasmic dynein 1 heavy chain 1 (3550-3560)
TEYLSNADERL

SEQ ID NO: 10629 - protein, 10 aa, Artificial Sequence
  Autophagy-related protein 9A (6-15)
TEYQRLEASY

SEQ ID NO: 10630 - protein, 13 aa, Artificial Sequence
  Glyceraldehyde-3-phosphate dehydrogenase (3-15)
TFDAGAGIALNDH

SEQ ID NO: 10631 - protein, 9 aa, Artificial Sequence
  Hydroxymethylglutaryl-CoA synthase, cytoplasmic (131-139)
TIIDKSKSV

SEQ ID NO: 10632 - protein, 11 aa, Artificial Sequence
  Histone H3.3 (119-129)
TIMPKDIQLAR

SEQ ID NO: 10633 - protein, 10 aa, Artificial Sequence
  NADH dehydrogenase (ubiquinone) iron-sulfur protein 5 (19-28)
TIQSGEQPYK

SEQ ID NO: 10634 - protein, 10 aa, Artificial Sequence
  T-complex protein 1 subunit zeta-2 (204-213)
TKEVNSGFFY

SEQ ID NO: 10635 - protein, 9 aa, Artificial Sequence
  Serine/threonine-protein phosphatase 6 regulatory ankyrin repeat subunit C (603-611)
TLAETLVNL

SEQ ID NO: 10636 - protein, 9 aa, Artificial Sequence
  Leucine-rich repeat-containing protein 41 (19-27)
TLASSLHTL

SEQ ID NO: 10637 - protein, 9 aa, Artificial Sequence
  MOB kinase activator 1A (130-138)
TLFPSKIGV

SEQ ID NO: 10638 - protein, 9 aa, Artificial Sequence
  A-kinase anchor protein 11 (1555-1563)
TLGSTVFRV

SEQ ID NO: 10639 - protein, 9 aa, Artificial Sequence
  Nucleosome-remodeling factor subunit BPTF (281-289)
TLMAEMHVV

SEQ ID NO: 10640 - protein, 9 aa, Artificial Sequence
  WD repeat-containing protein 81 (157-165)
TLMDILPRI

SEQ ID NO: 10641 - protein, 9 aa, Artificial Sequence
  Exportin-1 (346-354)
TLMEALHYM

SEQ ID NO: 10642 - protein, 9 aa, Artificial Sequence
  Splicing factor 3A subunit 1 (521-529)
TLQEQIEAI

SEQ ID NO: 10643 - protein, 9 aa, Artificial Sequence
  Replication protein A 32 kDa subunit (58-66)
TLVDEVFRI

SEQ ID NO: 10644 - protein, 9 aa, Artificial Sequence
  Elongator complex protein 2 (406-414)
TLWPEVQKL

SEQ ID NO: 10645 - protein, 9 aa, Artificial Sequence
  Exosome complex component RRP42 (108-116)
TLYRIFNNK

SEQ ID NO: 10646 - protein, 9 aa, Artificial Sequence
  Transmembrane protein 50A (48-56)
TMKDFNHSY

SEQ ID NO: 10647 - protein, 9 aa, Artificial Sequence
  snRNA-activating protein complex subunit 4 (1152-1160)
TPAPPTHAL

SEQ ID NO: 10648 - protein, 10 aa, Artificial Sequence
  Spectrin beta chain, non-erythrocytic 1 (2320-2329)
TPASSRAQTL

SEQ ID NO: 10649 - protein, 11 aa, Artificial Sequence
  26S proteasome non-ATPase regulatory subunit 4 (65-75)
TPDTGRILSKL

SEQ ID NO: 10650 - protein, 9 aa, Artificial Sequence
  ATP-dependent zinc metalloprotease YME1L1 (25-33)
TPKNTSVSL

SEQ ID NO: 10651 - protein, 9 aa, Artificial Sequence
  Galectin-8 (193-201)
TPMGPGRTV

SEQ ID NO: 10652 - protein, 9 aa, Artificial Sequence
  WAS/WASL-interacting protein family member 1 (331-339)
TPRLPQRNL

SEQ ID NO: 10653 - protein, 11 aa, Artificial Sequence
  ATP synthase F(0) complex subunit C2, mitochondrial (26-36)
TPSLVKSTSQL

SEQ ID NO: 10654 - protein, 9 aa, Artificial Sequence
  Ubiquitin carboxyl-terminal hydrolase 48 (860-868)
TQATIYVHK

SEQ ID NO: 10655 - protein, 11 aa, Artificial Sequence
  HLA class I histocompatibility antigen, B-13 alpha chain (63-73)
TQISKTNTQTY

SEQ ID NO: 10656 - protein, 10 aa, Artificial Sequence
  rRNA-processing protein FCF1 homolog (61-70)
TQLGPPYHIL

SEQ ID NO: 10657 - protein, 9 aa, Artificial Sequence
  14-3-3 protein gamma (115-123)
TQYESKVFY

SEQ ID NO: 10658 - protein, 9 aa, Artificial Sequence
  Gamma-interferon-inducible protein 16 (419-427)
TTFPESHLR

SEQ ID NO: 10659 - protein, 9 aa, Artificial Sequence
  MIT domain-containing protein 1 (236-244)
TTVDIFHKK

SEQ ID NO: 10660 - protein, 9 aa, Artificial Sequence
  Lys-63-specific deubiquitinase BRCC36 (66-74)
TVAEKVDAV

SEQ ID NO: 10661 - protein, 9 aa, Artificial Sequence
  28S ribosomal protein S24, mitochondrial (78-86)
TVEDVFLRK

SEQ ID NO: 10662 - protein, 12 aa, Artificial Sequence
  Phosphatidylinositol-4,5-bisphosphate 4-phosphatase 2 (39-50)
TVESPELQVPYK

SEQ ID NO: 10663 - protein, 9 aa, Artificial Sequence
  Glycine-tRNA ligase (533-541)
TVFEHTFHV

SEQ ID NO: 10664 - protein, 11 aa, Artificial Sequence
  Tubulin alpha-1C chain (38-48)
TVIDEVRTGTY

SEQ ID NO: 10665 - protein, 9 aa, Artificial Sequence
  Transcription factor BTF3 (76-84)
TVIHFNNPK

SEQ ID NO: 10666 - protein, 11 aa, Artificial Sequence
  DNA replication licensing factor MCM6 (163-173)
TVIRDVEQQFK

SEQ ID NO: 10667 - protein, 11 aa, Artificial Sequence
  Dolichyl-diphosphooligosaccharide-proteinosyltransferase subunit 2 (165-175)
TVLESRSLFSK

SEQ ID NO: 10668 - protein, 16 aa, Artificial Sequence
  Actin, cytoplasmic 2 (36-51)
TVLSGGTTMYPGIADR

SEQ ID NO: 10669 - protein, 9 aa, Artificial Sequence
  Ubiquitin-protein ligase E3A (325-333)
TYKVISNEF

SEQ ID NO: 10670 - protein, 9 aa, Artificial Sequence
  Vacuolar protein sorting-associated protein 51 homolog (480-488)
VADEELVHL

SEQ ID NO: 10671 - protein, 8 aa, Artificial Sequence
  Eukaryotic translation initiation factor 3 subunit H (221-228)
VADKHELL

SEQ ID NO: 10672 - protein, 9 aa, Artificial Sequence
  Bifunctional polynucleotide phosphatase/kinase (54-62)
VADPETRTV

SEQ ID NO: 10673 - protein, 9 aa, Artificial Sequence
  Serine/threonine-protein kinase PLK2 (471-479)
VADTVARVL

SEQ ID NO: 10674 - protein, 9 aa, Artificial Sequence
  Ubiquitin carboxyl-terminal hydrolase 16 (733-741)
VAEENTRVL

SEQ ID NO: 10675 - protein, 9 aa, Artificial Sequence
  HLA class I histocompatibility antigen, B-8 alpha chain (151-159)
VAEQDRAYL

SEQ ID NO: 10676 - protein, 9 aa, Artificial Sequence
  Mitochondrial import receptor subunit TOM5 homolog (35-43)
VALLRVTPF

SEQ ID NO: 10677 - protein, 18 aa, Artificial Sequence
  Actin, cytoplasmic 1 (13-30)
VAPEEHPVLLTEAPLNPK

SEQ ID NO: 10678 - protein, 8 aa, Artificial Sequence
  Polymerase I and transcript release factor (229-236)
VDDFKKAF

SEQ ID NO: 10679 - protein, 9 aa, Artificial Sequence
  Cholesteryl ester transfer protein (230-238)
VDISLTGDP

SEQ ID NO: 10680 - protein, 8 aa, Artificial Sequence
  Heterogeneous nuclear ribonucleoproteins C1/C2 (33-40)
VEAIFSKY

SEQ ID NO: 10681 - protein, 9 aa, Artificial Sequence
  Sodium/potassium-transporting ATPase subunit alpha-1 (701-709)
VEDSYGQQW

SEQ ID NO: 10682 - protein, 10 aa, Artificial Sequence
  116 kDa U5 small nuclear ribonucleoprotein component (621-630)
VEESGEHVIL

SEQ ID NO: 10683 - protein, 11 aa, Artificial Sequence
  Adenosylhomocysteinase 2 (222-232)
VEESVTGVHRL

SEQ ID NO: 10684 - protein, 12 aa, Artificial Sequence
  ATP synthase subunit alpha, mitochondrial (96-107)
VEFSSGLKGMSL

SEQ ID NO: 10685 - protein, 9 aa, Artificial Sequence
  HLA class II histocompatibility antigen, DRB1-4 beta chain (204-212)
VEHPSLTSP

SEQ ID NO: 10686 - protein, 11 aa, Artificial Sequence
  Protein disulfide-isomerase A6 (411-421)
VELDDLGKDEL

SEQ ID NO: 10687 - protein, 9 aa, Artificial Sequence
  Galectin-3 (204-212)
VEPDHFKVA

SEQ ID NO: 10688 - protein, 8 aa, Artificial Sequence
  SARM1 protein (269-276)
VEREVEQV

SEQ ID NO: 10689 - protein, 8 aa, Artificial Sequence
  N6-adenosine-methyltransferase 70 kDa subunit (116-123)
VESLLQKF

SEQ ID NO: 10690 - protein, 9 aa, Artificial Sequence
  Protein RMD5 homolog B (280-288)
VESPLSVSF

SEQ ID NO: 10691 - protein, 11 aa, Artificial Sequence
  Nucleosome assembly protein 1-like 1 (60-70)
VETPTGYIESL

SEQ ID NO: 10692 - protein, 9 aa, Artificial Sequence
  Influenza virus NS1A-binding protein (83-91)
VEVLLNYAY

SEQ ID NO: 10693 - protein, 9 aa, Artificial Sequence
  Rho GDP-dissociation inhibitor 1 (108-116)
VEYRIKISF

SEQ ID NO: 10694 - protein, 17 aa, Artificial Sequence
  40S ribosomal protein S3a (66-82)
VFEVSLADLQNDEVAFR

SEQ ID NO: 10695 - protein, 9 aa, Artificial Sequence
  40S ribosomal protein S23 (112-120)
VGDIPGVRF

SEQ ID NO: 10696 - protein, 9 aa, Artificial Sequence
  AT-rich interactive domain-containing protein 1A (1378-1386)
VGDPGQRTL

SEQ ID NO: 10697 - protein, 9 aa, Artificial Sequence
  Bromodomain-containing protein 8 (239-247)
VGDPHTVTV

SEQ ID NO: 10698 - protein, 9 aa, Artificial Sequence
  F-box/LRR-repeat protein 19 (440-448)
VGDPSVHLL

SEQ ID NO: 10699 - protein, 9 aa, Artificial Sequence
  Nucleolar protein 56 (117-125)
VIAEILRGV

SEQ ID NO: 10700 - protein, 9 aa, Artificial Sequence
  Kelch-like ECH-associated protein 1 (420-428)
VIDGHIYAV

SEQ ID NO: 10701 - protein, 9 aa, Artificial Sequence
  Eukaryotic translation initiation factor 3 subunit L (83-91)
VIDQKVYEI

SEQ ID NO: 10702 - protein, 9 aa, Artificial Sequence
  E3 ubiquitin-protein ligase RNF213 (1305-1313)
VIFKDFVNK

SEQ ID NO: 10703 - protein, 9 aa, Artificial Sequence
  MICOS complex subunit MIC27 (158-166)
VIIAKVTAK

SEQ ID NO: 10704 - protein, 13 aa, Artificial Sequence
  Elongation factor 1-alpha 1 (344-356)
VIILNHPGQISAG

SEQ ID NO: 10705 - protein, 9 aa, Artificial Sequence
  Plectin (1820-1828)
VLAEKLAAI

SEQ ID NO: 10706 - protein, 8 aa, Artificial Sequence
  Lysine-specific demethylase 5A (1593-1600)
VLDIPSKY

SEQ ID NO: 10707 - protein, 9 aa, Artificial Sequence
  Integrin-linked protein kinase (219-227)
VLHEGTNFV

SEQ ID NO: 10708 - protein, 9 aa, Artificial Sequence
  Interleukin-12 subunit alpha (14-22)
VLLDHLSLA

SEQ ID NO: 10709 - protein, 11 aa, Artificial Sequence
  Tumor necrosis factor receptor superfamily member 19 (5-15)
VLLEQEKTFFT

SEQ ID NO: 10710 - protein, 10 aa, Artificial Sequence
  Protein CNPPD1 (210-219)
VLLEQPTWQL

SEQ ID NO: 10711 - protein, 10 aa, Artificial Sequence
  Fatty acid synthase (2105-2114)
VLSSFVLAEK

SEQ ID NO: 10712 - protein, 9 aa, Artificial Sequence
  2'-deoxynucleoside 5'-phosphate N-hydrolase 1 (52-60)
VLTEHVAAA

SEQ ID NO: 10713 - protein, 10 aa, Artificial Sequence
  AKT-interacting protein (200-209)
VLYEKDIQLF

SEQ ID NO: 10714 - protein, 9 aa, Artificial Sequence
  Thioredoxin-like protein 4A (44-52)
VLYSIAEKV

SEQ ID NO: 10715 - protein, 11 aa, Artificial Sequence
  Putative PIP5K1A and PSMD4-like protein (813-823)
VMQDPEFLQSV

SEQ ID NO: 10716 - protein, 16 aa, Artificial Sequence
  78 kDa glucose-regulated protein (177-192)
VMRIINEPTAAAIAYG

SEQ ID NO: 10717 - protein, 11 aa, Artificial Sequence
  Glutathione S-transferase P (200-210)
VNLPINGNGKQ

SEQ ID NO: 10718 - protein, 9 aa, Artificial Sequence
  Eukaryotic translation initiation factor 3 subunit E (109-117)
VPATDRNAL

SEQ ID NO: 10719 - protein, 11 aa, Artificial Sequence
  Protein UXT (95-105)
VPDTSRIYVAL

SEQ ID NO: 10720 - protein, 11 aa, Artificial Sequence
  A-kinase-interacting protein 1 (107-117)
VPEEGGATHVY

SEQ ID NO: 10721 - protein, 9 aa, Artificial Sequence
  N-alpha-acetyltransferase 10 (67-75)
VPHGHITSL

SEQ ID NO: 10722 - protein, 9 aa, Artificial Sequence
  Tubulin beta chain (80-88)
VPRAILVDL

SEQ ID NO: 10723 - protein, 9 aa, Artificial Sequence
  Protein phosphatase 1 regulatory subunit 15A (126-134)
VPRGQGSQF

SEQ ID NO: 10724 - protein, 9 aa, Artificial Sequence
  Protein Wiz (759-767)
VPRPPQTSL

SEQ ID NO: 10725 - protein, 8 aa, Artificial Sequence
  Transmembrane protein 140 (75-82)
VPRVGLGL

SEQ ID NO: 10726 - protein, 9 aa, Artificial Sequence
  Nucleolar transcription factor 1 (161-169)
VPSTERMVL

SEQ ID NO: 10727 - protein, 9 aa, Artificial Sequence
  Replication protein A 70 kDa DNA-binding subunit (383-391)
VSDFGGRSL

SEQ ID NO: 10728 - protein, 9 aa, Artificial Sequence
  Cytosolic non-specific dipeptidase (386-394)
VSDFSHPHY

SEQ ID NO: 10729 - protein, 9 aa, Artificial Sequence
  Sister chromatid cohesion protein PDS5 homolog A (258-266)
VSDLSEHVF

SEQ ID NO: 10730 - protein, 8 aa, Artificial Sequence
  DNA damage-inducible transcript 4 protein (124-131)
VSQVGKEL

SEQ ID NO: 10731 - protein, 10 aa, Artificial Sequence
  Tetratricopeptide repeat protein 28 (985-994)
VTDPTGFLRM

SEQ ID NO: 10732 - protein, 9 aa, Artificial Sequence
  Beta-2-syntrophin (352-360)
VTEKDLLLY

SEQ ID NO: 10733 - protein, 10 aa, Artificial Sequence
  T-complex protein 1 subunit epsilon (13-22)
VTIFIRGGNK

SEQ ID NO: 10734 - protein, 10 aa, Artificial Sequence
  NHP2-like protein 1 (104-113)
VTIKEGSQLK

SEQ ID NO: 10735 - protein, 12 aa, Artificial Sequence
  T-complex protein 1 subunit delta (68-79)
VTITNDGATILK

SEQ ID NO: 10736 - protein, 9 aa, Artificial Sequence
  HLA class I histocompatibility antigen, alpha chain E (313-321)
VVAAVIWRK

SEQ ID NO: 10737 - protein, 9 aa, Artificial Sequence
  Jouberin (370-378)
VVDEHTGQY

SEQ ID NO: 10738 - protein, 9 aa, Artificial Sequence
  WASH complex subunit 7 (157-165)
VVMNVVHQL

SEQ ID NO: 10739 - protein, 11 aa, Artificial Sequence
  Cyclin-G-associated kinase (580-590)
VVMTPVPLFSK

SEQ ID NO: 10740 - protein, 10 aa, Artificial Sequence
  Exportin-6 (715-724)
VVQEPGQVFK

SEQ ID NO: 10741 - protein, 9 aa, Artificial Sequence
  DNA damage-binding protein 1 (508-516)
VVVAVGRAL

SEQ ID NO: 10742 - protein, 11 aa, Artificial Sequence
  rRNA 2'-O-methyltransferase fibrillarin (305-315)
VVVGVYRPPPK

SEQ ID NO: 10743 - protein, 9 aa, Artificial Sequence
  Transmembrane protein 41B (174-182)
VVYKYLTEK

SEQ ID NO: 10744 - protein, 9 aa, Artificial Sequence
  Ribose-phosphate pyrophosphokinase 1 (40-48)
VYAILTHGI

SEQ ID NO: 10745 - protein, 10 aa, Artificial Sequence
  ATP synthase mitochondrial F1 complex assembly factor 1 (87-96)
VYAVIPAEKF

SEQ ID NO: 10746 - protein, 9 aa, Artificial Sequence
  Antizyme inhibitor 1 (320-328)
VYGSFASKL

SEQ ID NO: 10747 - protein, 10 aa, Artificial Sequence
  ATP-dependent RNA helicase DHX8 (1133-1142)
VYIHPSSALF

SEQ ID NO: 10748 - protein, 9 aa, Artificial Sequence
  Adenosylhomocysteinase 2 (207-215)
VYKKYPNVF

SEQ ID NO: 10749 - protein, 9 aa, Artificial Sequence
  Inactive tyrosine-protein kinase 7 (955-963)
VYNSEYYHF

SEQ ID NO: 10750 - protein, 9 aa, Artificial Sequence
  2'-5'-oligoadenylate synthase 3 (865-873)
WENPRVLSF

SEQ ID NO: 10751 - protein, 7 aa, Artificial Sequence
  Actin, aortic smooth muscle (358-364)
WISKQEY

SEQ ID NO: 10752 - protein, 9 aa, Artificial Sequence
  Protein LYRIC (404-412)
WVDEERASL

SEQ ID NO: 10753 - protein, 10 aa, Artificial Sequence
  General transcription factor 3C polypeptide 5 (51-60)
YADPTKRLEL

SEQ ID NO: 10754 - protein, 9 aa, Artificial Sequence
  Translocon-associated protein subunit delta (67-75)
YADVGGKQF

SEQ ID NO: 10755 - protein, 10 aa, Artificial Sequence
  U5 small nuclear ribonucleoprotein 200 kDa helicase (1245-1254)
YAQDEHLITF

SEQ ID NO: 10756 - protein, 11 aa, Artificial Sequence
  HLA class I histocompatibility antigen, alpha chain G (137-147)
YAYDGKDYLAL

SEQ ID NO: 10757 - protein, 15 aa, Artificial Sequence
  Cofilin-1 (85-99)
YDATYETKESKKEDL

SEQ ID NO: 10758 - protein, 9 aa, Artificial Sequence
  Transcriptional adapter 2-alpha (431-439)
YDFLIREGY

SEQ ID NO: 10759 - protein, 9 aa, Artificial Sequence
  Myeloid cell nuclear differentiation antigen (31-39)
YDLGLTTKM

SEQ ID NO: 10760 - protein, 9 aa, Artificial Sequence
  Dual specificity tyrosine-phosphorylation-regulated kinase 1A (246-254)
YDLLRNTNF

SEQ ID NO: 10761 - protein, 8 aa, Artificial Sequence
  Renin receptor (335-342)
YDSIIYRM

SEQ ID NO: 10762 - protein, 9 aa, Artificial Sequence
  Integrin beta-1 (314-322)
YDYPSIAHL

SEQ ID NO: 10763 - protein, 9 aa, Artificial Sequence
  ATP-dependent RNA helicase DDX3X (283-291)
YEEARKFSY

SEQ ID NO: 10764 - protein, 9 aa, Artificial Sequence
  Cytochrome c oxidase subunit 7C, mitochondrial (19-27)
YEEGPGKNL

SEQ ID NO: 10765 - protein, 9 aa, Artificial Sequence
  Spectrin beta chain, non-erythrocytic 1 (461-469)
YEERVQAVV

SEQ ID NO: 10766 - protein, 11 aa, Artificial Sequence
  La-related protein 1 (633-643)
YEIDDRDVNKI

SEQ ID NO: 10767 - protein, 10 aa, Artificial Sequence
  Nodal modulator 2 (181-190)
YEILATHPTW

SEQ ID NO: 10768 - protein, 9 aa, Artificial Sequence
  Keratin, type I cytoskeletal 10 (42-50)
YENEVALRQ

SEQ ID NO: 10769 - protein, 9 aa, Artificial Sequence
  Ubiquitin carboxyl-terminal hydrolase 22 (258-266)
YEQQDAHEF

SEQ ID NO: 10770 - protein, 10 aa, Artificial Sequence
  Regulator of microtubule dynamics protein 1 (94-103)
YESGETEKLY

SEQ ID NO: 10771 - protein, 9 aa, Artificial Sequence
  Thioredoxin-interacting protein (97-105)
YEYKFGFEL

SEQ ID NO: 10772 - protein, 11 aa, Artificial Sequence
  Hemoglobin subunit alpha (25-35)
YGAEALERMFL

SEQ ID NO: 10773 - protein, 9 aa, Artificial Sequence
  Solute carrier family 25 member 43 (300-308)
YILSPLSYK

SEQ ID NO: 10774 - protein, 10 aa, Artificial Sequence
  UDP-N-acetylglucosamine transporter (266-275)
YIYDGELVSK

SEQ ID NO: 10775 - protein, 10 aa, Artificial Sequence
  Zinc finger protein 573 (42-51)
YLDPNQRDLY

SEQ ID NO: 10776 - protein, 9 aa, Artificial Sequence
  Splicing factor 3A subunit 3 (192-200)
YLQDYTDRV

SEQ ID NO: 10777 - protein, 11 aa, Artificial Sequence
  Regulator of microtubule dynamics protein 1 (92-102)
YLYESGETEKL

SEQ ID NO: 10778 - protein, 9 aa, Artificial Sequence
  Myc proto-oncogene protein (334-342)
YPAAKRVKL

SEQ ID NO: 10779 - protein, 9 aa, Artificial Sequence
  Exportin-T (608-616)
YPAERKQAL

SEQ ID NO: 10780 - protein, 10 aa, Artificial Sequence
  Ubiquitin-conjugating enzyme E2 D2 (59-68)
YPFKPPKVAF

SEQ ID NO: 10781 - protein, 10 aa, Artificial Sequence
  Ubiquitin-conjugating enzyme E2 E1 (89-98)
YPFKPPKVTF

SEQ ID NO: 10782 - protein, 9 aa, Artificial Sequence
  ATP-dependent RNA helicase DDX24 (383-391)
YPKRPLLGL

SEQ ID NO: 10783 - protein, 9 aa, Artificial Sequence
  All-trans-retinol 13,14-reductase (15-23)
YPRGGSSEI

SEQ ID NO: 10784 - protein, 9 aa, Artificial Sequence
  Laminin subunit gamma-1 (615-623)
YPSETTVKY

SEQ ID NO: 10785 - protein, 9 aa, Artificial Sequence
  Eukaryotic translation initiation factor 3 subunit E (62-70)
YSDDIPHAL

SEQ ID NO: 10786 - protein, 12 aa, Artificial Sequence
  Bromodomain and WD repeat-containing protein 1 (854-865)
YSESSSDSSSRY

SEQ ID NO: 10787 - protein, 9 aa, Artificial Sequence
  Nuclear pore complex protein Nup160 (345-353)
YSLDHISSL

SEQ ID NO: 10788 - protein, 9 aa, Artificial Sequence
  ATP-dependent RNA helicase DDX51 (304-312)
YTDATPLRV

SEQ ID NO: 10789 - protein, 8 aa, Artificial Sequence
  Cytosolic purine 5'-nucleotidase (255-262)
YTDKIMTY

SEQ ID NO: 10790 - protein, 10 aa, Artificial Sequence
  Sterol regulatory element-binding protein cleavage-activating protein (160-169)
YTDPAGLRNY

SEQ ID NO: 10791 - protein, 9 aa, Artificial Sequence
  General transcription factor 3C polypeptide 2 (787-795)
YTETVNHHY

SEQ ID NO: 10792 - protein, 9 aa, Artificial Sequence
  Cytochrome c oxidase subunit 1 (403-411)
YTLDQTYAK

SEQ ID NO: 10793 - protein, 9 aa, Artificial Sequence
  3-phosphoinositide-dependent protein kinase 1 (486-494)
YVDPVNKVL

SEQ ID NO: 10794 - protein, 10 aa, Artificial Sequence
  Alanine-tRNA ligase, cytoplasmic (497-506)
YVFENTVATV

SEQ ID NO: 10795 - protein, 14 aa, Artificial Sequence
  Actin, aortic smooth muscle (55-68)
YVGDEAQSKRGILT

SEQ ID NO: 10796 - protein, 9 aa, Artificial Sequence
  Exocyst complex component 2 (206-214)
YYAEVETRI

SEQ ID NO: 10797 - protein, 9 aa, Artificial Sequence
  Nuclear receptor corepressor 2 (332-340)
YYEKQFPEI

SEQ ID NO: 10798 - protein, 9 aa, Artificial Sequence
  Plexin-B2 (1-9)
YYTDIMHTL

SEQ ID NO: 10799 - protein, 9 aa, Artificial Sequence
  Tankyrase-1 (100-108)
AAAPVVPAV

SEQ ID NO: 10800 - protein, 9 aa, Artificial Sequence
  Ubiquitin-conjugating enzyme E2 J2 (242-250)
AAFAYTVKY

SEQ ID NO: 10801 - protein, 9 aa, Artificial Sequence
  DNA replication licensing factor MCM5 (326-334)
AALPNVYEV

SEQ ID NO: 10802 - protein, 9 aa, Artificial Sequence
  Heterogeneous nuclear ribonucleoprotein Q (215-223)
AAQEAVKLY

SEQ ID NO: 10803 - protein, 9 aa, Artificial Sequence
  Zinc finger protein 609 (360-368)
AEADKIYSF

SEQ ID NO: 10804 - protein, 9 aa, Artificial Sequence
  M-phase inducer phosphatase 2 (285-293)
AEEPKARVL

SEQ ID NO: 10805 - protein, 10 aa, Artificial Sequence
  SHC SH2 domain-binding protein 1 (437-446)
AEFLMKNSDL

SEQ ID NO: 10806 - protein, 9 aa, Artificial Sequence
  Pre-mRNA-splicing factor ATP-dependent RNA helicase DHX15 (563-571)
AEFPLDPQL

SEQ ID NO: 10807 - protein, 11 aa, Artificial Sequence
  Intraflagellar transport protein 81 homolog (43-53)
AEIDPKQLVDI

SEQ ID NO: 10808 - protein, 9 aa, Artificial Sequence
  Clathrin heavy chain 1 (493-501)
AETGQVQKI

SEQ ID NO: 10809 - protein, 9 aa, Artificial Sequence
  Uncharacterized protein C8orf59 (62-70)
AHFAKSISL

SEQ ID NO: 10810 - protein, 9 aa, Artificial Sequence
  60S ribosomal protein L9 (97-105)
AHFPINVVI

SEQ ID NO: 10811 - protein, 9 aa, Artificial Sequence
  Intraflagellar transport protein 27 homolog (30-38)
AHFQKSYTL

SEQ ID NO: 10812 - protein, 9 aa, Artificial Sequence
  Xaa-Pro aminopeptidase 1 (333-341)
AHIKDAVAL

SEQ ID NO: 10813 - protein, 9 aa, Artificial Sequence
  CCR4-NOT transcription complex subunit 1 (2246-2254)
AHMDIFQNL

SEQ ID NO: 10814 - protein, 9 aa, Artificial Sequence
  NEDD8 ultimate buster 1 (148-156)
AHNVKAMVL

SEQ ID NO: 10815 - protein, 10 aa, Artificial Sequence
  Peptidyl-prolyl cis-trans isomerase FKBP8 (230-239)
AHYQRADFVL

SEQ ID NO: 10816 - protein, 9 aa, Artificial Sequence
  Zinc phosphodiesterase ELAC protein 2 (230-238)
AIAPIIAAV

SEQ ID NO: 10817 - protein, 10 aa, Artificial Sequence
  Sister chromatid cohesion protein PDS5 homolog A (274-283)
AIDPHLLLSV

SEQ ID NO: 10818 - protein, 9 aa, Artificial Sequence
  RNA-binding motif, single-stranded-interacting protein 2 (87-95)
AILDKTTNK

SEQ ID NO: 10819 - protein, 9 aa, Artificial Sequence
  S-phase kinase-associated protein 1 (53-61)
AILKKVIQW

SEQ ID NO: 10820 - protein, 9 aa, Artificial Sequence
  Importin-11 (662-670)
AILTTLIHL

SEQ ID NO: 10821 - protein, 9 aa, Artificial Sequence
  Probable ATP-dependent RNA helicase DDX5 (466-474)
AINPKLLQL

SEQ ID NO: 10822 - protein, 9 aa, Artificial Sequence
  Mitochondrial fission process protein 1 (94-102)
AIPGFTINR

SEQ ID NO: 10823 - protein, 11 aa, Artificial Sequence
  Rab GDP dissociation inhibitor beta (163-173)
AIYGGTYMLNK

SEQ ID NO: 10824 - protein, 9 aa, Artificial Sequence
  Protein SHQ1 homolog (400-408)
ALAEALKEV

SEQ ID NO: 10825 - protein, 9 aa, Artificial Sequence
  DNA mismatch repair protein Msh2 (789-797)
ALANQIPTV

SEQ ID NO: 10826 - protein, 9 aa, Artificial Sequence
  EH domain-containing protein 2 (507-515)
ALASHLIEA

SEQ ID NO: 10827 - protein, 9 aa, Artificial Sequence
  Carboxypeptidase Q (122-130)
ALASLIRSV

SEQ ID NO: 10828 - protein, 9 aa, Artificial Sequence
  serine/threonine-protein phosphatase 2A 65 kDa regulatory subunit A beta isoform isoform e (229-237)
ALASVIMGL

SEQ ID NO: 10829 - protein, 9 aa, Artificial Sequence
  Fidgetin-like protein 1 (133-141)
ALASVVIHK

SEQ ID NO: 10830 - protein, 9 aa, Artificial Sequence
  Cleavage and polyadenylation specificity factor subunit 1 (195-203)
ALDEKLLNI

SEQ ID NO: 10831 - protein, 10 aa, Artificial Sequence
  Serine/threonine-protein kinase 10 (901-910)
ALDESHNQNL

SEQ ID NO: 10832 - protein, 10 aa, Artificial Sequence
  Protein phosphatase 1 regulatory subunit 15B (166-175)
ALDPAAQAFL

SEQ ID NO: 10833 - protein, 11 aa, Artificial Sequence
  Cardiolipin synthase (CMP-forming) (167-177)
ALDPLADKILI

SEQ ID NO: 10834 - protein, 9 aa, Artificial Sequence
  Splicing regulatory glutamine/lysine-rich protein 1 (152-160)
ALDPNIATL

SEQ ID NO: 10835 - protein, 9 aa, Artificial Sequence
  ATP-binding cassette sub-family A member 7 (273-281)
ALDSHPLSR

SEQ ID NO: 10836 - protein, 9 aa, Artificial Sequence
  Ras-related protein Rab-11A (155-163)
ALDSTNVEA

SEQ ID NO: 10837 - protein, 9 aa, Artificial Sequence
  AT-rich interactive domain-containing protein 1B (1641-1649)
ALDTINILL

SEQ ID NO: 10838 - protein, 10 aa, Artificial Sequence
  SWI/SNF-related matrix-associated actin-dependent regulator of chromatin subfamily A member 5 (920-929)
ALDTKIGRYK

SEQ ID NO: 10839 - protein, 9 aa, Artificial Sequence
  Glutamate carboxypeptidase 2 (718-726)
ALFDIESKV

SEQ ID NO: 10840 - protein, 11 aa, Artificial Sequence
  Sodium/potassium-transporting ATPase subunit beta-3 (132-142)
ALFEQKGPVYV

SEQ ID NO: 10841 - protein, 10 aa, Artificial Sequence
  RING finger protein 214 (467-476)
ALFPAPLAQI

SEQ ID NO: 10842 - protein, 9 aa, Artificial Sequence
  Protein disulfide-isomerase A3 (7-15)
ALFPGVALL

SEQ ID NO: 10843 - protein, 11 aa, Artificial Sequence
  Exportin-2 (684-694)
ALFPHLLQPVL

SEQ ID NO: 10844 - protein, 9 aa, Artificial Sequence
  Zinc finger BED domain-containing protein 1 (596-604)
ALFPLLPKV

SEQ ID NO: 10845 - protein, 9 aa, Artificial Sequence
  UDP-glucuronosyltransferase 1-10 (322-330)
ALGKIPQTV

SEQ ID NO: 10846 - protein, 10 aa, Artificial Sequence
  Developmentally-regulated GTP-binding protein 2 (66-75)
ALIGFPSVGK

SEQ ID NO: 10847 - protein, 9 aa, Artificial Sequence
  Transcription factor Maf (116-124)
ALISNSHQL

SEQ ID NO: 10848 - protein, 8 aa, Artificial Sequence
  U3 small nucleolar ribonucleoprotein protein IMP3 (78-85)
ALLDKLYA

SEQ ID NO: 10849 - protein, 9 aa, Artificial Sequence
  microtubule-actin cross-linking factor 1 isoform X2  (1652-1660)
ALLDWVTSV

SEQ ID NO: 10850 - protein, 11 aa, Artificial Sequence
  Coatomer subunit zeta-1 (90-100)
ALLENMEGLFL

SEQ ID NO: 10851 - protein, 10 aa, Artificial Sequence
  Serine/threonine-protein kinase 35 (192-201)
ALLENPKMEL

SEQ ID NO: 10852 - protein, 9 aa, Artificial Sequence
  GRIP and coiled-coil domain-containing protein 2 (277-285)
ALLETVNRL

SEQ ID NO: 10853 - protein, 9 aa, Artificial Sequence
  Progestin and adipoQ receptor family member 4 (146-154)
ALLGGLVNV

SEQ ID NO: 10854 - protein, 11 aa, Artificial Sequence
  Elongation of very long chain fatty acids protein 5 (14-24)
ALLGPRDTRVK

SEQ ID NO: 10855 - protein, 9 aa, Artificial Sequence
  Minor histocompatibility antigen H13 (43-51)
ALLPIFFGA

SEQ ID NO: 10856 - protein, 9 aa, Artificial Sequence
  Transcription factor IIIB 90 kDa subunit (582-590)
ALLPSSPTL

SEQ ID NO: 10857 - protein, 9 aa, Artificial Sequence
  TAF6-like RNA polymerase II p300/CBP-associated factor-associated factor 65 kDa subunit 6L (191-199)
ALLPYFVYV

SEQ ID NO: 10858 - protein, 9 aa, Artificial Sequence
  Plectin (403-411)
ALLQSDVRL

SEQ ID NO: 10859 - protein, 9 aa, Artificial Sequence
  RNA-binding protein Raly (187-195)
ALLSRLEQI

SEQ ID NO: 10860 - protein, 9 aa, Artificial Sequence
  Serine/threonine-protein phosphatase 6 regulatory ankyrin repeat subunit B (148-156)
ALNGHVEMV

SEQ ID NO: 10861 - protein, 9 aa, Artificial Sequence
  Ankyrin repeat domain-containing protein 27 (605-613)
ALNSKILSV

SEQ ID NO: 10862 - protein, 9 aa, Artificial Sequence
  Zinc finger protein 148 (107-115)
ALNVPISVK

SEQ ID NO: 10863 - protein, 9 aa, Artificial Sequence
  Putative eukaryotic translation initiation factor 2 subunit 3-like protein (363-371)
ALPEIFTEL

SEQ ID NO: 10864 - protein, 9 aa, Artificial Sequence
  La-related protein 1 (131-139)
ALPPVLTTV

SEQ ID NO: 10865 - protein, 9 aa, Artificial Sequence
  Importin subunit alpha-5 (339-347)
ALQSLLHLL

SEQ ID NO: 10866 - protein, 9 aa, Artificial Sequence
  Nuclear receptor-interacting protein 1 (745-753)
ALSEQILMV

SEQ ID NO: 10867 - protein, 9 aa, Artificial Sequence
  Glutamate-rich WD repeat-containing protein 1 (434-442)
ALSGFTIFR

SEQ ID NO: 10868 - protein, 9 aa, Artificial Sequence
  Fidgetin-like protein 1 (268-276)
ALSNPILNK

SEQ ID NO: 10869 - protein, 9 aa, Artificial Sequence
  TBC domain-containing protein kinase-like protein (116-124)
ALSPHNILL

SEQ ID NO: 10870 - protein, 9 aa, Artificial Sequence
  Enhancer of mRNA-decapping protein 4 (739-747)
ALSQDIPEI

SEQ ID NO: 10871 - protein, 9 aa, Artificial Sequence
  Quinone oxidoreductase-like protein 1 (41-49)
ALSQINTKL

SEQ ID NO: 10872 - protein, 9 aa, Artificial Sequence
  Prelamin-A/C (147-155)
ALSTALSEK

SEQ ID NO: 10873 - protein, 9 aa, Artificial Sequence
  Cyclin-dependent kinase 4 (96-104)
ALTPVVVTL

SEQ ID NO: 10874 - protein, 9 aa, Artificial Sequence
  Transcription initiation factor TFIID subunit 2 (948-956)
ALVDQLWKL

SEQ ID NO: 10875 - protein, 9 aa, Artificial Sequence
  Beta-hexosaminidase subunit beta (22-30)
ALVVQVAEA

SEQ ID NO: 10876 - protein, 9 aa, Artificial Sequence
  Nesprin-2 (1646-1654)
ALWDKLFNL

SEQ ID NO: 10877 - protein, 11 aa, Artificial Sequence
  Transmembrane protein 234 (16-26)
ALWGGTQPLLK

SEQ ID NO: 10878 - protein, 9 aa, Artificial Sequence
  28S ribosomal protein S29, mitochondrial (267-275)
ALWGRTTLK

SEQ ID NO: 10879 - protein, 9 aa, Artificial Sequence
  Lamin-B receptor (434-442)
ALWNEEALL

SEQ ID NO: 10880 - protein, 9 aa, Artificial Sequence
  CAS1 domain-containing protein 1 (533-541)
ALWPQIIQK

SEQ ID NO: 10881 - protein, 11 aa, Artificial Sequence
  Tetratricopeptide repeat protein 14 (349-359)
ALYATKGSLNK

SEQ ID NO: 10882 - protein, 9 aa, Artificial Sequence
  Ubiquitin carboxyl-terminal hydrolase 4 (552-560)
ALYGQPLLL

SEQ ID NO: 10883 - protein, 9 aa, Artificial Sequence
  Tyrosine-protein kinase Fyn (383-391)
ALYGRFTIK

SEQ ID NO: 10884 - protein, 9 aa, Artificial Sequence
  Putative ATP-dependent RNA helicase DHX57 (1220-1228)
ALYPNVVQV

SEQ ID NO: 10885 - protein, 9 aa, Artificial Sequence
  Nuclear pore complex protein Nup155 (411-419)
ALYSKGILL

SEQ ID NO: 10886 - protein, 9 aa, Artificial Sequence
  Heterogeneous nuclear ribonucleoprotein A0 (64-72)
AMAASPHAV

SEQ ID NO: 10887 - protein, 9 aa, Artificial Sequence
  Synemin (1524-1532)
AMFDKKVQL

SEQ ID NO: 10888 - protein, 10 aa, Artificial Sequence
  DNA-dependent protein kinase catalytic subunit (1302-1311)
AMHDIIAAEK

SEQ ID NO: 10889 - protein, 9 aa, Artificial Sequence
  Methionine synthase (186-194)
AMHGVFLYH

SEQ ID NO: 10890 - protein, 9 aa, Artificial Sequence
  Transformation/transcription domain-associated protein (2516-2524)
AMLPSITNV

SEQ ID NO: 10891 - protein, 9 aa, Artificial Sequence
  Heterogeneous nuclear ribonucleoprotein A1 (71-79)
AMNARPHKV

SEQ ID NO: 10892 - protein, 10 aa, Artificial Sequence
  Double-strand-break repair protein rad21 homolog (467-476)
AMPPPPPQGV

SEQ ID NO: 10893 - protein, 11 aa, Artificial Sequence
  Biogenesis of lysosome-related organelles complex 1 subunit 3 (99-109)
APAPAPARSLL

SEQ ID NO: 10894 - protein, 9 aa, Artificial Sequence
  Solute carrier family 23 member 2 (174-182)
APARAILSL

SEQ ID NO: 10895 - protein, 9 aa, Artificial Sequence
  ATP-binding cassette sub-family F member 3 (303-311)
APARASVIL

SEQ ID NO: 10896 - protein, 9 aa, Artificial Sequence
  Syndecan-4 (2-10)
APARLFALL

SEQ ID NO: 10897 - protein, 10 aa, Artificial Sequence
  Ankyrin repeat domain-containing protein 11 (1778-1787)
APARPLSTNL

SEQ ID NO: 10898 - protein, 9 aa, Artificial Sequence
  Solute carrier family 22 member 18 (145-153)
APEERPAAL

SEQ ID NO: 10899 - protein, 9 aa, Artificial Sequence
  Zinc fingers and homeoboxes protein 2 (415-423)
APEPKRPHI

SEQ ID NO: 10900 - protein, 10 aa, Artificial Sequence
  Hepatoma-derived growth factor (231-240)
APGIRDHESL

SEQ ID NO: 10901 - protein, 10 aa, Artificial Sequence
  Heterogeneous nuclear ribonucleoprotein M (460-469)
APIDRVGQTI

SEQ ID NO: 10902 - protein, 10 aa, Artificial Sequence
  Gamma-interferon-inducible protein 16 (685-694)
APKSGNTGEL

SEQ ID NO: 10903 - protein, 10 aa, Artificial Sequence
  Cancer/testis antigen 2 (114-123)
APLPRPGAVL

SEQ ID NO: 10904 - protein, 8 aa, Artificial Sequence
  Talin-1 (1328-1335)
APNLKSQL

SEQ ID NO: 10905 - protein, 10 aa, Artificial Sequence
  REST corepressor 1 (61-70)
APNNGQNKSL

SEQ ID NO: 10906 - protein, 9 aa, Artificial Sequence
  Histone deacetylase 6 (706-714)
APQPAKPRL

SEQ ID NO: 10907 - protein, 9 aa, Artificial Sequence
  BAG family molecular chaperone regulator 3 (130-138)
APQRSQSPL

SEQ ID NO: 10908 - protein, 9 aa, Artificial Sequence
  Conserved oligomeric Golgi complex subunit 7 (287-295)
APRAALTRL

SEQ ID NO: 10909 - protein, 11 aa, Artificial Sequence
  Protein PRRC2B (1519-1529)
APRAGEQGEAM

SEQ ID NO: 10910 - protein, 11 aa, Artificial Sequence
  Striatin-4 (219-229)
APRAPPGPAGL

SEQ ID NO: 10911 - protein, 11 aa, Artificial Sequence
  Tricarboxylate transport protein, mitochondrial (3-13)
APRAPRALAAA

SEQ ID NO: 10912 - protein, 9 aa, Artificial Sequence
  Actin, gamma-enteric smooth muscle (27-35)
APRAVFPSI

SEQ ID NO: 10913 - protein, 9 aa, Artificial Sequence
  General transcription factor IIF subunit 2 (77-85)
APREHPFVL

SEQ ID NO: 10914 - protein, 11 aa, Artificial Sequence
  Proteasome subunit beta type-8 (9-19)
APRGQRPESAL

SEQ ID NO: 10915 - protein, 10 aa, Artificial Sequence
  40S ribosomal protein S2 (198-207)
APRGTGIVSA

SEQ ID NO: 10916 - protein, 10 aa, Artificial Sequence
  General transcription factor 3C polypeptide 2 (702-711)
APRKGTVWSL

SEQ ID NO: 10917 - protein, 9 aa, Artificial Sequence
  Coiled-coil domain-containing protein 12 (108-116)
APRKPDWDL

SEQ ID NO: 10918 - protein, 9 aa, Artificial Sequence
  RNA demethylase ALKBH5 (289-297)
APRLETKSL

SEQ ID NO: 10919 - protein, 11 aa, Artificial Sequence
  Phosphatidylinositide phosphatase SAC2 (898-908)
APRLGSRSQSL

SEQ ID NO: 10920 - protein, 9 aa, Artificial Sequence
  Structural maintenance of chromosomes protein 4 (79-87)
APRLMITHI

SEQ ID NO: 10921 - protein, 9 aa, Artificial Sequence
  IST1 homolog (107-115)
APRLQSEVA

SEQ ID NO: 10922 - protein, 11 aa, Artificial Sequence
  IST1 homolog (107-117)
APRLQSEVAEL

SEQ ID NO: 10923 - protein, 12 aa, Artificial Sequence
  60S ribosomal protein L13 (47-58)
APRPASGPIRPI

SEQ ID NO: 10924 - protein, 11 aa, Artificial Sequence
  Cold shock domain-containing protein E1 (762-772)
APRPDRLVNRL

SEQ ID NO: 10925 - protein, 11 aa, Artificial Sequence
  tRNA-splicing endonuclease subunit Sen34 (71-81)
APRPDSRHHSL

SEQ ID NO: 10926 - protein, 9 aa, Artificial Sequence
  WAS/WASL-interacting protein family member 2 (122-130)
APRPPVSAA

SEQ ID NO: 10927 - protein, 9 aa, Artificial Sequence
  Rab GTPase-activating protein 1 (88-96)
APRSEVEAL

SEQ ID NO: 10928 - protein, 11 aa, Artificial Sequence
  HLA class II histocompatibility antigen, DP beta 1 chain (9-19)
APRTVALTALL

SEQ ID NO: 10929 - protein, 11 aa, Artificial Sequence
  Protocadherin gamma-C3 (257-267)
APSGTRVVQVL

SEQ ID NO: 10930 - protein, 10 aa, Artificial Sequence
  Rho GTPase-activating protein 7 (785-794)
APSLFHLNTL

SEQ ID NO: 10931 - protein, 11 aa, Artificial Sequence
  Round spermatid basic protein 1-like protein (94-104)
APSPSSSRSSF

SEQ ID NO: 10932 - protein, 9 aa, Artificial Sequence
  intercellular adhesion molecule-1
APSSPRPAL

SEQ ID NO: 10933 - protein, 10 aa, Artificial Sequence
  intercellular adhesion molecule-1
APSSPRPALP

SEQ ID NO: 10934 - protein, 8 aa, Artificial Sequence
  Unconventional myosin-Ic (176-183)
APVGGHIL

SEQ ID NO: 10935 - protein, 9 aa, Artificial Sequence
  Alpha-mannosidase 2C1 (660-668)
APVPPPTSL

SEQ ID NO: 10936 - protein, 9 aa, Artificial Sequence
  Transcription factor p65 (247-255)
APVRVSMQL

SEQ ID NO: 10937 - protein, 9 aa, Artificial Sequence
  Serine protease 23 (107-115)
APWKPTWPA

SEQ ID NO: 10938 - protein, 9 aa, Artificial Sequence
  Splicing factor, arginine/serine-rich 15 (410-418)
AQNEPLTQK

SEQ ID NO: 10939 - protein, 10 aa, Artificial Sequence
  GTP-binding nuclear protein Ran (215-224)
AQYEHDLEVA

SEQ ID NO: 10940 - protein, 9 aa, Artificial Sequence
  Neuropathy target esterase (279-287)
ARDSTVLRL

SEQ ID NO: 10941 - protein, 9 aa, Artificial Sequence
  Tubulin epsilon chain (273-281)
ARFEGSLNM

SEQ ID NO: 10942 - protein, 9 aa, Artificial Sequence
  Splicing factor 3A subunit 1 (306-314)
ARILIQERY

SEQ ID NO: 10943 - protein, 9 aa, Artificial Sequence
  Dedicator of cytokinesis protein 7 (251-259)
ARVKMQVTM

SEQ ID NO: 10944 - protein, 9 aa, Artificial Sequence
  MICOS complex subunit MIC13 (3-11)
ARVWSLMRF

SEQ ID NO: 10945 - protein, 9 aa, Artificial Sequence
  Endonuclease domain-containing 1 protein (4-12)
ARWLALGSL

SEQ ID NO: 10946 - protein, 9 aa, Artificial Sequence
  Sodium-dependent phosphate transport protein 4 (18-26)
ARYGIALVL

SEQ ID NO: 10947 - protein, 11 aa, Artificial Sequence
  Deubiquitinating protein VCIP135 (28-38)
ASAAASGGLLK

SEQ ID NO: 10948 - protein, 9 aa, Artificial Sequence
  Kinase D-interacting substrate of 220 kDa (763-771)
ASDPHIIIK

SEQ ID NO: 10949 - protein, 10 aa, Artificial Sequence
  Multivesicular body subunit 12A (40-49)
ASFGKSFAQK

SEQ ID NO: 10950 - protein, 11 aa, Artificial Sequence
  Myosin-9 (366-376)
ASMPDNTAAQK

SEQ ID NO: 10951 - protein, 9 aa, Artificial Sequence
  Pro-interleukin-16 (1150-1158)
ASQEGTIQK

SEQ ID NO: 10952 - protein, 9 aa, Artificial Sequence
  Cullin-4B (91-99)
ASSHVPIQK

SEQ ID NO: 10953 - protein, 11 aa, Artificial Sequence
  Vimentin (54-64)
ASSPGGVYATR

SEQ ID NO: 10954 - protein, 9 aa, Artificial Sequence
  Heterogeneous nuclear ribonucleoprotein D-like (81-89)
ASVDKVLEL

SEQ ID NO: 10955 - protein, 9 aa, Artificial Sequence
  Gamma-adducin (236-244)
ATAAVSSMK

SEQ ID NO: 10956 - protein, 10 aa, Artificial Sequence
  Clathrin heavy chain 1 (311-320)
ATAGIIGVNR

SEQ ID NO: 10957 - protein, 9 aa, Artificial Sequence
  WD repeat-containing protein 44 (93-101)
ATASPIVAR

SEQ ID NO: 10958 - protein, 9 aa, Artificial Sequence
  Nucleotide exchange factor SIL1 (214-222)
ATEQPLTAK

SEQ ID NO: 10959 - protein, 9 aa, Artificial Sequence
  Ankyrin repeat and KH domain-containing protein 1 (1541-1549)
ATFTNVFGK

SEQ ID NO: 10960 - protein, 10 aa, Artificial Sequence
  Protein artemis (555-564)
ATGESIAVKK

SEQ ID NO: 10961 - protein, 10 aa, Artificial Sequence
  Guanine nucleotide-binding protein G(I)/G(S)/G(T) subunit beta-1 (228-237)
ATGSWDSFLK

SEQ ID NO: 10962 - protein, 9 aa, Artificial Sequence
  Serine/threonine-protein kinase mTOR (800-808)
ATIGELAQV

SEQ ID NO: 10963 - protein, 11 aa, Artificial Sequence
  Interferon regulatory factor 2-binding protein-like (88-98)
ATILAGDVKVK

SEQ ID NO: 10964 - protein, 9 aa, Artificial Sequence
  Protein FAM76B (209-217)
ATIQNETPK

SEQ ID NO: 10965 - protein, 11 aa, Artificial Sequence
  Paired amphipathic helix protein Sin3a (628-638)
ATIRVLEAIQK

SEQ ID NO: 10966 - protein, 12 aa, Artificial Sequence
  T-complex protein 1 subunit eta (44-55)
ATISNDGATILK

SEQ ID NO: 10967 - protein, 9 aa, Artificial Sequence
  Hexokinase-1 (356-364)
ATLGAILNR

SEQ ID NO: 10968 - protein, 9 aa, Artificial Sequence
  Nuclear mitotic apparatus protein 1 (150-158)
ATLQEALAH

SEQ ID NO: 10969 - protein, 9 aa, Artificial Sequence
  Cytoplasmic dynein 1 heavy chain 1 (3080-3088)
ATSPALFNR

SEQ ID NO: 10970 - protein, 10 aa, Artificial Sequence
  Isoaspartyl peptidase/L-asparaginase (183-192)
ATSTGGIVNK

SEQ ID NO: 10971 - protein, 9 aa, Artificial Sequence
  Ankyrin repeat domain-containing protein 17 (653-661)
ATTLPIRNK

SEQ ID NO: 10972 - protein, 11 aa, Artificial Sequence
  Alsin (409-419)
ATYEAGALSLK

SEQ ID NO: 10973 - protein, 10 aa, Artificial Sequence
  Chromobox protein homolog 2 (418-427)
AVAPPTPASK

SEQ ID NO: 10974 - protein, 12 aa, Artificial Sequence
  Guanine nucleotide-binding protein G(I)/G(S)/G(T) subunit beta-2 (326-337)
AVATGSWDSFLK

SEQ ID NO: 10975 - protein, 10 aa, Artificial Sequence
  Cilia- and flagella-associated protein 97 (505-514)
AVDPSSGHPR

SEQ ID NO: 10976 - protein, 12 aa, Artificial Sequence
  Heme-binding protein 1 (85-96)
AVFPNEDGSLQK

SEQ ID NO: 10977 - protein, 9 aa, Artificial Sequence
  SCY1-like protein 2 (22-30)
AVMGNPVTR

SEQ ID NO: 10978 - protein, 9 aa, Artificial Sequence
  PH domain leucine-rich repeat-containing protein phosphatase 1 (285-293)
AVRNVPDAL

SEQ ID NO: 10979 - protein, 11 aa, Artificial Sequence
  Histone H2B type 1-A (112-122)
AVSEGTKAVTK

SEQ ID NO: 10980 - protein, 9 aa, Artificial Sequence
  E3 ubiquitin-protein ligase RNF123 (619-627)
AVTGILVQL

SEQ ID NO: 10981 - protein, 9 aa, Artificial Sequence
  Transcription termination factor 1 (809-817)
AVYVPFWQK

SEQ ID NO: 10982 - protein, 9 aa, Artificial Sequence
  Tyrosine-protein kinase Fyn (324-332)
AYIERMNYI

SEQ ID NO: 10983 - protein, 9 aa, Artificial Sequence
  COP9 signalosome complex subunit 4 (165-173)
AYINRASLL

SEQ ID NO: 10984 - protein, 9 aa, Artificial Sequence
  UDP-N-acetylglucosamine-peptide N-acetylglucosaminyltransferase 110 kDa subunit (697-705)
AYMPHTFFI

SEQ ID NO: 10985 - protein, 9 aa, Artificial Sequence
  Translocating chain-associated membrane protein 1 (155-163)
AYPHNLMTF

SEQ ID NO: 10986 - protein, 9 aa, Artificial Sequence
  Dihydropyrimidine dehydrogenase (NADP(+)) (185-193)
AYSAKIALF

SEQ ID NO: 10987 - protein, 9 aa, Artificial Sequence
  Double-stranded RNA-binding protein Staufen homolog 1 (70-78)
DAAAKALRI

SEQ ID NO: 10988 - protein, 8 aa, Artificial Sequence
  Minor histocompatibility antigen H13 (74-81)
DAARFPII

SEQ ID NO: 10989 - protein, 9 aa, Artificial Sequence
  Conserved oligomeric Golgi complex subunit 2 (338-346)
DAFHEKYTI

SEQ ID NO: 10990 - protein, 8 aa, Artificial Sequence
  AP-2 complex subunit mu (30-37)
DAFRVNVI

SEQ ID NO: 10991 - protein, 9 aa, Artificial Sequence
  UDP-N-acetylglucosamine-peptide N-acetylglucosaminyltransferase 110 kDa subunit (430-438)
DAHSNLASI

SEQ ID NO: 10992 - protein, 8 aa, Artificial Sequence
  Neurobeachin-like protein 2 (378-385)
DAIAVHVV

SEQ ID NO: 10993 - protein, 9 aa, Artificial Sequence
  Rho-associated protein kinase 2 (203-211)
DAIHSMGLI

SEQ ID NO: 10994 - protein, 9 aa, Artificial Sequence
  Ubiquitin carboxyl-terminal hydrolase 22 (496-504)
DAIITKASI

SEQ ID NO: 10995 - protein, 9 aa, Artificial Sequence
  NF-kappa-B essential modulator (63-71)
DAIRQSNQI

SEQ ID NO: 10996 - protein, 8 aa, Artificial Sequence
  Uncharacterized protein C1orf43 (108-115)
DAIRTSEI

SEQ ID NO: 10997 - protein, 9 aa, Artificial Sequence
  Enhancer of filamentation 1 (541-549)
DAKQLTTTI

SEQ ID NO: 10998 - protein, 9 aa, Artificial Sequence
  Endoplasmin (89-97)
DALDKIRLI

SEQ ID NO: 10999 - protein, 9 aa, Artificial Sequence
  60S ribosomal protein L23a (145-153)
DALDVANKI

SEQ ID NO: 11000 - protein, 9 aa, Artificial Sequence
  Peroxisome proliferator activated receptor interacting complex protein (2369-2377)
DALGKLISI

SEQ ID NO: 11001 - protein, 8 aa, Artificial Sequence
  S-adenosylmethionine synthase isoform type-2 (220-227)
DALKEKVI

SEQ ID NO: 11002 - protein, 9 aa, Artificial Sequence
  Microtubule-actin cross-linking factor 1, isoforms 1/2/3/5 (533-541)
DALKVINKV

SEQ ID NO: 11003 - protein, 9 aa, Artificial Sequence
  Bax inhibitor 1 (57-65)
DALLKFSHI

SEQ ID NO: 11004 - protein, 9 aa, Artificial Sequence
  Spectrin beta chain, non-erythrocytic 1 (949-957)
DALLSALSI

SEQ ID NO: 11005 - protein, 8 aa, Artificial Sequence
  Protein FAM179B (198-205)
DALQILHI

SEQ ID NO: 11006 - protein, 8 aa, Artificial Sequence
  Isoleucine-tRNA ligase, cytoplasmic (621-628)
DALRLYLI

SEQ ID NO: 11007 - protein, 9 aa, Artificial Sequence
  Programmed cell death protein 4 (72-80)
DALRSGLTV

SEQ ID NO: 11008 - protein, 9 aa, Artificial Sequence
  Methionine-tRNA ligase, cytoplasmic (281-289)
DALRSILTI

SEQ ID NO: 11009 - protein, 9 aa, Artificial Sequence
  ATP synthase subunit alpha, mitochondrial (164-172)
DAMKYTIVV

SEQ ID NO: 11010 - protein, 9 aa, Artificial Sequence
  Plectin (246-254)
DAMPRVPDV

SEQ ID NO: 11011 - protein, 8 aa, Artificial Sequence
  Cyclic AMP-responsive element-binding protein 1 (144-151)
DAPGVPRI

SEQ ID NO: 11012 - protein, 9 aa, Artificial Sequence
  Putative Polycomb group protein ASXL1 (26-34)
DAPMTPKQI

SEQ ID NO: 11013 - protein, 9 aa, Artificial Sequence
  NEDD4 family-interacting protein 1 (37-45)
DAPPPYSSI

SEQ ID NO: 11014 - protein, 8 aa, Artificial Sequence
  E3 ubiquitin-protein ligase MGRN1 (127-134)
DARVAITI

SEQ ID NO: 11015 - protein, 9 aa, Artificial Sequence
  HLA class I histocompatibility antigen, A-1 alpha chain (115-123)
DAYDGKDYI

SEQ ID NO: 11016 - protein, 8 aa, Artificial Sequence
  Probable ATP-dependent RNA helicase DDX49 (232-239)
DAYLVHLI

SEQ ID NO: 11017 - protein, 9 aa, Artificial Sequence
  Endothelin-converting enzyme 1 (30-38)
DAYPNGLQV

SEQ ID NO: 11018 - protein, 9 aa, Artificial Sequence
  Cohesin subunit SA-2 (683-691)
DAYQVLSTL

SEQ ID NO: 11019 - protein, 9 aa, Artificial Sequence
  Torsin-1A-interacting protein 1 (432-440)
DAYSSFRSV

SEQ ID NO: 11020 - protein, 9 aa, Artificial Sequence
  ATP-binding cassette sub-family E member 1 (434-442)
DAYTHPQFV

SEQ ID NO: 11021 - protein, 9 aa, Artificial Sequence
  Talin-1 (1943-1951)
DAYTKKELI

SEQ ID NO: 11022 - protein, 9 aa, Artificial Sequence
  Gelsolin (93-101)
DAYVILKTV

SEQ ID NO: 11023 - protein, 8 aa, Artificial Sequence
  40S ribosomal protein S26 (60-67)
DAYVLPKL

SEQ ID NO: 11024 - protein, 9 aa, Artificial Sequence
  40S ribosomal protein S26 (60-68)
DAYVLPKLY

SEQ ID NO: 11025 - protein, 9 aa, Artificial Sequence
  Intraflagellar transport protein 25 homolog (124-132)
DHFASVHSV

SEQ ID NO: 11026 - protein, 9 aa, Artificial Sequence
  Vacuolar protein sorting-associated protein 13A (1926-1934)
DHFNAMTSL

SEQ ID NO: 11027 - protein, 9 aa, Artificial Sequence
  Cytoplasmic FMR1-interacting protein 2 (355-363)
DHIRFISEL

SEQ ID NO: 11028 - protein, 9 aa, Artificial Sequence
  Protein zer-1 homolog (237-245)
DHIRVIVQL

SEQ ID NO: 11029 - protein, 9 aa, Artificial Sequence
  Cytoplasmic FMR1-interacting protein 1 (355-363)
DHMRFISEL

SEQ ID NO: 11030 - protein, 10 aa, Artificial Sequence
  60S ribosomal protein L9 (11-20)
DIPENVDITL

SEQ ID NO: 11031 - protein, 9 aa, Artificial Sequence
  5'-3' exoribonuclease 1 (835-843)
DIRAFDSRF

SEQ ID NO: 11032 - protein, 10 aa, Artificial Sequence
  MAX gene-associated protein (126-135)
DISPVDNHRY

SEQ ID NO: 11033 - protein, 10 aa, Artificial Sequence
  Protein MAK16 homolog (177-186)
DIYNFPIHAF

SEQ ID NO: 11034 - protein, 9 aa, Artificial Sequence
  DNA-directed RNA polymerases I, II, and III subunit RPABC5 (54-62)
DLIEKLLNY

SEQ ID NO: 11035 - protein, 9 aa, Artificial Sequence
  TAR DNA-binding protein 43 (128-136)
DLIIKGISV

SEQ ID NO: 11036 - protein, 9 aa, Artificial Sequence
  Arf-GAP with Rho-GAP domain, ANK repeat and PH domain-containing protein 3 (271-279)
DLISPYASF

SEQ ID NO: 11037 - protein, 9 aa, Artificial Sequence
  V-type proton ATPase subunit C 1 (62-70)
DLVTYITRF

SEQ ID NO: 11038 - protein, 9 aa, Artificial Sequence
  Lysine-specific demethylase 5B (44-52)
DPFAFIHKI

SEQ ID NO: 11039 - protein, 9 aa, Artificial Sequence
  116 kDa U5 small nuclear ribonucleoprotein component (910-918)
DPLDKSIVI

SEQ ID NO: 11040 - protein, 9 aa, Artificial Sequence
  Signal recognition particle 9 kDa protein (21-29)
DPMKARVVL

SEQ ID NO: 11041 - protein, 9 aa, Artificial Sequence
  Probable 28S rRNA (cytosine-C(5))-methyltransferase (223-231)
DPPPGSHVI

SEQ ID NO: 11042 - protein, 9 aa, Artificial Sequence
  Protein BTG2 (105-113)
DPYEVSYRI

SEQ ID NO: 11043 - protein, 9 aa, Artificial Sequence
  Small integral membrane protein 15 (18-26)
DPYGFLTTV

SEQ ID NO: 11044 - protein, 9 aa, Artificial Sequence
  Serine/threonine-protein kinase mTOR (895-903)
DPYKHKVNI

SEQ ID NO: 11045 - protein, 8 aa, Artificial Sequence
  Serine/threonine-protein kinase tousled-like 2 (715-722)
DPYLLPHI

SEQ ID NO: 11046 - protein, 8 aa, Artificial Sequence
  AP-3 complex subunit delta-1 isoform 3 (706-713)
DPYRALDI

SEQ ID NO: 11047 - protein, 8 aa, Artificial Sequence
  DnaJ homolog subfamily C member 16 (29-36)
DPYRVLGV

SEQ ID NO: 11048 - protein, 10 aa, Artificial Sequence
  CSC1-like protein 1 (174-183)
DPYSFGRTTI

SEQ ID NO: 11049 - protein, 9 aa, Artificial Sequence
  Nuclear pore membraneoprotein 210 (430-438)
DQDGGVHIL

SEQ ID NO: 11050 - protein, 9 aa, Artificial Sequence
  Ubiquitin carboxyl-terminal hydrolase 7 (365-373)
DRFEFPEQL

SEQ ID NO: 11051 - protein, 10 aa, Artificial Sequence
  39S ribosomal protein L38, mitochondrial (371-380)
DSHEPTYGIY

SEQ ID NO: 11052 - protein, 10 aa, Artificial Sequence
  Golgin subfamily A member 2 (517-526)
DTIGEYIALY

SEQ ID NO: 11053 - protein, 10 aa, Artificial Sequence
  N-alpha-acetyltransferase 25, NatB auxiliary subunit (540-549)
DTIGYLLTRY

SEQ ID NO: 11054 - protein, 9 aa, Artificial Sequence
  E3 ubiquitin-protein ligase RNF213 (545-553)
DTINLNSFF

SEQ ID NO: 11055 - protein, 9 aa, Artificial Sequence
  Gamma-interferon-inducible protein 16 (447-455)
DTISKMNDF

SEQ ID NO: 11056 - protein, 9 aa, Artificial Sequence
  ADP-ribosylation factor-like protein 2 (42-50)
DTISPTLGF

SEQ ID NO: 11057 - protein, 9 aa, Artificial Sequence
  Protein Asterix (74-82)
DTKQMMSSF

SEQ ID NO: 11058 - protein, 9 aa, Artificial Sequence
  Long-chain-fatty-acid-CoA ligase 3 (86-94)
DTLDKVFTY

SEQ ID NO: 11059 - protein, 11 aa, Artificial Sequence
  Heterogeneous nuclear ribonucleoprotein A3 (178-188)
DTVDKIVVQKY

SEQ ID NO: 11060 - protein, 9 aa, Artificial Sequence
  Protein SDE2 homolog (60-68)
DTVQHGAVY

SEQ ID NO: 11061 - protein, 11 aa, Artificial Sequence
  Heterogeneous nuclear ribonucleoprotein A0 (108-118)
DVAEGDLIEHF

SEQ ID NO: 11062 - protein, 11 aa, Artificial Sequence
  Small ubiquitin-related modifier 2 isoform b precursor (61-71)
DVFQQQTGGVY

SEQ ID NO: 11063 - protein, 10 aa, Artificial Sequence
  Dapper homolog 1 (245-254)
DVIADVNPKY

SEQ ID NO: 11064 - protein, 11 aa, Artificial Sequence
  Transmembrane protein 64 (301-311)
DVIAEQSVSGY

SEQ ID NO: 11065 - protein, 10 aa, Artificial Sequence
  60S acidic ribosomal protein P2 (53-62)
DVIAQGIGKL

SEQ ID NO: 11066 - protein, 9 aa, Artificial Sequence
  Transcription factor EB (253-261)
DVIDNIMRL

SEQ ID NO: 11067 - protein, 9 aa, Artificial Sequence
  Nipped-B-like protein (1331-1339)
DVIERVIQY

SEQ ID NO: 11068 - protein, 9 aa, Artificial Sequence
  Magnesium transporter NIPA2 (278-286)
DVIGTLSGF

SEQ ID NO: 11069 - protein, 9 aa, Artificial Sequence
  DnaJ homolog subfamily C member 8 (26-34)
DVIQAGKEY

SEQ ID NO: 11070 - protein, 9 aa, Artificial Sequence
  Mitochondrial import receptor subunit TOM5 homolog (23-31)
DVISSIRNF

SEQ ID NO: 11071 - protein, 9 aa, Artificial Sequence
  Membrane-bound transcription factor site-2 protease (264-272)
DVKDLIGFF

SEQ ID NO: 11072 - protein, 9 aa, Artificial Sequence
  E3 ubiquitin-protein ligase RNF213 (4145-4153)
DVKDYIQEY

SEQ ID NO: 11073 - protein, 11 aa, Artificial Sequence
  Pre-mRNA-processing-splicing factor 8 (1650-1660)
DVMDSTTTQKY

SEQ ID NO: 11074 - protein, 9 aa, Artificial Sequence
  Coiled-coil domain-containing protein 134 (67-75)
DVMLKGLFK

SEQ ID NO: 11075 - protein, 10 aa, Artificial Sequence
  Dipeptidyl peptidase 9 (772-781)
DVPENNQHGY

SEQ ID NO: 11076 - protein, 9 aa, Artificial Sequence
  Vimentin (271-279)
DVRQQYESV

SEQ ID NO: 11077 - protein, 9 aa, Artificial Sequence
  Src substrate cortactin (289-297)
DVTQVSSAY

SEQ ID NO: 11078 - protein, 9 aa, Artificial Sequence
  Kynurenine 3-monooxygenase (252-260)
DVVDFFQKY

SEQ ID NO: 11079 - protein, 11 aa, Artificial Sequence
  Vigilin (521-531)
DVVDSEALQVY

SEQ ID NO: 11080 - protein, 9 aa, Artificial Sequence
  Clathrin heavy chain 1 (271-279)
DVVFLITKY

SEQ ID NO: 11081 - protein, 9 aa, Artificial Sequence
  Peptidyl-prolyl cis-trans isomerase F, mitochondrial (179-187)
DVVKKIESF

SEQ ID NO: 11082 - protein, 9 aa, Artificial Sequence
  GH3 domain-containing protein (366-374)
DVVRVVGAY

SEQ ID NO: 11083 - protein, 10 aa, Artificial Sequence
  MAP kinase-activated protein kinase 2 (122-131)
DVYENLYAGR

SEQ ID NO: 11084 - protein, 10 aa, Artificial Sequence
  AF4/FMR2 family member 1 (32-41)
EAFPEKIPLF

SEQ ID NO: 11085 - protein, 9 aa, Artificial Sequence
  Protein SHQ1 homolog (207-215)
EAIEQILKY

SEQ ID NO: 11086 - protein, 9 aa, Artificial Sequence
  Condensin complex subunit 1 (636-644)
EAIGIISKM

SEQ ID NO: 11087 - protein, 9 aa, Artificial Sequence
  Protein transport protein Sec16A (1405-1413)
EAIQRTEAY

SEQ ID NO: 11088 - protein, 9 aa, Artificial Sequence
  Trafficking protein particle complex subunit 9 (320-328)
EAISYYSKY

SEQ ID NO: 11089 - protein, 8 aa, Artificial Sequence
  Heat shock cognate 71 kDa protein (88-95)
EAYLGKTV

SEQ ID NO: 11090 - protein, 9 aa, Artificial Sequence
  Calcineurin B homologous protein 1 (15-23)
EEIKKETGF

SEQ ID NO: 11091 - protein, 9 aa, Artificial Sequence
  Protein diaphanous homolog 1 (941-949)
EELRKSESF

SEQ ID NO: 11092 - protein, 9 aa, Artificial Sequence
  Plectin (1635-1643)
EEVAQQKSL

SEQ ID NO: 11093 - protein, 9 aa, Artificial Sequence
  Poly(ADP-ribose)ohydrolase ARH3 (12-20)
EGLARPLPL

SEQ ID NO: 11094 - protein, 9 aa, Artificial Sequence
  Mitochondrial enolase superfamily member 1 (393-401)
EHFKYPVMI

SEQ ID NO: 11095 - protein, 9 aa, Artificial Sequence
  TERF1-interacting nuclear factor 2 (29-37)
EHFPRVLEF

SEQ ID NO: 11096 - protein, 11 aa, Artificial Sequence
  Basigin (50-60)
EHINEGETAML

SEQ ID NO: 11097 - protein, 9 aa, Artificial Sequence
  Prefoldin subunit 2 (53-61)
EHSLVIDTL

SEQ ID NO: 11098 - protein, 9 aa, Artificial Sequence
  Regulator of microtubule dynamics protein 3 (350-358)
EHVDKAIAL

SEQ ID NO: 11099 - protein, 9 aa, Artificial Sequence
  E3 ubiquitin-protein ligase MARCH6 (288-296)
EHVFWVVSL

SEQ ID NO: 11100 - protein, 9 aa, Artificial Sequence
  Early endosome antigen 1 (171-179)
EIADIKSKY

SEQ ID NO: 11101 - protein, 9 aa, Artificial Sequence
  Heat shock 70 kDa protein 1B (129-137)
EIAEAYLGY

SEQ ID NO: 11102 - protein, 9 aa, Artificial Sequence
  Pumilio homolog 1 (848-856)
EIAGHIMEF

SEQ ID NO: 11103 - protein, 10 aa, Artificial Sequence
  GMP synthase (glutamine-hydrolyzing) (148-157)
EIFPLETPAF

SEQ ID NO: 11104 - protein, 11 aa, Artificial Sequence
  ATP synthase subunit g, mitochondrial (91-101)
EIIGKRGIIGY

SEQ ID NO: 11105 - protein, 9 aa, Artificial Sequence
  Serine/threonine-protein kinase 4 (69-77)
EIIKEISIM

SEQ ID NO: 11106 - protein, 9 aa, Artificial Sequence
  Protein furry homolog-like (472-480)
EIIKIIGKY

SEQ ID NO: 11107 - protein, 9 aa, Artificial Sequence
  Arf-GAP with SH3 domain, ANK repeat and PH domain-containing protein 2 (422-430)
EIISEVQRM

SEQ ID NO: 11108 - protein, 9 aa, Artificial Sequence
  Structural maintenance of chromosomes flexible hinge domain-containing protein 1 (760-768)
EIISHISQH

SEQ ID NO: 11109 - protein, 9 aa, Artificial Sequence
  Vacuolar protein sorting-associated protein 13C (916-924)
EIKEVILEF

SEQ ID NO: 11110 - protein, 9 aa, Artificial Sequence
  Pre-mRNA-processing-splicing factor 8 (2006-2014)
EIRDIILGM

SEQ ID NO: 11111 - protein, 10 aa, Artificial Sequence
  Filamin A (106-115)
EIVEGENHTY

SEQ ID NO: 11112 - protein, 9 aa, Artificial Sequence
  Putative elongation factor 1-alpha-like 3 (169-177)
EIVKEVSTY

SEQ ID NO: 11113 - protein, 10 aa, Artificial Sequence
  Bifunctional 3'-phosphoadenosine 5'-phosphosulfate synthase 1 (555-564)
EIVPFRVAAY

SEQ ID NO: 11114 - protein, 10 aa, Artificial Sequence
  Splicing factor 3B subunit 1 (42-51)
EIYGGSDSRF

SEQ ID NO: 11115 - protein, 9 aa, Artificial Sequence
  Protein SET (73-81)
ELIAKIPNF

SEQ ID NO: 11116 - protein, 9 aa, Artificial Sequence
  Protein CMSS1 (152-160)
ELIRSMTAF

SEQ ID NO: 11117 - protein, 8 aa, Artificial Sequence
  Beta-lactamase-like protein 2 (240-247)
ELVKIIYK

SEQ ID NO: 11118 - protein, 9 aa, Artificial Sequence
  Structural maintenance of chromosomes flexible hinge domain-containing protein 1 (1904-1912)
EQIDLLQQY

SEQ ID NO: 11119 - protein, 11 aa, Artificial Sequence
  Glutamine-fructose-6-phosphate aminotransferase (isomerizing) 1 (443-453)
ETADTLMGLRY

SEQ ID NO: 11120 - protein, 9 aa, Artificial Sequence
  Ezrin (109-117)
ETAVLLGSY

SEQ ID NO: 11121 - protein, 10 aa, Artificial Sequence
  Mediator of RNA polymerase II transcription subunit 13 (1609-1618)
ETFGEAGQKY

SEQ ID NO: 11122 - protein, 11 aa, Artificial Sequence
  A-kinase anchor protein 13 (546-556)
ETFGGFDSHQM

SEQ ID NO: 11123 - protein, 10 aa, Artificial Sequence
  DnaJ homolog subfamily C member 7 (29-38)
ETFKEQGNAY

SEQ ID NO: 11124 - protein, 9 aa, Artificial Sequence
  ERO1-like protein alpha (51-59)
ETIDRFNNY

SEQ ID NO: 11125 - protein, 10 aa, Artificial Sequence
  Protein SLX4IP (47-56)
ETIDSRVQEY

SEQ ID NO: 11126 - protein, 9 aa, Artificial Sequence
  Pre-mRNA-processing-splicing factor 8 (1612-1620)
ETIHPRKSY

SEQ ID NO: 11127 - protein, 9 aa, Artificial Sequence
  Far upstream element-binding protein 1 (396-404)
ETIKSISQQ

SEQ ID NO: 11128 - protein, 9 aa, Artificial Sequence
  Vacuolar protein sorting-associated protein 8 homolog (1056-1064)
ETIQITQKY

SEQ ID NO: 11129 - protein, 9 aa, Artificial Sequence
  RING finger protein 145 (166-174)
ETIVIINKF

SEQ ID NO: 11130 - protein, 10 aa, Artificial Sequence
  RNA polymerase-associated protein CTR9 homolog (376-385)
ETMKILGSLY

SEQ ID NO: 11131 - protein, 10 aa, Artificial Sequence
  Protein phosphatase 1 regulatory subunit 12A (825-834)
ETQTDSISRY

SEQ ID NO: 11132 - protein, 10 aa, Artificial Sequence
  WD repeat-containing protein 11 (1019-1028)
ETSADNQHYY

SEQ ID NO: 11133 - protein, 11 aa, Artificial Sequence
  Heterogeneous nuclear ribonucleoproteins A2/B1 (19-29)
ETTEESLRNYY

SEQ ID NO: 11134 - protein, 11 aa, Artificial Sequence
  Constitutive coactivator of PPAR-gamma-like protein 1 (893-903)
ETVATGPYRAF

SEQ ID NO: 11135 - protein, 10 aa, Artificial Sequence
  Type II inositol 1,4,5-trisphosphate 5-phosphatase (190-199)
ETVGTGIMGR

SEQ ID NO: 11136 - protein, 9 aa, Artificial Sequence
  HLA class II histocompatibility antigen, DR alpha chain (35-43)
ETVWRLEEF

SEQ ID NO: 11137 - protein, 9 aa, Artificial Sequence
  Spectrin alpha chain, non-erythrocytic 1 (648-656)
EVAARMNEV

SEQ ID NO: 11138 - protein, 9 aa, Artificial Sequence
  Heterogeneous nuclear ribonucleoprotein M (10-18)
EVAATEIKM

SEQ ID NO: 11139 - protein, 10 aa, Artificial Sequence
  Transmembrane anterior posterior transformation protein 1 homolog (204-213)
EVADRLFSSF

SEQ ID NO: 11140 - protein, 9 aa, Artificial Sequence
  Tankyrase-2 (792-800)
EVAEYLLQH

SEQ ID NO: 11141 - protein, 9 aa, Artificial Sequence
  Nuclear pore membraneoprotein 210 (776-784)
EVAGHLRTY

SEQ ID NO: 11142 - protein, 10 aa, Artificial Sequence
  Nucleoprotein TPR (1215-1224)
EVAQVESLRY

SEQ ID NO: 11143 - protein, 9 aa, Artificial Sequence
  Glutamyl-tRNA(Gln) amidotransferase subunit A, mitochondrial (334-342)
EVASNMARF

SEQ ID NO: 11144 - protein, 10 aa, Artificial Sequence
  Rho guanine nucleotide exchange factor 1 (666-675)
EVATDHKAFY

SEQ ID NO: 11145 - protein, 10 aa, Artificial Sequence
  Disheveled-associated activator of morphogenesis 1 (1034-1043)
EVFDKDLSKL

SEQ ID NO: 11146 - protein, 10 aa, Artificial Sequence
  Fatty acyl-CoA reductase 1 (146-155)
EVFMHVSTAY

SEQ ID NO: 11147 - protein, 10 aa, Artificial Sequence
  G1/S-specific cyclin-D2 (75-84)
EVFPLAMNYL

SEQ ID NO: 11148 - protein, 10 aa, Artificial Sequence
  Uncharacterized protein ZMYM6NB (45-54)
EVFPLKVFGY

SEQ ID NO: 11149 - protein, 10 aa, Artificial Sequence
  Mitotic spindle assembly checkpoint protein MAD1 (619-628)
EVFQTKIQEF

SEQ ID NO: 11150 - protein, 9 aa, Artificial Sequence
  Zinc finger and BTB domain-containing protein 38 (82-90)
EVFTEILNY

SEQ ID NO: 11151 - protein, 9 aa, Artificial Sequence
  Peroxisomal multifunctional enzyme type 2 (214-222)
EVGAGWIGK

SEQ ID NO: 11152 - protein, 9 aa, Artificial Sequence
  Chromodomain-helicase-DNA-binding protein 1-like (232-240)
EVGDFIQRY

SEQ ID NO: 11153 - protein, 9 aa, Artificial Sequence
  PERQ amino acid-rich with GYF domain-containing protein 2 (1163-1171)
EVHDYIRAY

SEQ ID NO: 11154 - protein, 10 aa, Artificial Sequence
  Centrosomal protein of 55 kDa (275-284)
EVHNLNQLLY

SEQ ID NO: 11155 - protein, 10 aa, Artificial Sequence
  Transcription termination factor 1, mitochondrial (99-108)
EVIASIISRY

SEQ ID NO: 11156 - protein, 9 aa, Artificial Sequence
  Sterol 26-hydroxylase, mitochondrial (180-188)
EVIDDFMTR

SEQ ID NO: 11157 - protein, 9 aa, Artificial Sequence
  Alpha/beta hydrolase domain-containing protein 17C (277-285)
EVIDFSHGL

SEQ ID NO: 11158 - protein, 10 aa, Artificial Sequence
  PHD finger protein 10 (57-66)
EVIDLMIKEY

SEQ ID NO: 11159 - protein, 10 aa, Artificial Sequence
  SNF-related serine/threonine-protein kinase (80-89)
EVIDTQTKLY

SEQ ID NO: 11160 - protein, 9 aa, Artificial Sequence
  Transcription initiation factor TFIID subunit 1-like (1043-1051)
EVIDVVRTM

SEQ ID NO: 11161 - protein, 9 aa, Artificial Sequence
  Shootin-1 (164-172)
EVIEEVNKV

SEQ ID NO: 11162 - protein, 12 aa, Artificial Sequence
  Glucocorticoid receptor (538-549)
EVIEPEVLYAGY

SEQ ID NO: 11163 - protein, 10 aa, Artificial Sequence
  Transformation/transcription domain-associated protein (3103-3112)
EVIESTNLKY

SEQ ID NO: 11164 - protein, 10 aa, Artificial Sequence
  Serine/threonine-protein kinase MARK2 (117-126)
EVIETEKTLY

SEQ ID NO: 11165 - protein, 10 aa, Artificial Sequence
  Histone H2A deubiquitinase MYSM1 (495-504)
EVIGLLGGRY

SEQ ID NO: 11166 - protein, 9 aa, Artificial Sequence
  CD9 antigen (116-124)
EVIKEVQEF

SEQ ID NO: 11167 - protein, 9 aa, Artificial Sequence
  Eukaryotic translation initiation factor 3 subunit L (50-58)
EVIKNFIQY

SEQ ID NO: 11168 - protein, 10 aa, Artificial Sequence
  Calcium signal-modulating cyclophilin ligand (207-216)
EVINRSMDTY

SEQ ID NO: 11169 - protein, 9 aa, Artificial Sequence
  NADH dehydrogenase (ubiquinone) 1 beta subcomplex subunit 6 (115-123)
EVIPPMKEF

SEQ ID NO: 11170 - protein, 9 aa, Artificial Sequence
  Tyrosyl-DNA phosphodiesterase 2 (152-160)
EVIPPYYSY

SEQ ID NO: 11171 - protein, 9 aa, Artificial Sequence
  60 kDa SS-A/Ro ribonucleoprotein (72-80)
EVIQEIKSF

SEQ ID NO: 11172 - protein, 9 aa, Artificial Sequence
  Insulin-degrading enzyme (951-959)
EVIQNMTEF

SEQ ID NO: 11173 - protein, 9 aa, Artificial Sequence
  Cytosolic 5'-nucleotidase 3A (161-169)
EVIRQAGVY

SEQ ID NO: 11174 - protein, 10 aa, Artificial Sequence
  Nucleoprotein TPR (531-540)
EVISQHLVSY

SEQ ID NO: 11175 - protein, 9 aa, Artificial Sequence
  Mediator of RNA polymerase II transcription subunit 26 (33-41)
EVISSLEKY

SEQ ID NO: 11176 - protein, 9 aa, Artificial Sequence
  Bloom syndrome protein (1277-1285)
EVISVLQKY

SEQ ID NO: 11177 - protein, 11 aa, Artificial Sequence
  Ribosomal protein S6 kinase alpha-3 (14-24)
EVKEDIGVGSY

SEQ ID NO: 11178 - protein, 12 aa, Artificial Sequence
  Farnesyl pyrophosphate synthase (40-51)
EVLEYNAIGGKY

SEQ ID NO: 11179 - protein, 11 aa, Artificial Sequence
  Tight junction protein ZO-2 (118-128)
EVMDEFDGRSF

SEQ ID NO: 11180 - protein, 9 aa, Artificial Sequence
  DNA polymerase eta (98-106)
EVMEIMSRF

SEQ ID NO: 11181 - protein, 9 aa, Artificial Sequence
  2',3'-cyclic-nucleotide 3'-phosphodiesterase (369-377)
EVRAIFTGY

SEQ ID NO: 11182 - protein, 10 aa, Artificial Sequence
  Fragile X mental retardation syndrome-related protein 1 (7-16)
EVRGSNGAFY

SEQ ID NO: 11183 - protein, 9 aa, Artificial Sequence
  Glycylpeptide N-tetradecanoyltransferase 1 (60-68)
EVTDFLSFY

SEQ ID NO: 11184 - protein, 9 aa, Artificial Sequence
  A-kinase anchor protein 9 (664-672)
EVTEIISQF

SEQ ID NO: 11185 - protein, 9 aa, Artificial Sequence
  DNA-directed RNA polymerases I, II, and III subunit RPABC1 (155-163)
EVTELLARY

SEQ ID NO: 11186 - protein, 9 aa, Artificial Sequence
  DNA topoisomerase 2-alpha (74-82)
EVTFVPGLY

SEQ ID NO: 11187 - protein, 9 aa, Artificial Sequence
  Volume-regulated anion channel subunit LRRC8D (74-82)
EVTTNIPKM

SEQ ID NO: 11188 - protein, 9 aa, Artificial Sequence
  Vacuolar protein sorting-associated protein 13D (1985-1993)
EVVAFIQHF

SEQ ID NO: 11189 - protein, 9 aa, Artificial Sequence
  Mortality factor 4-like protein 1 (216-224)
EVVAGIKEY

SEQ ID NO: 11190 - protein, 10 aa, Artificial Sequence
  Mortality factor 4-like protein 1 (216-225)
EVVAGIKEYF

SEQ ID NO: 11191 - protein, 9 aa, Artificial Sequence
  Nesprin-2 (1588-1596)
EVVDKINQV

SEQ ID NO: 11192 - protein, 9 aa, Artificial Sequence
  Peptide-N(4)-(N-acetyl-beta-glucosaminyl)asparagine amidase (383-391)
EVVDVTWRY

SEQ ID NO: 11193 - protein, 9 aa, Artificial Sequence
  GA-binding protein subunit beta-1 (118-126)
EVVELLIKY

SEQ ID NO: 11194 - protein, 9 aa, Artificial Sequence
  Glucocorticoid receptor (728-736)
EVVENLLNY

SEQ ID NO: 11195 - protein, 9 aa, Artificial Sequence
  Inverted formin-2 (336-344)
EVVERLLSV

SEQ ID NO: 11196 - protein, 9 aa, Artificial Sequence
  F-box only protein 22 (27-35)
EVVERVLTF

SEQ ID NO: 11197 - protein, 11 aa, Artificial Sequence
  Actin-binding protein IPP (418-428)
EVVGNMAVSRY

SEQ ID NO: 11198 - protein, 10 aa, Artificial Sequence
  26S proteasome non-ATPase regulatory subunit 2 (581-590)
EVVSEPFRSF

SEQ ID NO: 11199 - protein, 10 aa, Artificial Sequence
  Cold shock domain-containing protein E1 (630-639)
EVYPFGIVGM

SEQ ID NO: 11200 - protein, 9 aa, Artificial Sequence
  Zinc finger MIZ domain-containing protein 2 (271-279)
EVYPGQQYL

SEQ ID NO: 11201 - protein, 9 aa, Artificial Sequence
  Uncharacterized protein C18orf8 (437-445)
EYIRSLNQF

SEQ ID NO: 11202 - protein, 9 aa, Artificial Sequence
  Oxysterol-binding protein (17-25)
EYMEHVYLI

SEQ ID NO: 11203 - protein, 9 aa, Artificial Sequence
  Insulin receptor substrate 2 (597-605)
EYTLMRATF

SEQ ID NO: 11204 - protein, 9 aa, Artificial Sequence
  Striatin-interacting protein 2 (594-602)
EYVSQHLVF

SEQ ID NO: 11205 - protein, 9 aa, Artificial Sequence
  Phospholipid hydroperoxide glutathione peroxidase, mitochondrial (119-127)
FAAGYNVKF

SEQ ID NO: 11206 - protein, 8 aa, Artificial Sequence
  Tuftelin-interacting protein 11 (132-139)
FAGGTKSF

SEQ ID NO: 11207 - protein, 11 aa, Artificial Sequence
  Sister chromatid cohesion protein PDS5 homolog A (273-283)
FAIDPHLLLSV

SEQ ID NO: 11208 - protein, 9 aa, Artificial Sequence
  ATP-dependent RNA helicase DDX24 (247-255)
FAIPMIHAV

SEQ ID NO: 11209 - protein, 9 aa, Artificial Sequence
  Clathrin heavy chain 1 (1594-1602)
FAMPYFIQV

SEQ ID NO: 11210 - protein, 9 aa, Artificial Sequence
  Splicing factor, proline- and glutamine-rich (486-494)
FEYEYSQRW

SEQ ID NO: 11211 - protein, 9 aa, Artificial Sequence
  Serine/threonine-protein phosphatase PP1-beta catalytic subunit (226-234)
FGADVVSKF

SEQ ID NO: 11212 - protein, 9 aa, Artificial Sequence
  Chromatin assembly factor 1 subunit B (228-236)
FHDDSMKSF

SEQ ID NO: 11213 - protein, 9 aa, Artificial Sequence
  Endoplasmin (422-430)
FHDMMPKYL

SEQ ID NO: 11214 - protein, 9 aa, Artificial Sequence
  Protein transport protein Sec23B (630-638)
FHGPPEPVL

SEQ ID NO: 11215 - protein, 9 aa, Artificial Sequence
  Coatomer subunit alpha (101-109)
FHHEYPWIL

SEQ ID NO: 11216 - protein, 9 aa, Artificial Sequence
  Putative heat shock protein HSP 90-alpha A5 (3-11)
FHHVGQAGL

SEQ ID NO: 11217 - protein, 9 aa, Artificial Sequence
  Phosphatidylinositol 4,5-bisphosphate 3-kinase catalytic subunit gamma isoform (961-969)
FHIDFGHIL

SEQ ID NO: 11218 - protein, 9 aa, Artificial Sequence
  Fas apoptotic inhibitory molecule 3 (252-260)
FHILIPTIL

SEQ ID NO: 11219 - protein, 9 aa, Artificial Sequence
  Rho GTPase-activating protein 4 (276-284)
FHLALGQVL

SEQ ID NO: 11220 - protein, 10 aa, Artificial Sequence
  Proteasome subunit alpha type-5 (154-163)
FHMDPSGTFV

SEQ ID NO: 11221 - protein, 9 aa, Artificial Sequence
  Anaphase-promoting complex subunit 1 (1137-1145)
FHNGVAAGL

SEQ ID NO: 11222 - protein, 9 aa, Artificial Sequence
  Ubiquitin-conjugating enzyme E2 J1 (237-245)
FHQPTQPVA

SEQ ID NO: 11223 - protein, 9 aa, Artificial Sequence
  Mitotic checkpoint serine/threonine-protein kinase BUB1 (438-446)
FHTTPNTSL

SEQ ID NO: 11224 - protein, 9 aa, Artificial Sequence
  WD repeat-containing protein 47 (348-356)
FHYPGVQNL

SEQ ID NO: 11225 - protein, 10 aa, Artificial Sequence
  Probable ubiquitin carboxyl-terminal hydrolase FAF-X (1466-1475)
FIFPASNVYL

SEQ ID NO: 11226 - protein, 9 aa, Artificial Sequence
  Endoplasmic reticulum aminopeptidase 1 (249-257)
FIISDFESV

SEQ ID NO: 11227 - protein, 9 aa, Artificial Sequence
  Protein kinase C-binding protein 1 (213-221)
FLADAKWIL

SEQ ID NO: 11228 - protein, 9 aa, Artificial Sequence
  Unconventional myosin-Ic (773-781)
FLDHVRTSF

SEQ ID NO: 11229 - protein, 9 aa, Artificial Sequence
  E3 ubiquitin-protein ligase RNF216 (134-142)
FLDLGPPGI

SEQ ID NO: 11230 - protein, 9 aa, Artificial Sequence
  UDP-glucose:glycoprotein glucosyltransferase 2 (97-105)
FLDNLHINL

SEQ ID NO: 11231 - protein, 9 aa, Artificial Sequence
  Proteasome-associated protein ECM29 homolog (801-809)
FLDSTSPLL

SEQ ID NO: 11232 - protein, 9 aa, Artificial Sequence
  Eukaryotic translation initiation factor 3 subunit M (218-226)
FLFDHLLTL

SEQ ID NO: 11233 - protein, 9 aa, Artificial Sequence
  HEAT repeat-containing protein 1 (2003-2011)
FLFDTQHFI

SEQ ID NO: 11234 - protein, 10 aa, Artificial Sequence
  Apolipoprotein L1 (239-248)
FLGENISNFL

SEQ ID NO: 11235 - protein, 9 aa, Artificial Sequence
  WASH complex subunit strumpellin (1046-1054)
FLIAQLPKL

SEQ ID NO: 11236 - protein, 10 aa, Artificial Sequence
  Tensin-1 (1527-1536)
FLIETGPRGV

SEQ ID NO: 11237 - protein, 9 aa, Artificial Sequence
  Plexin-B2 (395-403)
FLINFIHTL

SEQ ID NO: 11238 - protein, 9 aa, Artificial Sequence
  cAMP-specific 3',5'-cyclic phosphodiesterase 4B (382-390)
FLINTNSEL

SEQ ID NO: 11239 - protein, 10 aa, Artificial Sequence
  Serine/threonine-protein kinase 11-interacting protein (316-325)
FLLDGKVLSL

SEQ ID NO: 11240 - protein, 11 aa, Artificial Sequence
  Tyrosine-protein kinase BAZ1B (291-301)
FLLDPYKYMTL

SEQ ID NO: 11241 - protein, 10 aa, Artificial Sequence
  Transmembrane emp24 domain-containing protein 10 (22-31)
FLLGPRLVLA

SEQ ID NO: 11242 - protein, 9 aa, Artificial Sequence
  TBC1 domain family member 13 (329-337)
FLLPDVIRI

SEQ ID NO: 11243 - protein, 10 aa, Artificial Sequence
  Atlastin-3 (263-272)
FLLPHPGLQV

SEQ ID NO: 11244 - protein, 9 aa, Artificial Sequence
  Glycerol-3-phosphate acyltransferase 4 (174-182)
FLLPLRIAL

SEQ ID NO: 11245 - protein, 10 aa, Artificial Sequence
  ATP-dependent RNA helicase DDX24 (582-591)
FLMQYPGRSL

SEQ ID NO: 11246 - protein, 9 aa, Artificial Sequence
  Quinone oxidoreductase-like protein 1 (284-292)
FLNDEVWNL

SEQ ID NO: 11247 - protein, 9 aa, Artificial Sequence
  Spectrin beta chain, non-erythrocytic 1 (1184-1192)
FLNNQEYVL

SEQ ID NO: 11248 - protein, 9 aa, Artificial Sequence
  Bifunctional coenzyme A synthase (125-133)
FLPPLPTSV

SEQ ID NO: 11249 - protein, 9 aa, Artificial Sequence
  RNA-binding protein EWS (550-558)
FLPPPFPPP

SEQ ID NO: 11250 - protein, 9 aa, Artificial Sequence
  Arginyl aminopeptidase-like 1 (87-95)
FLPPSFPIV

SEQ ID NO: 11251 - protein, 10 aa, Artificial Sequence
  Exosome complex component RRP4 (134-143)
FLQEGDLISA

SEQ ID NO: 11252 - protein, 10 aa, Artificial Sequence
  Cirhin (214-223)
FLSDGTIISV

SEQ ID NO: 11253 - protein, 9 aa, Artificial Sequence
  26S proteasome non-ATPase regulatory subunit 1 (260-268)
FLSSVIQNL

SEQ ID NO: 11254 - protein, 9 aa, Artificial Sequence
  Acidic leucine-rich nuclear phosphoprotein 32 family member A (46-54)
FLSTINVGL

SEQ ID NO: 11255 - protein, 10 aa, Artificial Sequence
  Mannosyl-oligosaccharide glucosidase (448-457)
FLWDEGFHQL

SEQ ID NO: 11256 - protein, 9 aa, Artificial Sequence
  rRNA methyltransferase 1, mitochondrial (246-254)
FLWERPTLL

SEQ ID NO: 11257 - protein, 8 aa, Artificial Sequence
  Transmembrane protein 41B (141-148)
FLYPFPLA

SEQ ID NO: 11258 - protein, 9 aa, Artificial Sequence
  tRNA-splicing endonuclease subunit Sen15 (185-193)
FMLPDPQNI

SEQ ID NO: 11259 - protein, 11 aa, Artificial Sequence
  tRNA-splicing endonuclease subunit Sen15 (185-195)
FMLPDPQNISL

SEQ ID NO: 11260 - protein, 9 aa, Artificial Sequence
  Intraflagellar transport protein 172 homolog (435-443)
FMNPHLISV

SEQ ID NO: 11261 - protein, 9 aa, Artificial Sequence
  Ecto-NOX disulfide-thiol exchanger 1 (187-195)
FMVDKAIYL

SEQ ID NO: 11262 - protein, 9 aa, Artificial Sequence
  Integrin alpha-4 (949-957)
FPEPNPRVI

SEQ ID NO: 11263 - protein, 9 aa, Artificial Sequence
  Protein RRP5 homolog (1250-1258)
FPFGKIGTV

SEQ ID NO: 11264 - protein, 9 aa, Artificial Sequence
  Zinc finger protein 662 (74-82)
FPFPKPALI

SEQ ID NO: 11265 - protein, 10 aa, Artificial Sequence
  U2 small nuclear ribonucleoprotein B'' (72-81)
FPFYGKPMRI

SEQ ID NO: 11266 - protein, 9 aa, Artificial Sequence
  Cyclin-dependent kinase 9 (59-67)
FPITALREI

SEQ ID NO: 11267 - protein, 8 aa, Artificial Sequence
  HLA class II histocompatibility antigen, DP alpha 1 chain (123-130)
FPKEPVEL

SEQ ID NO: 11268 - protein, 9 aa, Artificial Sequence
  Poly(A)-specific ribonuclease PARN (273-281)
FPRLLDTKL

SEQ ID NO: 11269 - protein, 9 aa, Artificial Sequence
  Glutamine-fructose-6-phosphate aminotransferase (isomerizing) 2 (671-679)
FPRNLAKSV

SEQ ID NO: 11270 - protein, 9 aa, Artificial Sequence
  AT-rich interactive domain-containing protein 2 (669-677)
FPVQGVHTV

SEQ ID NO: 11271 - protein, 9 aa, Artificial Sequence
  Putative heat shock protein HSP 90-beta 2 (17-25)
FQAEIAQLM

SEQ ID NO: 11272 - protein, 9 aa, Artificial Sequence
  Transcription intermediary factor 1-alpha (890-898)
FQDPVPLTV

SEQ ID NO: 11273 - protein, 9 aa, Artificial Sequence
  Integrin beta-7 (790-798)
FQEADSPTL

SEQ ID NO: 11274 - protein, 9 aa, Artificial Sequence
  Nicotinate phosphoribosyltransferase (342-350)
FQVPWLESV

SEQ ID NO: 11275 - protein, 9 aa, Artificial Sequence
  5-aminolevulinate synthase, nonspecific, mitochondrial (214-222)
FQYDRFFEK

SEQ ID NO: 11276 - protein, 9 aa, Artificial Sequence
  Asparagine synthetase (glutamine-hydrolyzing) (11-19)
FRFENVNGY

SEQ ID NO: 11277 - protein, 10 aa, Artificial Sequence
  Probable ATP-dependent RNA helicase DDX5 (558-567)
FRTGNPTGTY

SEQ ID NO: 11278 - protein, 10 aa, Artificial Sequence
  Protein transport protein Sec31A (398-407)
FSFGGKLVTF

SEQ ID NO: 11279 - protein, 9 aa, Artificial Sequence
  Polymeric immunoglobulin receptor (132-140)
FSVVINQLR

SEQ ID NO: 11280 - protein, 9 aa, Artificial Sequence
  Neutral amino acid transporter B(0) (89-97)
FVFPGELLL

SEQ ID NO: 11281 - protein, 9 aa, Artificial Sequence
  Clathrin heavy chain 1 (783-791)
FVHDLVLYL

SEQ ID NO: 11282 - protein, 9 aa, Artificial Sequence
  Actin-binding protein anillin (958-966)
FVLDKVPFL

SEQ ID NO: 11283 - protein, 8 aa, Artificial Sequence
  Myosin light polypeptide 6 (150-157)
FVRHILSG

SEQ ID NO: 11284 - protein, 11 aa, Artificial Sequence
  Alkyldihydroxyacetonephosphate synthase, peroxisomal (497-507)
GEDNGQRGYLL

SEQ ID NO: 11285 - protein, 9 aa, Artificial Sequence
  Putative deoxyribonuclease TATDN3 (48-56)
GEFEKIMQL

SEQ ID NO: 11286 - protein, 9 aa, Artificial Sequence
  Zinc finger protein 428 (174-182)
GELHGHFML

SEQ ID NO: 11287 - protein, 9 aa, Artificial Sequence
  Patatin-like phospholipase domain-containing protein 2 (124-132)
GENVIISHF

SEQ ID NO: 11288 - protein, 9 aa, Artificial Sequence
  DAZ-associated protein 1 (125-133)
GETELREYF

SEQ ID NO: 11289 - protein, 11 aa, Artificial Sequence
  Nuclear pore complex protein Nup93 (311-321)
GEVEGHPVWAL

SEQ ID NO: 11290 - protein, 9 aa, Artificial Sequence
  Elongation factor 2 (120-128)
GEVSARQEL

SEQ ID NO: 11291 - protein, 9 aa, Artificial Sequence
  WD repeat-containing protein 61 (188-196)
GHAMPIRSL

SEQ ID NO: 11292 - protein, 9 aa, Artificial Sequence
  Elongator complex protein 2 (237-245)
GHFDGVQDL

SEQ ID NO: 11293 - protein, 9 aa, Artificial Sequence
  Neuropathy target esterase (188-196)
GHFEKPLFL

SEQ ID NO: 11294 - protein, 10 aa, Artificial Sequence
  Protein SCAF8 (919-928)
GILGIQPPSV

SEQ ID NO: 11295 - protein, 10 aa, Artificial Sequence
  MKL/myocardin-like protein 2 (440-449)
GLAAGGIVAV

SEQ ID NO: 11296 - protein, 10 aa, Artificial Sequence
  TRPM8 channel-associated factor 2 (73-82)
GLAPFLLNAV

SEQ ID NO: 11297 - protein, 9 aa, Artificial Sequence
  Neurobeachin-like protein 2 (789-797)
GLAPKPVQV

SEQ ID NO: 11298 - protein, 9 aa, Artificial Sequence
  Rapamycin-insensitive companion of mTOR (711-719)
GLARVILSK

SEQ ID NO: 11299 - protein, 11 aa, Artificial Sequence
  Nuclear pore complex protein Nup107 (915-925)
GLDPLGYEIQL

SEQ ID NO: 11300 - protein, 9 aa, Artificial Sequence
  Elongation factor 2 (217-225)
GLHGWAFTL

SEQ ID NO: 11301 - protein, 9 aa, Artificial Sequence
  CCR4-NOT transcription complex subunit 1 (373-381)
GLHNVVYGI

SEQ ID NO: 11302 - protein, 9 aa, Artificial Sequence
  DNA-dependent protein kinase catalytic subunit (2509-2517)
GLIDENPGL

SEQ ID NO: 11303 - protein, 9 aa, Artificial Sequence
  Structural maintenance of chromosomes flexible hinge domain-containing protein 1 (829-837)
GLLDLPFRV

SEQ ID NO: 11304 - protein, 10 aa, Artificial Sequence
  F-box only protein 22 (210-219)
GLLDNPELRV

SEQ ID NO: 11305 - protein, 11 aa, Artificial Sequence
  Nuclear receptor subfamily 2 group C member 2 (238-248)
GLLDPGMLVNI

SEQ ID NO: 11306 - protein, 9 aa, Artificial Sequence
  Protein zer-1 homolog (593-601)
GLLGNVAEV

SEQ ID NO: 11307 - protein, 9 aa, Artificial Sequence
  Protein zyg-11 homolog B (299-307)
GLLNNIAEV

SEQ ID NO: 11308 - protein, 9 aa, Artificial Sequence
  Lysophospholipid acyltransferase 7 (141-149)
GLLPDVPSL

SEQ ID NO: 11309 - protein, 9 aa, Artificial Sequence
  E3 ubiquitin-protein ligase UBR4 (1708-1716)
GLLRIIPYL

SEQ ID NO: 11310 - protein, 9 aa, Artificial Sequence
  Protein ELYS (929-937)
GLMEDLLKL

SEQ ID NO: 11311 - protein, 9 aa, Artificial Sequence
  Exocyst complex component 4 (173-181)
GLSDLRLEL

SEQ ID NO: 11312 - protein, 9 aa, Artificial Sequence
  Nuclear pore complex protein Nup155 (139-147)
GLSETILAV

SEQ ID NO: 11313 - protein, 9 aa, Artificial Sequence
  Leucine-rich repeat and calponin homology domain-containing protein 3 (750-758)
GLSQVAVTV

SEQ ID NO: 11314 - protein, 9 aa, Artificial Sequence
  Glucocorticoid modulatory element-binding protein 1 (503-511)
GLTSAIQAV

SEQ ID NO: 11315 - protein, 10 aa, Artificial Sequence
  Complex I assembly factor TIMMDC1, mitochondrial (187-196)
GLVAGGIIGA

SEQ ID NO: 11316 - protein, 9 aa, Artificial Sequence
  Serine-tRNA ligase, cytoplasmic (31-39)
GLVDQLVKA

SEQ ID NO: 11317 - protein, 9 aa, Artificial Sequence
  KATNB1-like protein 1 (274-282)
GLWEQENHL

SEQ ID NO: 11318 - protein, 9 aa, Artificial Sequence
  Rotatin (1413-1421)
GLWGTVVNI

SEQ ID NO: 11319 - protein, 10 aa, Artificial Sequence
  Melanoma-associated antigen 10 (254-263)
GLYDGMEHLI

SEQ ID NO: 11320 - protein, 9 aa, Artificial Sequence
  tRNA (adenine(58)-N(1))-methyltransferase non-catalytic subunit TRM6 (83-91)
GLYEFPLNK

SEQ ID NO: 11321 - protein, 9 aa, Artificial Sequence
  Putative ATP-dependent RNA helicase DHX30 (983-991)
GLYPNLIQV

SEQ ID NO: 11322 - protein, 10 aa, Artificial Sequence
  Catenin alpha-1 (725-734)
GMASLNLPAV

SEQ ID NO: 11323 - protein, 9 aa, Artificial Sequence
  RNA-binding protein 12 (509-517)
GMLEKIDMI

SEQ ID NO: 11324 - protein, 9 aa, Artificial Sequence
  Probable ATP-dependent RNA helicase YTHDC2 (978-986)
GMYPNLVHV

SEQ ID NO: 11325 - protein, 9 aa, Artificial Sequence
  Heterogeneous nuclear ribonucleoprotein M (480-488)
GPAIERMGL

SEQ ID NO: 11326 - protein, 9 aa, Artificial Sequence
  ETS translocation variant 5 (173-181)
GPAPAPHSL

SEQ ID NO: 11327 - protein, 11 aa, Artificial Sequence
  Filamin-A (852-862)
GPGLSRTGVEL

SEQ ID NO: 11328 - protein, 10 aa, Artificial Sequence
  Splicing factor, proline- and glutamine-rich (215-224)
GPKPGGGPGL

SEQ ID NO: 11329 - protein, 9 aa, Artificial Sequence
  Peptidyl-prolyl cis-trans isomerase-like 2 (134-142)
GPNSNRSQF

SEQ ID NO: 11330 - protein, 10 aa, Artificial Sequence
  RuvB-like 1 (70-79)
GPPGTGKTAL

SEQ ID NO: 11331 - protein, 9 aa, Artificial Sequence
  Transmembrane protein 214 (461-469)
GPRLPWTRL

SEQ ID NO: 11332 - protein, 9 aa, Artificial Sequence
  PHD finger protein 3 (205-213)
GQIEVVPEV

SEQ ID NO: 11333 - protein, 9 aa, Artificial Sequence
  Nucleolar RNA helicase 2 (190-198)
GRAPQVLVL

SEQ ID NO: 11334 - protein, 10 aa, Artificial Sequence
  Ran-binding protein 9 (76-85)
GRDGYMGIGL

SEQ ID NO: 11335 - protein, 9 aa, Artificial Sequence
  COP9 signalosome complex subunit 5 (281-289)
GRGSFMLGL

SEQ ID NO: 11336 - protein, 9 aa, Artificial Sequence
  WD repeat-containing protein 81 (717-725)
GRILLPEGF

SEQ ID NO: 11337 - protein, 10 aa, Artificial Sequence
  Neutral amino acid transporter A (111-120)
GRLGGIAVAY

SEQ ID NO: 11338 - protein, 10 aa, Artificial Sequence
  Spectrin beta chain, non-erythrocytic 1 (822-831)
GRLSGIEERY

SEQ ID NO: 11339 - protein, 11 aa, Artificial Sequence
  ATP-binding cassette sub-family F member 3 (595-605)
GRYGISGELAM

SEQ ID NO: 11340 - protein, 9 aa, Artificial Sequence
  Stathmin 1/oncoprotein 18 (118-126)
GSHFISHLS

SEQ ID NO: 11341 - protein, 9 aa, Artificial Sequence
  AP-5 complex subunit beta-1 (317-325)
GTAQLTLLH

SEQ ID NO: 11342 - protein, 9 aa, Artificial Sequence
  UPF0428 protein CXorf56 (73-81)
GTLIDNQFK

SEQ ID NO: 11343 - protein, 9 aa, Artificial Sequence
  PX domain-containing protein kinase-like protein (149-157)
GTLKDLIYK

SEQ ID NO: 11344 - protein, 9 aa, Artificial Sequence
  Putative inactive carbonic anhydrase 5B-like protein (13-21)
GTLSSWNLK

SEQ ID NO: 11345 - protein, 9 aa, Artificial Sequence
  Small integral membrane protein 4 (34-42)
GTMEWIMIK

SEQ ID NO: 11346 - protein, 9 aa, Artificial Sequence
  Arf-GAP with SH3 domain, ANK repeat and PH domain-containing protein 2 (482-490)
GTSELLLAK

SEQ ID NO: 11347 - protein, 9 aa, Artificial Sequence
  DNA cross-link repair 1A protein (877-885)
GTYSIGKEK

SEQ ID NO: 11348 - protein, 9 aa, Artificial Sequence
  Proteasome subunit beta type-3 (184-192)
GVIVHIIEK

SEQ ID NO: 11349 - protein, 9 aa, Artificial Sequence
  Tensin-1 (71-79)
HAKVLEFGW

SEQ ID NO: 11350 - protein, 9 aa, Artificial Sequence
  Mothers against decapentaplegic homolog 2 (291-299)
HASQPSLTV

SEQ ID NO: 11351 - protein, 9 aa, Artificial Sequence
  TIP41-like protein (203-211)
HEADKTYML

SEQ ID NO: 11352 - protein, 9 aa, Artificial Sequence
  Zinc finger protein 655 (167-175)
HEPEKSFSL

SEQ ID NO: 11353 - protein, 8 aa, Artificial Sequence
  Retinol dehydrogenase 10 (221-228)
HESLSHEL

SEQ ID NO: 11354 - protein, 9 aa, Artificial Sequence
  Hippocampus abundant transcript-like protein 1 (50-58)
HETFSQHTF

SEQ ID NO: 11355 - protein, 9 aa, Artificial Sequence
  N-acetyltransferase 9 (4-12)
HEWMKSEEL

SEQ ID NO: 11356 - protein, 9 aa, Artificial Sequence
  Tubulin beta-4B chain (28-36)
HGIDPTGTY

SEQ ID NO: 11357 - protein, 9 aa, Artificial Sequence
  MOB kinase activator 3A (169-177)
HHFDRIAQM

SEQ ID NO: 11358 - protein, 9 aa, Artificial Sequence
  Fanconi anemia group I protein (98-106)
HHFPGPLLV

SEQ ID NO: 11359 - protein, 9 aa, Artificial Sequence
  Transcriptional repressor protein YY1 (78-86)
HHHPPMIAL

SEQ ID NO: 11360 - protein, 9 aa, Artificial Sequence
  Myotubularin-related protein 6 (51-59)
HHIASVEKL

SEQ ID NO: 11361 - protein, 9 aa, Artificial Sequence
  Kelch-like protein 6 (219-227)
HHILKSDDL

SEQ ID NO: 11362 - protein, 10 aa, Artificial Sequence
  Squalene synthase (268-277)
HHIPDVITYL

SEQ ID NO: 11363 - protein, 8 aa, Artificial Sequence
  N-alpha-acetyltransferase 38, NatC auxiliary subunit (107-114)
HHIVSIEV

SEQ ID NO: 11364 - protein, 10 aa, Artificial Sequence
  Fructose-bisphosphate aldolase A (220-229)
HHIYLEGTLL

SEQ ID NO: 11365 - protein, 9 aa, Artificial Sequence
  Signal recognition particle 54 kDa protein (472-480)
HHMGGMAGL

SEQ ID NO: 11366 - protein, 10 aa, Artificial Sequence
  U1 small nuclear ribonucleoprotein A (155-164)
HHMPGQPPYM

SEQ ID NO: 11367 - protein, 8 aa, Artificial Sequence
  DNA topoisomerase 2-alpha (558-565)
HHNWPSLL

SEQ ID NO: 11368 - protein, 9 aa, Artificial Sequence
  Ubiquitin-associated protein 2-like (890-898)
HHTTQQTFL

SEQ ID NO: 11369 - protein, 10 aa, Artificial Sequence
  Dedicator of cytokinesis protein 2 (573-582)
HHVENKGATL

SEQ ID NO: 11370 - protein, 9 aa, Artificial Sequence
  Oxidative stress-induced growth inhibitor 2 (114-122)
HHYIPHVVL

SEQ ID NO: 11371 - protein, 10 aa, Artificial Sequence
  60S ribosomal protein L30 (72-81)
HHYSGNNIEL

SEQ ID NO: 11372 - protein, 9 aa, Artificial Sequence
  Ribosomal L1 domain-containing protein 1 (227-235)
HIIENIVAV

SEQ ID NO: 11373 - protein, 9 aa, Artificial Sequence
  E3 ubiquitin-protein ligase TRIM11 (224-232)
HLAELIAEL

SEQ ID NO: 11374 - protein, 9 aa, Artificial Sequence
  Probable E3 ubiquitin-protein ligase HERC1 (1903-1911)
HLGDFLVFL

SEQ ID NO: 11375 - protein, 9 aa, Artificial Sequence
  Talin-1 (1711-1719)
HLIEPLANA

SEQ ID NO: 11376 - protein, 9 aa, Artificial Sequence
  Transmembrane protein 41B (196-204)
HLINYIIFL

SEQ ID NO: 11377 - protein, 9 aa, Artificial Sequence
  tRNA-specific adenosine deaminase 1 (169-177)
HLLEEPIYL

SEQ ID NO: 11378 - protein, 9 aa, Artificial Sequence
  Nuclear pore complex protein Nup205 (808-816)
HLLNESPML

SEQ ID NO: 11379 - protein, 10 aa, Artificial Sequence
  Activating transcription factor 7-interacting protein 1 (1036-1045)
HLLPTAPTTV

SEQ ID NO: 11380 - protein, 9 aa, Artificial Sequence
  Ras GTPase-activating-like protein IQGAP1 (1247-1255)
HLSIINEYL

SEQ ID NO: 11381 - protein, 9 aa, Artificial Sequence
  Nucleoprotein TPR (907-915)
HLSNMEVQV

SEQ ID NO: 11382 - protein, 9 aa, Artificial Sequence
  Next to BRCA1 gene 1 protein (330-338)
HLWNSIHGL

SEQ ID NO: 11383 - protein, 11 aa, Artificial Sequence
  E3 ubiquitin-protein ligase HUWE1 (111-121)
HLYSSIEHLTT

SEQ ID NO: 11384 - protein, 9 aa, Artificial Sequence
  Transmembrane protein 248 (135-143)
HLYSTILGH

SEQ ID NO: 11385 - protein, 9 aa, Artificial Sequence
  E3 ubiquitin-protein ligase RNF167 (2-10)
HPAAFPLPV

SEQ ID NO: 11386 - protein, 9 aa, Artificial Sequence
  T-complex protein 1 subunit theta (7-15)
HPAAKMIVM

SEQ ID NO: 11387 - protein, 9 aa, Artificial Sequence
  Ras GTPase-activating protein-binding protein 1 (336-344)
HPDSHQLFI

SEQ ID NO: 11388 - protein, 11 aa, Artificial Sequence
  Sterol regulatory element-binding protein 2 (512-522)
HPHSGSGRSVL

SEQ ID NO: 11389 - protein, 9 aa, Artificial Sequence
  AP-2 complex subunit beta (191-199)
HPNSNLLDL

SEQ ID NO: 11390 - protein, 9 aa, Artificial Sequence
  Catenin beta-1 (499-507)
HPPSHWPLI

SEQ ID NO: 11391 - protein, 10 aa, Artificial Sequence
  Uncharacterized protein C20orf196 (108-117)
HPQPGSANSL

SEQ ID NO: 11392 - protein, 9 aa, Artificial Sequence
  Polycomb protein EED (185-193)
HPRDPNLLL

SEQ ID NO: 11393 - protein, 10 aa, Artificial Sequence
  Hypoxia-inducible factor 1-alpha (708-717)
HPRSPNVLSV

SEQ ID NO: 11394 - protein, 9 aa, Artificial Sequence
  Exosome complex component RRP46 (111-119)
HPRTSITVV

SEQ ID NO: 11395 - protein, 9 aa, Artificial Sequence
  Kelch-like protein 11 (343-351)
HPTSHVSLL

SEQ ID NO: 11396 - protein, 9 aa, Artificial Sequence
  Cytoplasmic dynein 1 heavy chain 1 (331-339)
HRLLLIQAF

SEQ ID NO: 11397 - protein, 9 aa, Artificial Sequence
  Chromodomain-helicase-DNA-binding protein 3 (1077-1085)
HRVLIFSQM

SEQ ID NO: 11398 - protein, 9 aa, Artificial Sequence
  Helicase SRCAP (1801-1809)
HRVLIFTQM

SEQ ID NO: 11399 - protein, 9 aa, Artificial Sequence
  Endothelial PAS domain-containing protein 1 (15-23)
HSMDMKFTY

SEQ ID NO: 11400 - protein, 10 aa, Artificial Sequence
  Histone-binding protein RBBP7 (375-384)
HTAKISDFSW

SEQ ID NO: 11401 - protein, 9 aa, Artificial Sequence
  Adenylyl cyclase-associated protein 1 (23-31)
HTSDMHRGY

SEQ ID NO: 11402 - protein, 9 aa, Artificial Sequence
  POTE ankyrin domain family member I (78-86)
HTVPIYEGY

SEQ ID NO: 11403 - protein, 10 aa, Artificial Sequence
  Thioredoxin-interacting protein (164-173)
HTYLANGQTK

SEQ ID NO: 11404 - protein, 9 aa, Artificial Sequence
  Activity-dependent neuroprotector homeobox protein (162-170)
HVAAPYIAK

SEQ ID NO: 11405 - protein, 9 aa, Artificial Sequence
  DNA-binding protein inhibitor ID-4 (93-101)
HVIDYILDL

SEQ ID NO: 11406 - protein, 10 aa, Artificial Sequence
  Secernin-2 (133-142)
HVITGLLEHY

SEQ ID NO: 11407 - protein, 11 aa, Artificial Sequence
  ETS-related transcription factor Elf-1 (38-48)
HVPGADILNSY

SEQ ID NO: 11408 - protein, 10 aa, Artificial Sequence
  Cholinesterase (154-163)
HVYDGKFLAR

SEQ ID NO: 11409 - protein, 9 aa, Artificial Sequence
  TCDD-inducible poly (ADP-ribose) polymerase (387-395)
HYILHNSFF

SEQ ID NO: 11410 - protein, 9 aa, Artificial Sequence
  Proliferation-associated protein 2G4 (20-28)
IAFPTSISV

SEQ ID NO: 11411 - protein, 9 aa, Artificial Sequence
  Growth hormone-inducible transmembrane protein (143-151)
IAISRTPVL

SEQ ID NO: 11412 - protein, 10 aa, Artificial Sequence
  TRPM8 channel-associated factor 1 (376-385)
IALWPPVREK

SEQ ID NO: 11413 - protein, 9 aa, Artificial Sequence
  Kinesin-like protein KIF18B (388-396)
IARLPSSTL

SEQ ID NO: 11414 - protein, 9 aa, Artificial Sequence
  Eukaryotic initiation factor 4A-II (97-105)
IEFKETQAL

SEQ ID NO: 11415 - protein, 11 aa, Artificial Sequence
  Casein kinase II subunit alpha (263-273)
IELDPRFNDIL

SEQ ID NO: 11416 - protein, 9 aa, Artificial Sequence
  Methionine adenosyltransferase 2 subunit beta (82-90)
IHDFQPHVI

SEQ ID NO: 11417 - protein, 9 aa, Artificial Sequence
  Ubiquitin-like protein 5 (62-70)
IHDGMNLEL

SEQ ID NO: 11418 - protein, 11 aa, Artificial Sequence
  NudC domain-containing protein 1 (119-129)
IHFSSSTWVTL

SEQ ID NO: 11419 - protein, 9 aa, Artificial Sequence
  DNA topoisomerase 2-alpha (557-565)
IHHNWPSLL

SEQ ID NO: 11420 - protein, 10 aa, Artificial Sequence
  Probable ATP-dependent RNA helicase DDX5 (298-307)
IHINIGALEL

SEQ ID NO: 11421 - protein, 9 aa, Artificial Sequence
  Nucleolar protein 58 (107-115)
IHSPVVNEL

SEQ ID NO: 11422 - protein, 9 aa, Artificial Sequence
  ATPase family AAA domain-containing protein 2B (521-529)
IHSSIVSTL

SEQ ID NO: 11423 - protein, 9 aa, Artificial Sequence
  RNA polymerase II-associated protein 3 (126-134)
IHVDSQKAL

SEQ ID NO: 11424 - protein, 9 aa, Artificial Sequence
  Cytochrome c oxidase subunit 1 (311-319)
IIAIPTGVK

SEQ ID NO: 11425 - protein, 9 aa, Artificial Sequence
  40S ribosomal protein S7 (59-67)
IIFVPVPQL

SEQ ID NO: 11426 - protein, 9 aa, Artificial Sequence
  Zinc fingers and homeoboxes protein 3 (566-574)
IIIDSVPEV

SEQ ID NO: 11427 - protein, 9 aa, Artificial Sequence
  Dedicator of cytokinesis protein 7 (1109-1117)
IIMETVPQL

SEQ ID NO: 11428 - protein, 9 aa, Artificial Sequence
  Ras GTPase-activating-like protein IQGAP1 (1302-1310)
IINTHTLLL

SEQ ID NO: 11429 - protein, 9 aa, Artificial Sequence
  Intron-binding protein aquarius (273-281)
ILDDSHLLV

SEQ ID NO: 11430 - protein, 9 aa, Artificial Sequence
  Coatomer subunit zeta-1 (5-13)
ILEPSLYTV

SEQ ID NO: 11431 - protein, 10 aa, Artificial Sequence
  Methylmalonyl-CoA mutase, mitochondrial (172-181)
ILFDGIPLEK

SEQ ID NO: 11432 - protein, 9 aa, Artificial Sequence
  Asparagine synthetase (glutamine-hydrolyzing) (154-162)
ILFNNAVKK

SEQ ID NO: 11433 - protein, 9 aa, Artificial Sequence
  Protein SCAF8 (920-928)
ILGIQPPSV

SEQ ID NO: 11434 - protein, 9 aa, Artificial Sequence
  CREB-binding protein (26-34)
ILIGYLEYV

SEQ ID NO: 11435 - protein, 9 aa, Artificial Sequence
  Protein RRNAD1 (424-432)
ILLDRLLYL

SEQ ID NO: 11436 - protein, 8 aa, Artificial Sequence
  MAU2 chromatid cohesion factor homolog (246-253)
ILLEHIIM

SEQ ID NO: 11437 - protein, 9 aa, Artificial Sequence
  Phospholipase A-2-activating protein (517-525)
ILLEKILSL

SEQ ID NO: 11438 - protein, 9 aa, Artificial Sequence
  Serine-protein kinase ATM (144-152)
ILLKDILSV

SEQ ID NO: 11439 - protein, 9 aa, Artificial Sequence
  Glycerol-3-phosphate acyltransferase 3 (22-30)
ILLPSVFGV

SEQ ID NO: 11440 - protein, 9 aa, Artificial Sequence
  Protein FAM122B (239-247)
ILMDDLSPK

SEQ ID NO: 11441 - protein, 10 aa, Artificial Sequence
  DNA (cytosine-5)-methyltransferase 1 (382-391)
ILMDPSPEYA

SEQ ID NO: 11442 - protein, 9 aa, Artificial Sequence
  A-kinase anchor protein 8-like (529-537)
ILNNKLISK

SEQ ID NO: 11443 - protein, 9 aa, Artificial Sequence
  Protein TASOR (898-906)
ILNPEVVTV

SEQ ID NO: 11444 - protein, 10 aa, Artificial Sequence
  Anaphase-promoting complex subunit 1 (57-66)
ILSKDGVLYV

SEQ ID NO: 11445 - protein, 9 aa, Artificial Sequence
  Uncharacterized protein KIAA1109 (858-866)
ILSPLNVFV

SEQ ID NO: 11446 - protein, 9 aa, Artificial Sequence
  General vesicular transport factor p115 (329-337)
ILTETINTV

SEQ ID NO: 11447 - protein, 9 aa, Artificial Sequence
  ORM1-like protein 2 (28-36)
ILVGLLHMV

SEQ ID NO: 11448 - protein, 9 aa, Artificial Sequence
  Fibronectin type III domain-containing protein 3B (1072-1080)
ILWETVPSM

SEQ ID NO: 11449 - protein, 10 aa, Artificial Sequence
  Phenylalanine-tRNA ligase, mitochondrial (215-224)
ILYDIPDIRL

SEQ ID NO: 11450 - protein, 9 aa, Artificial Sequence
  Serine/threonine-protein phosphatase 2B catalytic subunit alpha isoform (138-146)
ILYPKTLFL

SEQ ID NO: 11451 - protein, 9 aa, Artificial Sequence
  Serine/threonine-protein phosphatase 2B catalytic subunit beta isoform (165-173)
ILYPSTLFL

SEQ ID NO: 11452 - protein, 9 aa, Artificial Sequence
  Proteasome activator complex subunit 4 (38-46)
ILYSKTEHL

SEQ ID NO: 11453 - protein, 9 aa, Artificial Sequence
  Vigilin (627-635)
IPAKLHNSL

SEQ ID NO: 11454 - protein, 9 aa, Artificial Sequence
  Thioredoxin domain-containing protein 11 (92-100)
IPAKPPVSF

SEQ ID NO: 11455 - protein, 9 aa, Artificial Sequence
  RNA-binding protein 12B (28-36)
IPDGGVHII

SEQ ID NO: 11456 - protein, 9 aa, Artificial Sequence
  Bifunctional glutamate/proline-tRNA ligase (709-717)
IPDGHTKEM

SEQ ID NO: 11457 - protein, 9 aa, Artificial Sequence
  Plectin (3582-3590)
IPEEQRAQL

SEQ ID NO: 11458 - protein, 8 aa, Artificial Sequence
  Filamin-A (1600-1607)
IPFSPYRV

SEQ ID NO: 11459 - protein, 9 aa, Artificial Sequence
  Coatomer subunit beta' (567-575)
IPKDNRLYL

SEQ ID NO: 11460 - protein, 9 aa, Artificial Sequence
  Bladder cancer-associated protein (13-21)
IPKPLNPAL

SEQ ID NO: 11461 - protein, 9 aa, Artificial Sequence
  Integrin beta-1 (92-100)
IPKSAVGTL

SEQ ID NO: 11462 - protein, 10 aa, Artificial Sequence
  Sodium/potassium-transporting ATPase subunit alpha-1 (601-610)
IPLPLGTVTI

SEQ ID NO: 11463 - protein, 9 aa, Artificial Sequence
  Tubulin beta chain (365-373)
IPNNVKTAV

SEQ ID NO: 11464 - protein, 9 aa, Artificial Sequence
  Membrane cofactor protein (71-79)
IPPLATHTI

SEQ ID NO: 11465 - protein, 8 aa, Artificial Sequence
  Chromodomain-helicase-DNA-binding protein 4 (1903-1910)
IPPVAVRL

SEQ ID NO: 11466 - protein, 10 aa, Artificial Sequence
  V-type proton ATPase catalytic subunit A (118-127)
IPRGVNVSAL

SEQ ID NO: 11467 - protein, 9 aa, Artificial Sequence
  Ubiquitin-associated domain-containing protein 2 (32-40)
IPRVQVAQI

SEQ ID NO: 11468 - protein, 9 aa, Artificial Sequence
  Probable ubiquitin carboxyl-terminal hydrolase FAF-X (1578-1586)
IPSIRNGIL

SEQ ID NO: 11469 - protein, 9 aa, Artificial Sequence
  Patatin-like phospholipase domain-containing protein 2 (212-220)
IQFNLRNLY

SEQ ID NO: 11470 - protein, 9 aa, Artificial Sequence
  Hypoxia-inducible factor 1-alpha (370-378)
IQHDLIFSL

SEQ ID NO: 11471 - protein, 9 aa, Artificial Sequence
  AN1-type zinc finger protein 5 (198-206)
IRKENPVVV

SEQ ID NO: 11472 - protein, 9 aa, Artificial Sequence
  Plectin (3944-3952)
IRPGTAFEL

SEQ ID NO: 11473 - protein, 9 aa, Artificial Sequence
  Nuclear factor of activated T-cells, cytoplasmic 2 (431-439)
IRTPVKVNF

SEQ ID NO: 11474 - protein, 9 aa, Artificial Sequence
  Cytospin-A (888-896)
ISGPISTSK

SEQ ID NO: 11475 - protein, 11 aa, Artificial Sequence
  Endothelin-converting enzyme 1 (719-729)
ITDPHSPSRFR

SEQ ID NO: 11476 - protein, 9 aa, Artificial Sequence
  TRAF2 and NCK-interacting protein kinase (425-433)
ITKDVVLQW

SEQ ID NO: 11477 - protein, 10 aa, Artificial Sequence
  Heat shock protein HSP 90-alpha (91-100)
IVDTGIGMTK

SEQ ID NO: 11478 - protein, 9 aa, Artificial Sequence
  Smith-Magenis syndrome chromosomal region candidate gene 8 protein (742-750)
IVRKLVTAL

SEQ ID NO: 11479 - protein, 10 aa, Artificial Sequence
  Actin, cytoplasmic 2 (75-84)
IVTNWDDMEK

SEQ ID NO: 11480 - protein, 9 aa, Artificial Sequence
  Importin subunit alpha-5 (492-500)
IYQKAFDLI

SEQ ID NO: 11481 - protein, 10 aa, Artificial Sequence
  Krueppel-like factor 3 (37-46)
IYSTPLPEKF

SEQ ID NO: 11482 - protein, 9 aa, Artificial Sequence
  Butyrophilin subfamily 3 member A3 secreted isoform (315-323)
IYTFPHASF

SEQ ID NO: 11483 - protein, 9 aa, Artificial Sequence
  Probable C-mannosyltransferase DPY19L1 (119-127)
IYTKIMDLI

SEQ ID NO: 11484 - protein, 9 aa, Artificial Sequence
  Basic leucine zipper and W2 domain-containing protein 2 (358-366)
KAFQKIVVL

SEQ ID NO: 11485 - protein, 9 aa, Artificial Sequence
  Structural maintenance of chromosomes protein 1A (1026-1034)
KAMEKLESV

SEQ ID NO: 11486 - protein, 9 aa, Artificial Sequence
  Histone H2B type 1-K (58-66)
KAMGIMNSF

SEQ ID NO: 11487 - protein, 9 aa, Artificial Sequence
  Replication protein A 70 kDa DNA-binding subunit (157-165)
KAYGASKTF

SEQ ID NO: 11488 - protein, 9 aa, Artificial Sequence
  Protein arginine N-methyltransferase 3 (98-106)
KEEYLKPVL

SEQ ID NO: 11489 - protein, 11 aa, Artificial Sequence
  Heat shock protein HSP 90-alpha (656-666)
KEFEGKTLVSV

SEQ ID NO: 11490 - protein, 10 aa, Artificial Sequence
  Nuclear autoantigenic sperm protein (298-307)
KEIEELKELL

SEQ ID NO: 11491 - protein, 10 aa, Artificial Sequence
  Nucleoporin GLE1 (442-451)
KEIFDKIHSL

SEQ ID NO: 11492 - protein, 11 aa, Artificial Sequence
  CDK5 and ABL1 enzyme substrate 1 (180-190)
KEIIGLEGVEL

SEQ ID NO: 11493 - protein, 11 aa, Artificial Sequence
  40S ribosomal protein S14 (7-17)
KEKKEEQVISL

SEQ ID NO: 11494 - protein, 11 aa, Artificial Sequence
  14-3-3 protein theta (158-168)
KEMQPTHPIRL

SEQ ID NO: 11495 - protein, 10 aa, Artificial Sequence
  Store-operated calcium entry-associated regulatory factor (86-95)
KGWDGYDVQW

SEQ ID NO: 11496 - protein, 9 aa, Artificial Sequence
  Midasin (3076-3084)
KIAQFLESV

SEQ ID NO: 11497 - protein, 9 aa, Artificial Sequence
  Heme oxygenase 1 (149-157)
KIAQKALDL

SEQ ID NO: 11498 - protein, 9 aa, Artificial Sequence
  WD repeat-containing protein 82 (84-92)
KIDDTIRYL

SEQ ID NO: 11499 - protein, 11 aa, Artificial Sequence
  Cytochrome c oxidase subunit 2 (217-227)
KIFEMGPVFTL

SEQ ID NO: 11500 - protein, 9 aa, Artificial Sequence
  Poly (ADP-ribose) polymerase 14 (1060-1068)
KIGSIIFQV

SEQ ID NO: 11501 - protein, 11 aa, Artificial Sequence
  KH domain-containing, RNA-binding, signal transduction-associated protein 1 (175-185)
KILGPQGNTIK

SEQ ID NO: 11502 - protein, 9 aa, Artificial Sequence
  Nucleolar pre-ribosomal-associated protein 1 (278-286)
KILPDLNTV

SEQ ID NO: 11503 - protein, 9 aa, Artificial Sequence
  Protein SON (1565-1573)
KILPTSETK

SEQ ID NO: 11504 - protein, 9 aa, Artificial Sequence
  Phosphatidylinositol 4-phosphate 5-kinase type-1 beta (263-271)
KIMDYSLLL

SEQ ID NO: 11505 - protein, 10 aa, Artificial Sequence
  Heat shock protein HSP 90-alpha (389-398)
KIMKDILEKK

SEQ ID NO: 11506 - protein, 9 aa, Artificial Sequence
  Mitotic checkpoint serine/threonine-protein kinase BUB1 beta (908-916)
KIVDFSYSV

SEQ ID NO: 11507 - protein, 9 aa, Artificial Sequence
  Tripeptidyl-peptidase 2 (81-89)
KIWDPVHRV

SEQ ID NO: 11508 - protein, 11 aa, Artificial Sequence
  Cyclin-dependent kinase 16 (375-385)
KLADFGLARAK

SEQ ID NO: 11509 - protein, 10 aa, Artificial Sequence
  Probable RNA-binding protein 23 (357-366)
KLAEGAGIQL

SEQ ID NO: 11510 - protein, 10 aa, Artificial Sequence
  SAP domain-containing ribonucleoprotein (19-28)
KLAELKQECL

SEQ ID NO: 11511 - protein, 9 aa, Artificial Sequence
  LIM and senescent cell antigen-like-containing domain protein 1 (317-325)
KLAETLGRK

SEQ ID NO: 11512 - protein, 9 aa, Artificial Sequence
  Protein NDRG1 (209-217)
KLDPTKTTL

SEQ ID NO: 11513 - protein, 11 aa, Artificial Sequence
  SEC14-like protein 1 (60-70)
KLDVDAPRLLK

SEQ ID NO: 11514 - protein, 9 aa, Artificial Sequence
  B-cell receptor-associated protein 31 (167-175)
KLDVGNAEV

SEQ ID NO: 11515 - protein, 9 aa, Artificial Sequence
  WAS protein family homolog 1 (210-218)
KLFDAPLSI

SEQ ID NO: 11516 - protein, 11 aa, Artificial Sequence
  Putative WAS protein family homolog 3 (208-218)
KLFDAPLSISK

SEQ ID NO: 11517 - protein, 10 aa, Artificial Sequence
  Oxysterol-binding protein-related protein 9 (138-147)
KLFDDKLQNC

SEQ ID NO: 11518 - protein, 10 aa, Artificial Sequence
  FACT complex subunit SSRP1 (413-422)
KLFDFVNAKK

SEQ ID NO: 11519 - protein, 12 aa, Artificial Sequence
  Eukaryotic translation initiation factor 3 subunit I (213-224)
KLFDSTTLEHQK

SEQ ID NO: 11520 - protein, 9 aa, Artificial Sequence
  Interferon regulatory factor 4 (356-364)
KLFDTQQFL

SEQ ID NO: 11521 - protein, 9 aa, Artificial Sequence
  Protein transport protein Sec61 subunit alpha isoform 2 (95-103)
KLFGMIITI

SEQ ID NO: 11522 - protein, 9 aa, Artificial Sequence
  Vacuolar fusion protein CCZ1 homolog (146-154)
KLFNGTFLK

SEQ ID NO: 11523 - protein, 9 aa, Artificial Sequence
  Iron-responsive element-binding protein 2 (746-754)
KLFNKFIGK

SEQ ID NO: 11524 - protein, 10 aa, Artificial Sequence
  Interleukin enhancer-binding factor 3 (591-600)
KLFPDTPLAL

SEQ ID NO: 11525 - protein, 9 aa, Artificial Sequence
  DNA-directed DNA/RNA polymerase mu (238-246)
KLFTQIFGV

SEQ ID NO: 11526 - protein, 11 aa, Artificial Sequence
  Serine/threonine-protein phosphatase 2A 65 kDa regulatory subunit A alpha isoform (188-198)
KLGEFAKVLEL

SEQ ID NO: 11527 - protein, 9 aa, Artificial Sequence
  ADP-ribosylation factor 5 (38-46)
KLGEIVTTI

SEQ ID NO: 11528 - protein, 8 aa, Artificial Sequence
  Ras GTPase-activating-like protein IQGAP2 (158-165)
KLGIAPQI

SEQ ID NO: 11529 - protein, 9 aa, Artificial Sequence
  Actin-like protein 6A (337-345)
KLIANNTTV

SEQ ID NO: 11530 - protein, 11 aa, Artificial Sequence
  Serine/threonine-protein kinase pim-2 (179-189)
KLIDFGSGALL

SEQ ID NO: 11531 - protein, 12 aa, Artificial Sequence
  Serine/threonine-protein kinase pim-1 (274-285)
KLIDFGSGALLK

SEQ ID NO: 11532 - protein, 9 aa, Artificial Sequence
  Dedicator of cytokinesis protein 4 (165-173)
KLIDKLDSL

SEQ ID NO: 11533 - protein, 9 aa, Artificial Sequence
  Protein furry homolog (375-383)
KLIGQVHEV

SEQ ID NO: 11534 - protein, 9 aa, Artificial Sequence
  Nodal modulator 3 (764-772)
KLIPLLLQL

SEQ ID NO: 11535 - protein, 10 aa, Artificial Sequence
  Nucleolar pre-ribosomal-associated protein 1 (172-181)
KLIQLPVVYV

SEQ ID NO: 11536 - protein, 9 aa, Artificial Sequence
  Telomere-associated protein RIF1 (232-240)
KLISELQKL

SEQ ID NO: 11537 - protein, 10 aa, Artificial Sequence
  26S protease regulatory subunit 6A (109-118)
KLKPGDLVGV

SEQ ID NO: 11538 - protein, 11 aa, Artificial Sequence
  Ras association domain-containing protein 1 (139-149)
KLLDDEQPLRL

SEQ ID NO: 11539 - protein, 9 aa, Artificial Sequence
  Cytochrome P450 2J2 (182-190)
KLLDEVTYL

SEQ ID NO: 11540 - protein, 10 aa, Artificial Sequence
  Phosphopantothenoylcysteine decarboxylase (39-48)
KLLDIPGLEV

SEQ ID NO: 11541 - protein, 10 aa, Artificial Sequence
  Protein scribble homolog (779-788)
KLLEVNGVAL

SEQ ID NO: 11542 - protein, 9 aa, Artificial Sequence
  Integrator complex subunit 4-like protein 2 isoform X2 (94-102)
KLLGSMEQV

SEQ ID NO: 11543 - protein, 9 aa, Artificial Sequence
  Nucleolar pre-ribosomal-associated protein 1 (170-178)
KLLNKIYEA

SEQ ID NO: 11544 - protein, 9 aa, Artificial Sequence
  Acidic leucine-rich nuclear phosphoprotein 32 family member A (137-145)
KLLPQLTYL

SEQ ID NO: 11545 - protein, 9 aa, Artificial Sequence
  Proheparin-binding EGF-like growth factor (2-10)
KLLPSVVLK

SEQ ID NO: 11546 - protein, 10 aa, Artificial Sequence
  Transmembrane protein 43 (13-22)
KLLSDPNYGV

SEQ ID NO: 11547 - protein, 9 aa, Artificial Sequence
  Ubiquitin carboxyl-terminal hydrolase 48 (231-239)
KLLSKFYEL

SEQ ID NO: 11548 - protein, 11 aa, Artificial Sequence
  Cytosolic acyl coenzyme A thioester hydrolase (210-220)
KLMDEVAGIVA

SEQ ID NO: 11549 - protein, 9 aa, Artificial Sequence
  N-alpha-acetyltransferase 20 (79-87)
KLMELLEEI

SEQ ID NO: 11550 - protein, 9 aa, Artificial Sequence
  Transcription intermediary factor 1-alpha (341-349)
KLMQQQQEV

SEQ ID NO: 11551 - protein, 9 aa, Artificial Sequence
  Cohesin subunit SA-1 (228-236)
KLMTALVNV

SEQ ID NO: 11552 - protein, 9 aa, Artificial Sequence
  Proteasome subunit alpha type-5 (151-159)
KLNATNIEL

SEQ ID NO: 11553 - protein, 9 aa, Artificial Sequence
  Myomegalin (424-432)
KLNEMSYEL

SEQ ID NO: 11554 - protein, 9 aa, Artificial Sequence
  Twinfilin-1 (192-200)
KLNNRQLNY

SEQ ID NO: 11555 - protein, 10 aa, Artificial Sequence
  Stromal interaction molecule 1 (571-580)
KLPDSPALAK

SEQ ID NO: 11556 - protein, 9 aa, Artificial Sequence
  Probable U3 small nucleolar RNA-associated protein 11 (5-13)
KLQDGVHII

SEQ ID NO: 11557 - protein, 9 aa, Artificial Sequence
  Hyaluronan mediated motility receptor (672-680)
KLQEELNKV

SEQ ID NO: 11558 - protein, 9 aa, Artificial Sequence
  Centromere-associated protein E (1817-1825)
KLQEKIQEL

SEQ ID NO: 11559 - protein, 9 aa, Artificial Sequence
  Zinc finger C3H1 domain-containing protein (891-899)
KLQEQIHRV

SEQ ID NO: 11560 - protein, 10 aa, Artificial Sequence
  Transmembrane protein 131 (929-938)
KLREPNFTLK

SEQ ID NO: 11561 - protein, 9 aa, Artificial Sequence
  EF-hand domain-containing protein D1 (174-182)
KLSEIDVAL

SEQ ID NO: 11562 - protein, 9 aa, Artificial Sequence
  Keratin, type II cytoskeletal 8 (148-156)
KLSELEAAL

SEQ ID NO: 11563 - protein, 9 aa, Artificial Sequence
  78 kDa glucose-regulated protein (2-10)
KLSLVAAML

SEQ ID NO: 11564 - protein, 9 aa, Artificial Sequence
  Retrotransposon-derived protein PEG10 (112-120)
KLTEENTTL

SEQ ID NO: 11565 - protein, 9 aa, Artificial Sequence
  Zinc finger MYM-type protein 2 (166-174)
KLTEIRHEV

SEQ ID NO: 11566 - protein, 10 aa, Artificial Sequence
  Cyclin-dependent kinase 2 (24-33)
KLTGEVVALK

SEQ ID NO: 11567 - protein, 10 aa, Artificial Sequence
  Transforming acidic coiled-coil-containing protein 3 (599-608)
KLVEFDFLGA

SEQ ID NO: 11568 - protein, 9 aa, Artificial Sequence
  Adenylyl cyclase-associated protein 1 (465-473)
KLVTTVTEI

SEQ ID NO: 11569 - protein, 9 aa, Artificial Sequence
  Inactive hydroxysteroid dehydrogenase-like protein 1 (148-156)
KLWDIINVN

SEQ ID NO: 11570 - protein, 9 aa, Artificial Sequence
  UBX domain-containing protein 11 (82-90)
KLWDLEQQV

SEQ ID NO: 11571 - protein, 9 aa, Artificial Sequence
  Pecanex-like protein 3 (1234-1242)
KLWDLLYKL

SEQ ID NO: 11572 - protein, 9 aa, Artificial Sequence
  MORF4 family-associated protein 1-like 1 (56-64)
KLWEMDNML

SEQ ID NO: 11573 - protein, 10 aa, Artificial Sequence
  MORF4 family-associated protein 1-like 1 (56-65)
KLWEMDNMLI

SEQ ID NO: 11574 - protein, 11 aa, Artificial Sequence
  MORF4 family-associated protein 1-like 1 (56-66)
KLWEMDNMLIQ

SEQ ID NO: 11575 - protein, 9 aa, Artificial Sequence
  Rho guanine nucleotide exchange factor 3 (108-116)
KLWSETFDV

SEQ ID NO: 11576 - protein, 9 aa, Artificial Sequence
  ADP-ribosylation factor-like protein 4C (157-165)
KLYEMILKR

SEQ ID NO: 11577 - protein, 9 aa, Artificial Sequence
  Splicing factor 3B subunit 4 (78-86)
KLYGKPIRV

SEQ ID NO: 11578 - protein, 9 aa, Artificial Sequence
  Tuberin (574-582)
KLYTLPASH

SEQ ID NO: 11579 - protein, 11 aa, Artificial Sequence
  E3 ubiquitin-protein ligase BRE1A (694-704)
KMADEDALRKI

SEQ ID NO: 11580 - protein, 9 aa, Artificial Sequence
  Melanoma-associated antigen 12 (112-120)
KMAELVHFL

SEQ ID NO: 11581 - protein, 11 aa, Artificial Sequence
  Ribosome biogenesis protein BOP1 (115-125)
KMDDPDYWRTV

SEQ ID NO: 11582 - protein, 9 aa, Artificial Sequence
  Talin-1 (535-543)
KMDESKHEI

SEQ ID NO: 11583 - protein, 9 aa, Artificial Sequence
  KDEL motif-containing protein 2 (215-223)
KMFSDEILL

SEQ ID NO: 11584 - protein, 10 aa, Artificial Sequence
  Structural maintenance of chromosomes protein 5 (378-387)
KMIEDLQNEL

SEQ ID NO: 11585 - protein, 12 aa, Artificial Sequence
  UPF0428 protein CXorf56 (70-81)
KMKGTLIDNQFK

SEQ ID NO: 11586 - protein, 11 aa, Artificial Sequence
  Tropomodulin-3 (307-317)
KMLEENTNILK

SEQ ID NO: 11587 - protein, 9 aa, Artificial Sequence
  HEAT repeat-containing protein 1 (682-690)
KMVEDLISV

SEQ ID NO: 11588 - protein, 9 aa, Artificial Sequence
  cAMP-dependent protein kinase type I-beta regulatory subunit (244-252)
KMYEEFLSK

SEQ ID NO: 11589 - protein, 10 aa, Artificial Sequence
  La-related protein 4B (374-383)
KPAASPLTSL

SEQ ID NO: 11590 - protein, 9 aa, Artificial Sequence
  Myosin-9 (517-525)
KPAGPPGIL

SEQ ID NO: 11591 - protein, 9 aa, Artificial Sequence
  Serine/threonine-protein kinase Nek6 (199-207)
KPANVFITA

SEQ ID NO: 11592 - protein, 9 aa, Artificial Sequence
  Acid ceramidase (209-217)
KPGLFSLTL

SEQ ID NO: 11593 - protein, 9 aa, Artificial Sequence
  BAG family molecular chaperone regulator 3 (324-332)
KPGPVGPEL

SEQ ID NO: 11594 - protein, 9 aa, Artificial Sequence
  Proteasome assembly chaperone 1 (230-238)
KPILSTRSL

SEQ ID NO: 11595 - protein, 10 aa, Artificial Sequence
  Radixin (3-12)
KPINVRVTTM

SEQ ID NO: 11596 - protein, 9 aa, Artificial Sequence
  Retinoblastoma-binding protein 5 (324-332)
KPKTTNIEL

SEQ ID NO: 11597 - protein, 9 aa, Artificial Sequence
  Transketolase (451-459)
KPLDRKLIL

SEQ ID NO: 11598 - protein, 9 aa, Artificial Sequence
  Forkhead box protein N2 (170-178)
KPLPLKTAL

SEQ ID NO: 11599 - protein, 11 aa, Artificial Sequence
  Galectin-3 (139-149)
KPNANRIALDF

SEQ ID NO: 11600 - protein, 9 aa, Artificial Sequence
  Catenin beta-1 (666-674)
KPQDYKKRL

SEQ ID NO: 11601 - protein, 11 aa, Artificial Sequence
  Catenin beta-1 (666-676)
KPQDYKKRLSV

SEQ ID NO: 11602 - protein, 9 aa, Artificial Sequence
  Serine/threonine-protein kinase tousled-like 2 (155-163)
KPRLDTEQL

SEQ ID NO: 11603 - protein, 9 aa, Artificial Sequence
  Retrotransposon-derived protein PEG10 (325-333)
KPRSPPRAL

SEQ ID NO: 11604 - protein, 11 aa, Artificial Sequence
  Retrotransposon-derived protein PEG10 (325-335)
KPRSPPRALVL

SEQ ID NO: 11605 - protein, 9 aa, Artificial Sequence
  rRNA-processing protein UTP23 homolog (149-157)
KPSPKTIAF

SEQ ID NO: 11606 - protein, 9 aa, Artificial Sequence
  60S ribosomal protein L13a (130-138)
KPTRKFAYL

SEQ ID NO: 11607 - protein, 10 aa, Artificial Sequence
  U3 small nucleolar ribonucleoprotein protein IMP3 (14-23)
KQVDFLNWEV

SEQ ID NO: 11608 - protein, 9 aa, Artificial Sequence
  Src kinase-associated phosphoprotein 2 (319-327)
KRGDVIYIL

SEQ ID NO: 11609 - protein, 10 aa, Artificial Sequence
  Guanylate-binding protein 4 (305-314)
KRLGTLVVTY

SEQ ID NO: 11610 - protein, 11 aa, Artificial Sequence
  Eukaryotic translation initiation factor 4 gamma 1 (570-580)
KRYDREFLLGF

SEQ ID NO: 11611 - protein, 10 aa, Artificial Sequence
  Hom s 1 (791-800)
KSMNANTITK

SEQ ID NO: 11612 - protein, 11 aa, Artificial Sequence
  Prefoldin subunit 5 (107-117)
KTAEDAKDFFK

SEQ ID NO: 11613 - protein, 11 aa, Artificial Sequence
  Death-inducer obliterator 1 (585-595)
KTAPPGSAVGK

SEQ ID NO: 11614 - protein, 9 aa, Artificial Sequence
  Volume-regulated anion channel subunit LRRC8C (100-108)
KTDLDLQQY

SEQ ID NO: 11615 - protein, 9 aa, Artificial Sequence
  Activating transcription factor 7-interacting protein 1 (394-402)
KTIDASVSK

SEQ ID NO: 11616 - protein, 10 aa, Artificial Sequence
  Arfaptin-1 (216-225)
KTIEDTLMTV

SEQ ID NO: 11617 - protein, 12 aa, Artificial Sequence
  UPF0769 protein C21orf59 (114-125)
KTIEEAKAIISK

SEQ ID NO: 11618 - protein, 11 aa, Artificial Sequence
  Acyl-CoA dehydrogenase family member 9, mitochondrial (521-531)
KTIMEEQLVLK

SEQ ID NO: 11619 - protein, 9 aa, Artificial Sequence
  Beta-synuclein (32-40)
KTKEGVLYV

SEQ ID NO: 11620 - protein, 9 aa, Artificial Sequence
  Transcriptional repressor protein YY1 (213-221)
KTLEGEFSV

SEQ ID NO: 11621 - protein, 10 aa, Artificial Sequence
  SWI/SNF-related matrix-associated actin-dependent regulator of chromatin subfamily A member 5 (112-121)
KTPTSPLKMK

SEQ ID NO: 11622 - protein, 9 aa, Artificial Sequence
  Short coiled-coil protein (97-105)
KTRLINQVL

SEQ ID NO: 11623 - protein, 9 aa, Artificial Sequence
  Collagen alpha-2(VI) chain (132-140)
KTRVFAVVI

SEQ ID NO: 11624 - protein, 9 aa, Artificial Sequence
  Ubinuclein-2 (526-534)
KTSDKPLMY

SEQ ID NO: 11625 - protein, 9 aa, Artificial Sequence
  26S proteasome non-ATPase regulatory subunit 6 (126-134)
KTYDKTVAL

SEQ ID NO: 11626 - protein, 10 aa, Artificial Sequence
  Coiled-coil domain-containing protein 14 (522-531)
KTYENVLSSR

SEQ ID NO: 11627 - protein, 10 aa, Artificial Sequence
  Heterogeneous nuclear ribonucleoprotein L-like (486-495)
KVFDAKPSAK

SEQ ID NO: 11628 - protein, 9 aa, Artificial Sequence
  Dihydroxyacetone phosphate acyltransferase (128-136)
KVFKQIFSK

SEQ ID NO: 11629 - protein, 10 aa, Artificial Sequence
  Ubiquitin carboxyl-terminal hydrolase 11 (139-148)
KVIELPNIQK

SEQ ID NO: 11630 - protein, 9 aa, Artificial Sequence
  Syntenin-1 (14-22)
KVIQAQTAF

SEQ ID NO: 11631 - protein, 9 aa, Artificial Sequence
  Plasmalemma vesicle-associated protein (164-172)
KVKTLEVEI

SEQ ID NO: 11632 - protein, 9 aa, Artificial Sequence
  Mitofusin-2 (84-92)
KVRGISEVL

SEQ ID NO: 11633 - protein, 9 aa, Artificial Sequence
  Heterogeneous nuclear ribonucleoprotein R isoform 7 (155-163)
KVWGNVVTV

SEQ ID NO: 11634 - protein, 10 aa, Artificial Sequence
  Small integral membrane protein 20 (58-67)
KVWSDPFGRK

SEQ ID NO: 11635 - protein, 9 aa, Artificial Sequence
  Stromal interaction molecule 2 (478-486)
KVYNGILEK

SEQ ID NO: 11636 - protein, 9 aa, Artificial Sequence
  Homeobox-containing protein 1 (325-333)
KVYNWFANR

SEQ ID NO: 11637 - protein, 9 aa, Artificial Sequence
  Threonylcarbamoyladenosine tRNA methylthiotransferase (405-413)
KVYTPSISK

SEQ ID NO: 11638 - protein, 9 aa, Artificial Sequence
  WD repeat-containing protein 1 (65-73)
KYAPSGFYI

SEQ ID NO: 11639 - protein, 9 aa, Artificial Sequence
  Alpha-soluble NSF attachment protein (227-235)
KYEELFPAF

SEQ ID NO: 11640 - protein, 9 aa, Artificial Sequence
  Putative E3 ubiquitin-protein ligase UBR7 (125-133)
KYNDNFFGL

SEQ ID NO: 11641 - protein, 9 aa, Artificial Sequence
  Rho guanine nucleotide exchange factor 1 (516-524)
KYPLLLQSI

SEQ ID NO: 11642 - protein, 9 aa, Artificial Sequence
  Zinc finger MYND domain-containing protein 11 (415-423)
KYTKIFNDF

SEQ ID NO: 11643 - protein, 8 aa, Artificial Sequence
  Transformation/transcription domain-associated protein (379-386)
LADLVHHV

SEQ ID NO: 11644 - protein, 8 aa, Artificial Sequence
  Ras GTPase-activating-like protein IQGAP1 (1072-1079)
LAPVVKEI

SEQ ID NO: 11645 - protein, 9 aa, Artificial Sequence
  Vimentin (124-132)
LEQQNKILL

SEQ ID NO: 11646 - protein, 9 aa, Artificial Sequence
  HLA class II histocompatibility antigen, DRB1-15 beta chain (48-56)
LGRPDAEYW

SEQ ID NO: 11647 - protein, 9 aa, Artificial Sequence
  U5 small nuclear ribonucleoprotein 200 kDa helicase (620-628)
LHDDRGPVL

SEQ ID NO: 11648 - protein, 8 aa, Artificial Sequence
  Elongation factor 2 (218-225)
LHGWAFTL

SEQ ID NO: 11649 - protein, 9 aa, Artificial Sequence
  Importin subunit alpha-1 (260-268)
LHHDDPEVL

SEQ ID NO: 11650 - protein, 9 aa, Artificial Sequence
  Protein kinase C delta type (286-294)
LLAEALNQV

SEQ ID NO: 11651 - protein, 9 aa, Artificial Sequence
  Protein sel-1 homolog 1 (580-588)
LLAEQGYEV

SEQ ID NO: 11652 - protein, 9 aa, Artificial Sequence
  BRCA1-associated ATM activator 1 (541-549)
LLASEVPQL

SEQ ID NO: 11653 - protein, 9 aa, Artificial Sequence
  15 kDa selenoprotein (21-29)
LLATVLQAV

SEQ ID NO: 11654 - protein, 9 aa, Artificial Sequence
  Talin-1 (2250-2258)
LLDHVLLTL

SEQ ID NO: 11655 - protein, 8 aa, Artificial Sequence
  Annexin A11 (433-440)
LLDIRSEY

SEQ ID NO: 11656 - protein, 8 aa, Artificial Sequence
  U3 small nucleolar ribonucleoprotein protein IMP3 (79-86)
LLDKLYAL

SEQ ID NO: 11657 - protein, 9 aa, Artificial Sequence
  WD repeat-containing protein 36 (605-613)
LLDSAPLNV

SEQ ID NO: 11658 - protein, 9 aa, Artificial Sequence
  Group XIIA secretory phospholipase A2 (158-166)
LLFDSVIHL

SEQ ID NO: 11659 - protein, 9 aa, Artificial Sequence
  Ras-related GTP-binding protein A (204-212)
LLFERATFL

SEQ ID NO: 11660 - protein, 9 aa, Artificial Sequence
  Transcription factor 20 (837-845)
LLHEENFSV

SEQ ID NO: 11661 - protein, 9 aa, Artificial Sequence
  NADH dehydrogenase (ubiquinone) 1 alpha subcomplex subunit 1 (16-24)
LLIPGLATA

SEQ ID NO: 11662 - protein, 9 aa, Artificial Sequence
  ERO1-like protein alpha (260-268)
LLLEILHEI

SEQ ID NO: 11663 - protein, 9 aa, Artificial Sequence
  Staphylococcal nuclease domain-containing protein 1 (186-194)
LLLPDYYLV

SEQ ID NO: 11664 - protein, 11 aa, Artificial Sequence
  Staphylococcal nuclease domain-containing protein 1 (186-196)
LLLPDYYLVTV

SEQ ID NO: 11665 - protein, 9 aa, Artificial Sequence
  Histone H2B type 2-F (101-109)
LLLPGELAK

SEQ ID NO: 11666 - protein, 9 aa, Artificial Sequence
  Clathrin heavy chain 1 (1422-1430)
LLMVLSPRL

SEQ ID NO: 11667 - protein, 9 aa, Artificial Sequence
  DNA-dependent protein kinase catalytic subunit (2454-2462)
LLNPVVEFV

SEQ ID NO: 11668 - protein, 9 aa, Artificial Sequence
  Superkiller viralicidic activity 2-like 2 (273-281)
LLPDNVHYV

SEQ ID NO: 11669 - protein, 9 aa, Artificial Sequence
  Homocysteine-responsive endoplasmic reticulum-resident ubiquitin-like domain member 1 protein (222-230)
LLPEGPPAI

SEQ ID NO: 11670 - protein, 9 aa, Artificial Sequence
  Potassium channel subfamily K member 4 (365-373)
LLPPPPCPA

SEQ ID NO: 11671 - protein, 9 aa, Artificial Sequence
  Casein kinase I isoform alpha (57-65)
LLYESKLYK

SEQ ID NO: 11672 - protein, 9 aa, Artificial Sequence
  Syntenin-1 (290-298)
LMDHTIPEV

SEQ ID NO: 11673 - protein, 9 aa, Artificial Sequence
  Bombesin receptor-activated protein C6orf89 (120-128)
LMSLPIAKK

SEQ ID NO: 11674 - protein, 9 aa, Artificial Sequence
  Constitutive coactivator of PPAR-gamma-like protein 1 (567-575)
LMYPYIFHV

SEQ ID NO: 11675 - protein, 9 aa, Artificial Sequence
  Peripheral plasma membrane protein CASK (705-713)
LPAFKRKTL

SEQ ID NO: 11676 - protein, 9 aa, Artificial Sequence
  Butyrophilin subfamily 3 member A3 secreted isoform (388-396)
LPAHPGAEV

SEQ ID NO: 11677 - protein, 9 aa, Artificial Sequence
  FERM domain-containing protein 4A (166-174)
LPALPTQAL

SEQ ID NO: 11678 - protein, 9 aa, Artificial Sequence
  Proline-rich protein PRCC (42-50)
LPAPKGPAL

SEQ ID NO: 11679 - protein, 9 aa, Artificial Sequence
  Serine/threonine-protein kinase SIK2 (446-454)
LPASVHPQL

SEQ ID NO: 11680 - protein, 11 aa, Artificial Sequence
  Host cell factor 1 (1377-1387)
LPDATSSHRTV

SEQ ID NO: 11681 - protein, 9 aa, Artificial Sequence
  Actin-related protein 2 (246-254)
LPDGRIIKV

SEQ ID NO: 11682 - protein, 9 aa, Artificial Sequence
  Transducin-like enhancer protein 4 (517-525)
LPDGRTLIV

SEQ ID NO: 11683 - protein, 11 aa, Artificial Sequence
  Biogenesis of lysosome-related organelles complex 1 subunit 6 (61-71)
LPDLQRSKQAL

SEQ ID NO: 11684 - protein, 9 aa, Artificial Sequence
  Integrator complex subunit 11 (441-449)
LPEAKKPRL

SEQ ID NO: 11685 - protein, 9 aa, Artificial Sequence
  Queuine tRNA-ribosyltransferase subunit QTRTD1 (120-128)
LPEDKPRLI

SEQ ID NO: 11686 - protein, 9 aa, Artificial Sequence
  Tyrosine-protein phosphatase non-receptor type 11 (283-291)
LPFDHTRVV

SEQ ID NO: 11687 - protein, 9 aa, Artificial Sequence
  Polypyrimidine tract-binding protein 2 (91-99)
LPFGKVTNI

SEQ ID NO: 11688 - protein, 9 aa, Artificial Sequence
  Nodal modulator 3 (615-623)
LPHHRVIEV

SEQ ID NO: 11689 - protein, 9 aa, Artificial Sequence
  RNA-binding protein 33 (711-719)
LPIAPSHVI

SEQ ID NO: 11690 - protein, 9 aa, Artificial Sequence
  Leucine-rich repeat-containing protein 59 (38-46)
LPKATILDL

SEQ ID NO: 11691 - protein, 9 aa, Artificial Sequence
  26S proteasome non-ATPase regulatory subunit 6 (11-19)
LPKNPDLRI

SEQ ID NO: 11692 - protein, 9 aa, Artificial Sequence
  Telomerase protein component 1 (671-679)
LPLLPGRTV

SEQ ID NO: 11693 - protein, 9 aa, Artificial Sequence
  Transcription factor Sp3 (515-523)
LPNLQTVTV

SEQ ID NO: 11694 - protein, 9 aa, Artificial Sequence
  Eukaryotic initiation factor 4A-III (354-362)
LPNNRELYI

SEQ ID NO: 11695 - protein, 8 aa, Artificial Sequence
  eIF-2-alpha kinase activator GCN1 (1363-1370)
LPPLVPAI

SEQ ID NO: 11696 - protein, 9 aa, Artificial Sequence
  E3 ubiquitin-protein ligase RNF181 (50-58)
LPPPAAKTV

SEQ ID NO: 11697 - protein, 9 aa, Artificial Sequence
  Mediator of RNA polymerase II transcription subunit 7 (10-18)
LPPPPMQYI

SEQ ID NO: 11698 - protein, 9 aa, Artificial Sequence
  Crooked neck-like protein 1 (45-53)
LPPPPQQKI

SEQ ID NO: 11699 - protein, 9 aa, Artificial Sequence
  Terminal uridylyltransferase 7 (284-292)
LPPPTPSQI

SEQ ID NO: 11700 - protein, 9 aa, Artificial Sequence
  Transcription elongation factor SPT4 (93-101)
LPQGIVREL

SEQ ID NO: 11701 - protein, 10 aa, Artificial Sequence
  Homeobox protein TGIF2 (105-114)
LPRGSSPSVL

SEQ ID NO: 11702 - protein, 9 aa, Artificial Sequence
  ATP-dependent RNA helicase DHX36 (300-308)
LPRKQGSIL

SEQ ID NO: 11703 - protein, 9 aa, Artificial Sequence
  Carnitine O-palmitoyltransferase 1, liver isoform (171-179)
LPRLPVPAV

SEQ ID NO: 11704 - protein, 10 aa, Artificial Sequence
  Beta-hexosaminidase subunit beta (8-17)
LPRPPMLLAL

SEQ ID NO: 11705 - protein, 9 aa, Artificial Sequence
  cGMP-inhibited 3',5'-cyclic phosphodiesterase B (240-248)
LPSALRPLL

SEQ ID NO: 11706 - protein, 10 aa, Artificial Sequence
  Polymerase delta-interacting protein 3 (241-250)
LPSSIRTKAL

SEQ ID NO: 11707 - protein, 8 aa, Artificial Sequence
  Runt-related transcription factor 2 (116-123)
LPVAFKVV

SEQ ID NO: 11708 - protein, 9 aa, Artificial Sequence
  THUMP domain-containing protein 3 (124-132)
LPWSNPLKV

SEQ ID NO: 11709 - protein, 9 aa, Artificial Sequence
  Peptidyl-prolyl cis-trans isomerase FKBP4 (200-208)
LPYGLERAI

SEQ ID NO: 11710 - protein, 8 aa, Artificial Sequence
  eIF-2-alpha kinase activator GCN1 (2077-2084)
LPYLVPKL

SEQ ID NO: 11711 - protein, 8 aa, Artificial Sequence
  E3 ubiquitin-protein ligase UBR4 (260-267)
LPYQIKKI

SEQ ID NO: 11712 - protein, 10 aa, Artificial Sequence
  Lysyl oxidase homolog 3 (408-417)
LPYTGAETRI

SEQ ID NO: 11713 - protein, 9 aa, Artificial Sequence
  Histone acetyltransferase KAT6B (711-719)
LSDLGRLSY

SEQ ID NO: 11714 - protein, 9 aa, Artificial Sequence
  Phosphatidylinositide phosphatase SAC2 (667-675)
LSLENLEKI

SEQ ID NO: 11715 - protein, 11 aa, Artificial Sequence
  Serpin B6 (76-86)
LTEVNKTGTQY

SEQ ID NO: 11716 - protein, 10 aa, Artificial Sequence
  Heat shock-related 70 kDa protein 2 (213-222)
LTIEDGIFEV

SEQ ID NO: 11717 - protein, 10 aa, Artificial Sequence
  Heat shock protein HSP 90-beta (36-45)
LVDTGIGMTK

SEQ ID NO: 11718 - protein, 9 aa, Artificial Sequence
  Interleukin-32 (97-105)
LVHAVQALW

SEQ ID NO: 11719 - protein, 9 aa, Artificial Sequence
  Protein diaphanous homolog 1 (1090-1098)
LYKELGEYF

SEQ ID NO: 11720 - protein, 9 aa, Artificial Sequence
  AKT-interacting protein (116-124)
LYQDGVFKF

SEQ ID NO: 11721 - protein, 8 aa, Artificial Sequence
  HLA class I histocompatibility antigen, Cw-3 alpha chain (4-11)
MAPRTLIL

SEQ ID NO: 11722 - protein, 9 aa, Artificial Sequence
  Charged multivesicular body protein 2a (127-135)
MEFERQAEI

SEQ ID NO: 11723 - protein, 9 aa, Artificial Sequence
  Bifunctional glutamate/proline-tRNA ligase (487-495)
MEWDKIWAF

SEQ ID NO: 11724 - protein, 9 aa, Artificial Sequence
  Sodium-coupled neutral amino acid transporter 1 (2-10)
MHFKSGLEL

SEQ ID NO: 11725 - protein, 9 aa, Artificial Sequence
  Nucleoside diphosphate kinase A (68-76)
MHSGPVVAM

SEQ ID NO: 11726 - protein, 11 aa, Artificial Sequence
  Cytochrome b (53-63)
MHYSPDASTAF

SEQ ID NO: 11727 - protein, 9 aa, Artificial Sequence
  Lysosomal protective protein (1-9)
MIRAAPPPL

SEQ ID NO: 11728 - protein, 9 aa, Artificial Sequence
  78 kDa glucose-regulated protein (1-9)
MKLSLVAAM

SEQ ID NO: 11729 - protein, 9 aa, Artificial Sequence
  Putative uncharacterized protein ZNF436-AS1 (1-9)
MLAVPVRLK

SEQ ID NO: 11730 - protein, 9 aa, Artificial Sequence
  Transformation/transcription domain-associated protein (1824-1832)
MLDSLRIYL

SEQ ID NO: 11731 - protein, 11 aa, Artificial Sequence
  Ubiquitin carboxyl-terminal hydrolase 11 (568-578)
MLFGHPLLVSV

SEQ ID NO: 11732 - protein, 8 aa, Artificial Sequence
  Beta-1-syntrophin (41-48)
MPILISKI

SEQ ID NO: 11733 - protein, 9 aa, Artificial Sequence
  Neuroblast differentiation-associated protein AHNAK (882-890)
MPKFSMPGF

SEQ ID NO: 11734 - protein, 9 aa, Artificial Sequence
  Neuroblast differentiation-associated protein AHNAK (2766-2774)
MPKIKMPKI

SEQ ID NO: 11735 - protein, 9 aa, Artificial Sequence
  Synergin gamma (422-430)
MPLPGTKAL

SEQ ID NO: 11736 - protein, 9 aa, Artificial Sequence
  Cyclin-dependent kinase 6 (54-62)
MPLSTIREV

SEQ ID NO: 11737 - protein, 9 aa, Artificial Sequence
  Type II inositol 3,4-bisphosphate 4-phosphatase (788-796)
MPPDYISHF

SEQ ID NO: 11738 - protein, 9 aa, Artificial Sequence
  Double-strand-break repair protein rad21 homolog (468-476)
MPPPPPQGV

SEQ ID NO: 11739 - protein, 9 aa, Artificial Sequence
  Eukaryotic initiation factor 4A-III (311-319)
MPQKERESI

SEQ ID NO: 11740 - protein, 10 aa, Artificial Sequence
  Mitotic-spindle organizing protein 2A (99-108)
MPRQPSATRL

SEQ ID NO: 11741 - protein, 9 aa, Artificial Sequence
  UDP-N-acetylglucosamine-peptide N-acetylglucosaminyltransferase 110 kDa subunit (774-782)
MPVIPMNTI

SEQ ID NO: 11742 - protein, 9 aa, Artificial Sequence
  Protein diaphanous homolog 1 (845-853)
MPYQEIKNV

SEQ ID NO: 11743 - protein, 9 aa, Artificial Sequence
  Prelamin-A/C (199-207)
MRARMQQQL

SEQ ID NO: 11744 - protein, 9 aa, Artificial Sequence
  Transcobalamin-2 (1-9)
MRHLGAFLF

SEQ ID NO: 11745 - protein, 9 aa, Artificial Sequence
  Suppressor of SWI4 1 homolog (100-108)
MRLPGGPTL

SEQ ID NO: 11746 - protein, 9 aa, Artificial Sequence
  Calcium/calmodulin-dependent protein kinase II inhibitor 1 (17-25)
MTDKAPPGV

SEQ ID NO: 11747 - protein, 9 aa, Artificial Sequence
  Insulin receptor substrate 2 (543-551)
MTMDRPLSH

SEQ ID NO: 11748 - protein, 9 aa, Artificial Sequence
  Necdin (58-66)
MVKDVIGSY

SEQ ID NO: 11749 - protein, 12 aa, Artificial Sequence
  ATP-citrate synthase (529-540)
MVYPFTGDHKQK

SEQ ID NO: 11750 - protein, 9 aa, Artificial Sequence
  Melanoma-associated antigen D2 (110-118)
NADPQAVTM

SEQ ID NO: 11751 - protein, 9 aa, Artificial Sequence
  FERM domain-containing protein 8 (198-206)
NAYRQVQEV

SEQ ID NO: 11752 - protein, 9 aa, Artificial Sequence
  Rapamycin-insensitive companion of mTOR (139-147)
NEVERTQAL

SEQ ID NO: 11753 - protein, 9 aa, Artificial Sequence
  26S protease regulatory subunit 4 (119-127)
NHAIVSTSV

SEQ ID NO: 11754 - protein, 8 aa, Artificial Sequence
  Serine/threonine-protein phosphatase 2A catalytic subunit beta isoform (229-236)
NHANGLTL

SEQ ID NO: 11755 - protein, 10 aa, Artificial Sequence
  Transcription factor 4 (402-411)
NHAVGPSTAM

SEQ ID NO: 11756 - protein, 9 aa, Artificial Sequence
  Translationally-controlled tumor protein (75-83)
NHHLQETSF

SEQ ID NO: 11757 - protein, 9 aa, Artificial Sequence
  SHC-transforming protein 4 (284-292)
NHHMQSISF

SEQ ID NO: 11758 - protein, 9 aa, Artificial Sequence
  E3 ubiquitin-protein ligase synoviolin (308-316)
NHIFHTSCL

SEQ ID NO: 11759 - protein, 9 aa, Artificial Sequence
  Dedicator of cytokinesis protein 8 (737-745)
NHLEKFFTL

SEQ ID NO: 11760 - protein, 9 aa, Artificial Sequence
  Cytochrome c oxidase subunit 6C (21-29)
NHMAVAFVL

SEQ ID NO: 11761 - protein, 9 aa, Artificial Sequence
  Ankyrin repeat domain-containing protein 54 (187-195)
NHVPVITTL

SEQ ID NO: 11762 - protein, 10 aa, Artificial Sequence
  Transcription factor jun-B (150-159)
NHVTPPNVSL

SEQ ID NO: 11763 - protein, 9 aa, Artificial Sequence
  Periodic tryptophan protein 2 homolog (866-874)
NHYNMQYAL

SEQ ID NO: 11764 - protein, 9 aa, Artificial Sequence
  Alpha-2-macroglobulin receptor-associated protein (292-300)
NHYQKQLEI

SEQ ID NO: 11765 - protein, 9 aa, Artificial Sequence
  Protein SCAF11 (912-920)
NIFPYPVGV

SEQ ID NO: 11766 - protein, 9 aa, Artificial Sequence
  RUS1 family protein C16orf58 (197-205)
NLAKCIVSV

SEQ ID NO: 11767 - protein, 9 aa, Artificial Sequence
  Pterin-4-alpha-carbinolamine dehydratase (19-27)
NLASFIEQV

SEQ ID NO: 11768 - protein, 9 aa, Artificial Sequence
  E3 ubiquitin-protein ligase RNF123 (595-603)
NLFDRVVTL

SEQ ID NO: 11769 - protein, 9 aa, Artificial Sequence
  Plastin-3 (327-335)
NLFNKYPAL

SEQ ID NO: 11770 - protein, 10 aa, Artificial Sequence
  THO complex subunit 2 (162-171)
NLIDLDDLYV

SEQ ID NO: 11771 - protein, 9 aa, Artificial Sequence
  Tyrosine-protein phosphatase non-receptor type 13 (472-480)
NLINQEIML

SEQ ID NO: 11772 - protein, 9 aa, Artificial Sequence
  Trifunctional purine biosynthetic protein adenosine-3 (39-47)
NLISALEEA

SEQ ID NO: 11773 - protein, 9 aa, Artificial Sequence
  Protein virilizer homolog (623-631)
NLLEEVFHL

SEQ ID NO: 11774 - protein, 9 aa, Artificial Sequence
  Chloride intracellular channel protein 5 (187-195)
NLLPKLHVV

SEQ ID NO: 11775 - protein, 9 aa, Artificial Sequence
  PHD finger protein 20-like protein 1 (210-218)
NLLTHIENV

SEQ ID NO: 11776 - protein, 9 aa, Artificial Sequence
  AP-3 complex subunit mu-2 (268-276)
NLVAIPVYV

SEQ ID NO: 11777 - protein, 10 aa, Artificial Sequence
  55 kDa erythrocyte membrane protein (337-346)
NMFGTKFETV

SEQ ID NO: 11778 - protein, 9 aa, Artificial Sequence
  Tetratricopeptide repeat protein 4 (260-268)
NPHGARLSL

SEQ ID NO: 11779 - protein, 9 aa, Artificial Sequence
  General transcription factor 3C polypeptide 1 (336-344)
NPKESSSSL

SEQ ID NO: 11780 - protein, 11 aa, Artificial Sequence
  Talin-1 (1623-1633)
NPRDPPSWSVL

SEQ ID NO: 11781 - protein, 11 aa, Artificial Sequence
  Roundabout homolog 1 (1497-1507)
NPRDPSSSSSM

SEQ ID NO: 11782 - protein, 9 aa, Artificial Sequence
  Clathrin interactor 1 (379-387)
NQAPSGPVA

SEQ ID NO: 11783 - protein, 9 aa, Artificial Sequence
  Coiled-coil domain-containing protein 134 (154-162)
NQGPHSPIL

SEQ ID NO: 11784 - protein, 9 aa, Artificial Sequence
  Transcription factor p65 (186-194)
NRAPNTAEL

SEQ ID NO: 11785 - protein, 9 aa, Artificial Sequence
  Putative methyltransferase NSUN3 (57-65)
NRFNYPFEL

SEQ ID NO: 11786 - protein, 9 aa, Artificial Sequence
  Toll-like receptor 9 (425-433)
NRISGASEL

SEQ ID NO: 11787 - protein, 9 aa, Artificial Sequence
  Dolichyl-diphosphooligosaccharide-proteinosyltransferase subunit 2 (618-626)
NRMLAQQAV

SEQ ID NO: 11788 - protein, 9 aa, Artificial Sequence
  Dolichyl-diphosphooligosaccharide-proteinosyltransferase subunit 2 (358-366)
NVADVVIKF

SEQ ID NO: 11789 - protein, 9 aa, Artificial Sequence
  Calcium homeostasis endoplasmic reticulum protein (14-22)
NVIDKLAQF

SEQ ID NO: 11790 - protein, 10 aa, Artificial Sequence
  E3 ubiquitin-protein ligase DTX3L (376-385)
NVIEVDSAHY

SEQ ID NO: 11791 - protein, 9 aa, Artificial Sequence
  U5 small nuclear ribonucleoprotein 200 kDa helicase (1517-1525)
NVRPVPLEL

SEQ ID NO: 11792 - protein, 9 aa, Artificial Sequence
  Arf-GAP with SH3 domain, ANK repeat and PH domain-containing protein 1 (87-95)
NYAQVLDKF

SEQ ID NO: 11793 - protein, 9 aa, Artificial Sequence
  GRB2-related adapter protein (100-108)
NYGDQVQHF

SEQ ID NO: 11794 - protein, 9 aa, Artificial Sequence
  Heat shock protein HSP 90-alpha (249-257)
NYKKFYEQF

SEQ ID NO: 11795 - protein, 9 aa, Artificial Sequence
  Fructosamine-3-kinase (284-292)
NYLNHWNHF

SEQ ID NO: 11796 - protein, 11 aa, Artificial Sequence
  SEC14-like protein 1 (424-434)
NYPETLGRLLI

SEQ ID NO: 11797 - protein, 10 aa, Artificial Sequence
  TATA element modulatory factor (751-760)
QEAENRNQEL

SEQ ID NO: 11798 - protein, 9 aa, Artificial Sequence
  Threonine-tRNA ligase, cytoplasmic (318-326)
QELYFFHEL

SEQ ID NO: 11799 - protein, 10 aa, Artificial Sequence
  Nuclear autoantigen Sp-100 (132-141)
QEYPDLIHIY

SEQ ID NO: 11800 - protein, 9 aa, Artificial Sequence
  Myosin-9 (709-717)
QGFPNRVVF

SEQ ID NO: 11801 - protein, 9 aa, Artificial Sequence
  MOB kinase activator 1A (165-173)
QHFDSVMQL

SEQ ID NO: 11802 - protein, 9 aa, Artificial Sequence
  ATP-citrate synthase (996-1004)
QHFPATPLL

SEQ ID NO: 11803 - protein, 10 aa, Artificial Sequence
  Cullin-3 (489-498)
QHLQATGVSL

SEQ ID NO: 11804 - protein, 9 aa, Artificial Sequence
  Angio-associated migratory cell protein (356-364)
QHQSGIVQL

SEQ ID NO: 11805 - protein, 9 aa, Artificial Sequence
  Protein PML (767-775)
QHVYPFSSL

SEQ ID NO: 11806 - protein, 9 aa, Artificial Sequence
  Solute carrier family 41 member 3 (91-99)
QHWPVFVEV

SEQ ID NO: 11807 - protein, 9 aa, Artificial Sequence
  Putative Polycomb group protein ASXL2 (1383-1391)
QILPKPLTK

SEQ ID NO: 11808 - protein, 9 aa, Artificial Sequence
  Programmed cell death 6-interacting protein (435-443)
QLIKELPEL

SEQ ID NO: 11809 - protein, 9 aa, Artificial Sequence
  Dynactin subunit 1 (1167-1175)
QLMEQVAQL

SEQ ID NO: 11810 - protein, 9 aa, Artificial Sequence
  E3 ubiquitin-protein ligase DTX3L (447-455)
QLMREVLLL

SEQ ID NO: 11811 - protein, 9 aa, Artificial Sequence
  Non-specific lipid-transfer protein (539-547)
QLQPGNAKL

SEQ ID NO: 11812 - protein, 9 aa, Artificial Sequence
  Poly (ADP-ribose) polymerase 14 (218-226)
QLSPRLLEV

SEQ ID NO: 11813 - protein, 9 aa, Artificial Sequence
  Protein ZGRF1 (2047-2055)
QLWGRVIQH

SEQ ID NO: 11814 - protein, 9 aa, Artificial Sequence
  Myosin-10 (655-663)
QLYKESLTK

SEQ ID NO: 11815 - protein, 9 aa, Artificial Sequence
  Signal recognition particle subunit SRP72 (247-255)
QLYNQIIKL

SEQ ID NO: 11816 - protein, 9 aa, Artificial Sequence
  Casein kinase I isoform alpha (119-127)
QMISRIEYV

SEQ ID NO: 11817 - protein, 10 aa, Artificial Sequence
  rRNA 2'-O-methyltransferase fibrillarin (236-245)
QPDQTRIVAL

SEQ ID NO: 11818 - protein, 9 aa, Artificial Sequence
  Eukaryotic translation initiation factor 4 gamma 3 (664-672)
QPKLPMRTL

SEQ ID NO: 11819 - protein, 9 aa, Artificial Sequence
  Activating transcription factor 7-interacting protein 1 (787-795)
QPLPVILHV

SEQ ID NO: 11820 - protein, 9 aa, Artificial Sequence
  Transmembrane emp24 domain-containing protein 5 (50-58)
QPMPLKASL

SEQ ID NO: 11821 - protein, 9 aa, Artificial Sequence
  E3 ubiquitin-protein ligase RNF31 (125-133)
QPRPQSTSL

SEQ ID NO: 11822 - protein, 10 aa, Artificial Sequence
  Nuclear factor of activated T-cells, cytoplasmic 2 (486-495)
QPYYPQHPMV

SEQ ID NO: 11823 - protein, 9 aa, Artificial Sequence
  Threonylcarbamoyladenosine tRNA methylthiotransferase (88-96)
QQIDRVVEV

SEQ ID NO: 11824 - protein, 9 aa, Artificial Sequence
  60S ribosomal protein L26 (65-73)
QQIGKVVQV

SEQ ID NO: 11825 - protein, 9 aa, Artificial Sequence
  Long-chain-fatty-acid-CoA ligase 3 (405-413)
QRNLFILAY

SEQ ID NO: 11826 - protein, 9 aa, Artificial Sequence
  B-cell receptor-associated protein 29 (101-109)
QRNLYISGF

SEQ ID NO: 11827 - protein, 11 aa, Artificial Sequence
  Nucleolar RNA helicase 2 (558-568)
QRSLINSNVGF

SEQ ID NO: 11828 - protein, 9 aa, Artificial Sequence
  GPI transamidase component PIG-T (351-359)
QRYVSGYGL

SEQ ID NO: 11829 - protein, 12 aa, Artificial Sequence
  Zinc finger protein 143 (64-75)
QVIQLEDGSAAY

SEQ ID NO: 11830 - protein, 9 aa, Artificial Sequence
  mRNA cap guanine-N7 methyltransferase (448-456)
QVRLPLGTL

SEQ ID NO: 11831 - protein, 9 aa, Artificial Sequence
  Elongation of very long chain fatty acids protein 1 (201-209)
QYPVIIHLI

SEQ ID NO: 11832 - protein, 9 aa, Artificial Sequence
  Arf-GAP with SH3 domain, ANK repeat and PH domain-containing protein 2 (74-82)
QYTQALEKF

SEQ ID NO: 11833 - protein, 9 aa, Artificial Sequence
  Telomerase protein component 1 (820-828)
RAAPHRISL

SEQ ID NO: 11834 - protein, 9 aa, Artificial Sequence
  MICOS complex subunit MIC60 (432-440)
RAFDSAVAK

SEQ ID NO: 11835 - protein, 10 aa, Artificial Sequence
  Uromodulin (615-624)
RAFSSLGLLK

SEQ ID NO: 11836 - protein, 9 aa, Artificial Sequence
  Signal transducer CD24 (3-11)
RAMVARLGL

SEQ ID NO: 11837 - protein, 9 aa, Artificial Sequence
  Eukaryotic translation initiation factor 4H (185-193)
RAQRPRLQL

SEQ ID NO: 11838 - protein, 9 aa, Artificial Sequence
  Cytochrome b-c1 complex subunit 8 (25-33)
RAYPHVFTK

SEQ ID NO: 11839 - protein, 10 aa, Artificial Sequence
  CLIP-associating protein 1 (519-528)
REAEHLYHTL

SEQ ID NO: 11840 - protein, 9 aa, Artificial Sequence
  Integrin alpha-6 (29-37)
REDNVIRKY

SEQ ID NO: 11841 - protein, 9 aa, Artificial Sequence
  Eukaryotic initiation factor 4A-III (260-268)
REEWKFDTL

SEQ ID NO: 11842 - protein, 11 aa, Artificial Sequence
  TCF3 fusion partner (90-100)
REIEQVNERVL

SEQ ID NO: 11843 - protein, 11 aa, Artificial Sequence
  Ataxin-2-like protein (324-334)
REIESSPQYRL

SEQ ID NO: 11844 - protein, 11 aa, Artificial Sequence
  NF-kappa-B essential modulator (319-329)
REKLAEKKELL

SEQ ID NO: 11845 - protein, 10 aa, Artificial Sequence
  ER membrane protein complex subunit 7 (192-201)
REMEQSMNML

SEQ ID NO: 11846 - protein, 11 aa, Artificial Sequence
  HMG box-containing protein 1 (104-114)
RENEVDWLTEL

SEQ ID NO: 11847 - protein, 10 aa, Artificial Sequence
  Kinesin-like protein KIFC1 (639-648)
RETQAINSSL

SEQ ID NO: 11848 - protein, 9 aa, Artificial Sequence
  Translation machinery-associated protein 16 (109-117)
RETVIKQTM

SEQ ID NO: 11849 - protein, 10 aa, Artificial Sequence
  Protein timeless homolog (623-632)
REVWPEGDVF

SEQ ID NO: 11850 - protein, 9 aa, Artificial Sequence
  E3 SUMO-protein ligase PIAS3 (145-153)
RFEEAHFTF

SEQ ID NO: 11851 - protein, 9 aa, Artificial Sequence
  Tubulin alpha-1C chain (334-342)
RIHFPLATY

SEQ ID NO: 11852 - protein, 9 aa, Artificial Sequence
  Poly (ADP-ribose) polymerase 4 (631-639)
RIIDTVAQV

SEQ ID NO: 11853 - protein, 9 aa, Artificial Sequence
  Moesin (275-283)
RINKRILAL

SEQ ID NO: 11854 - protein, 9 aa, Artificial Sequence
  Valine-tRNA ligase (530-538)
RIPAYFVTV

SEQ ID NO: 11855 - protein, 12 aa, Artificial Sequence
  COMM domain-containing protein 9 (145-156)
RIRDQLSAVASK

SEQ ID NO: 11856 - protein, 9 aa, Artificial Sequence
  SUN domain-containing protein 2 (117-125)
RIRPTAVTL

SEQ ID NO: 11857 - protein, 10 aa, Artificial Sequence
  28S ribosomal protein S21, mitochondrial (50-59)
RIYNMEMARK

SEQ ID NO: 11858 - protein, 10 aa, Artificial Sequence
  Heterogeneous nuclear ribonucleoprotein A1 (14-23)
RKLFIGGLSF

SEQ ID NO: 11859 - protein, 10 aa, Artificial Sequence
  Catenin beta-1 (124-133)
RLAEPSQMLK

SEQ ID NO: 11860 - protein, 9 aa, Artificial Sequence
  Kalirin (2002-2010)
RLAQLFIKH

SEQ ID NO: 11861 - protein, 9 aa, Artificial Sequence
  Thyroid adenoma-associated protein (345-353)
RLASKVISH

SEQ ID NO: 11862 - protein, 9 aa, Artificial Sequence
  Prostaglandin F2 receptor negative regulator (3-11)
RLASRPLLL

SEQ ID NO: 11863 - protein, 9 aa, Artificial Sequence
  Transcription factor 4 (368-376)
RLDDAIHVL

SEQ ID NO: 11864 - protein, 9 aa, Artificial Sequence
  Fanconi anemia group D2 protein (253-261)
RLDPNFLLK

SEQ ID NO: 11865 - protein, 11 aa, Artificial Sequence
  Ubiquitin carboxyl-terminal hydrolase 19 (1354-1364)
RLFDDSTVTTV

SEQ ID NO: 11866 - protein, 11 aa, Artificial Sequence
  BTB/POZ domain-containing protein 2 (2-12)
RLFDEPQLASL

SEQ ID NO: 11867 - protein, 9 aa, Artificial Sequence
  Heat shock protein beta-1 (27-35)
RLFDQAFGL

SEQ ID NO: 11868 - protein, 9 aa, Artificial Sequence
  V-type proton ATPase subunit S1 (315-323)
RLFGTTVTF

SEQ ID NO: 11869 - protein, 10 aa, Artificial Sequence
  V-type proton ATPase subunit S1 (225-234)
RLFGTTVTFK

SEQ ID NO: 11870 - protein, 10 aa, Artificial Sequence
  Dol-P-Man:Man(5)GlcNAc(2)-PP-Dol alpha-1,3-mannosyltransferase (123-132)
RLFNDPVAMV

SEQ ID NO: 11871 - protein, 9 aa, Artificial Sequence
  tRNA-dihydrouridine(20) synthase (NAD(P)+)-like (362-370)
RLFSSIVTV

SEQ ID NO: 11872 - protein, 9 aa, Artificial Sequence
  Surfeit locus protein 6 (121-129)
RLHEKIQEA

SEQ ID NO: 11873 - protein, 9 aa, Artificial Sequence
  Proteasome subunit alpha type-4 (20-28)
RLIAQRYLL

SEQ ID NO: 11874 - protein, 9 aa, Artificial Sequence
  Lysine-specific demethylase 5B (975-983)
RLIDLGVGL

SEQ ID NO: 11875 - protein, 10 aa, Artificial Sequence
  Rho GTPase-activating protein 19 (65-74)
RLIDLPGTEL

SEQ ID NO: 11876 - protein, 9 aa, Artificial Sequence
  General transcription factor 3C polypeptide 1 (377-385)
RLIESLFTI

SEQ ID NO: 11877 - protein, 11 aa, Artificial Sequence
  Heat shock 70 kDa protein 1-like (51-61)
RLIGDAAKNQV

SEQ ID NO: 11878 - protein, 9 aa, Artificial Sequence
  Short coiled-coil protein (55-63)
RLINQVLEL

SEQ ID NO: 11879 - protein, 9 aa, Artificial Sequence
  Importin-9 (241-249)
RLIPTLVSI

SEQ ID NO: 11880 - protein, 9 aa, Artificial Sequence
  Eukaryotic translation initiation factor 4E (61-69)
RLISKFDTV

SEQ ID NO: 11881 - protein, 9 aa, Artificial Sequence
  C-X-C motif chemokine 14 (14-22)
RLLAAALLL

SEQ ID NO: 11882 - protein, 10 aa, Artificial Sequence
  Engulfment and cell motility protein 1 (697-706)
RLLDLENIQI

SEQ ID NO: 11883 - protein, 9 aa, Artificial Sequence
  PX domain-containing protein kinase-like protein (219-227)
RLLDLENSL

SEQ ID NO: 11884 - protein, 9 aa, Artificial Sequence
  Collagen alpha-1(XVIII) chain (14-22)
RLLDVLAPL

SEQ ID NO: 11885 - protein, 9 aa, Artificial Sequence
  Baculoviral IAP repeat-containing protein 6 (2177-2185)
RLLDYVATV

SEQ ID NO: 11886 - protein, 9 aa, Artificial Sequence
  Lysine-specific histone demethylase 1A (180-188)
RLLEATSYL

SEQ ID NO: 11887 - protein, 9 aa, Artificial Sequence
  Isochorismatase domain-containing protein 2 (49-57)
RLLEVPVML

SEQ ID NO: 11888 - protein, 12 aa, Artificial Sequence
  Histone H2B type 1-K (100-111)
RLLLPGELAKHA

SEQ ID NO: 11889 - protein, 10 aa, Artificial Sequence
  Attractin (51-60)
RLLSPPLRPR

SEQ ID NO: 11890 - protein, 9 aa, Artificial Sequence
  Heat shock protein 105 kDa (183-191)
RLMNDMTAV

SEQ ID NO: 11891 - protein, 9 aa, Artificial Sequence
  Heat shock 70 kDa protein 4L (128-136)
RLMNETTAV

SEQ ID NO: 11892 - protein, 11 aa, Artificial Sequence
  Heat shock 70 kDa protein 4L (128-138)
RLMNETTAVAL

SEQ ID NO: 11893 - protein, 9 aa, Artificial Sequence
  Cyclin-D1-binding protein 1 (55-63)
RLNEAAVTV

SEQ ID NO: 11894 - protein, 10 aa, Artificial Sequence
  Coatomer subunit gamma-2 (708-717)
RLPDDDPTAV

SEQ ID NO: 11895 - protein, 9 aa, Artificial Sequence
  Glyoxylate reductase/hydroxypyruvate reductase (125-133)
RLPEAIEEV

SEQ ID NO: 11896 - protein, 9 aa, Artificial Sequence
  EH domain-containing protein 4 (337-345)
RLPEIYIQL

SEQ ID NO: 11897 - protein, 9 aa, Artificial Sequence
  Sorting nexin-1 (13-21)
RLPPPFPGL

SEQ ID NO: 11898 - protein, 9 aa, Artificial Sequence
  DNA-directed RNA polymerase III subunit RPC1 (218-226)
RLPPPTILK

SEQ ID NO: 11899 - protein, 9 aa, Artificial Sequence
  Kazrin (78-86)
RLQEEVHLL

SEQ ID NO: 11900 - protein, 11 aa, Artificial Sequence
  Synaptojanin-2-binding protein (58-68)
RLQEGDKILSV

SEQ ID NO: 11901 - protein, 9 aa, Artificial Sequence
  Centrosomal protein of 85 kDa (243-251)
RLQMEQMQL

SEQ ID NO: 11902 - protein, 12 aa, Artificial Sequence
  KIF1-binding protein (494-505)
RLRDPDSHIVKK

SEQ ID NO: 11903 - protein, 9 aa, Artificial Sequence
  Transmembrane protein 69 (146-154)
RLSEAIVTV

SEQ ID NO: 11904 - protein, 10 aa, Artificial Sequence
  WASH complex subunit strumpellin (31-40)
RLSEFIPAVF

SEQ ID NO: 11905 - protein, 9 aa, Artificial Sequence
  COP9 signalosome complex subunit 8 (199-207)
RLTDYVAFL

SEQ ID NO: 11906 - protein, 9 aa, Artificial Sequence
  Proliferating cell nuclear antigen (5-13)
RLVQGSILK

SEQ ID NO: 11907 - protein, 11 aa, Artificial Sequence
  Serine-threonine kinase receptor-associated protein (167-177)
RLWDHATMTEV

SEQ ID NO: 11908 - protein, 9 aa, Artificial Sequence
  Probable ubiquitin carboxyl-terminal hydrolase FAF-Y (1674-1682)
RLWGEPVNL

SEQ ID NO: 11909 - protein, 11 aa, Artificial Sequence
  Lariat debranching enzyme (301-311)
RLWNMPENNGL

SEQ ID NO: 11910 - protein, 9 aa, Artificial Sequence
  DNA damage-inducible transcript 4 protein (184-192)
RLWPKIQGL

SEQ ID NO: 11911 - protein, 10 aa, Artificial Sequence
  Serine/threonine-protein kinase mTOR (2035-2044)
RLYFGERNVK

SEQ ID NO: 11912 - protein, 10 aa, Artificial Sequence
  Filamin-A (142-151)
RLYSVSYLLK

SEQ ID NO: 11913 - protein, 9 aa, Artificial Sequence
  C-1-tetrahydrofolate synthase, cytoplasmic (746-754)
RMFGIPVVV

SEQ ID NO: 11914 - protein, 10 aa, Artificial Sequence
  Hemoglobin subunit alpha (3-12)
RMFLSFPTTK

SEQ ID NO: 11915 - protein, 9 aa, Artificial Sequence
  Transaldolase (28-36)
RMFNAENGK

SEQ ID NO: 11916 - protein, 9 aa, Artificial Sequence
  Receptor activity-modifying protein 2 (21-29)
RPAALRLLL

SEQ ID NO: 11917 - protein, 11 aa, Artificial Sequence
  Nucleolar protein 11 (53-63)
RPADPEKNQSL

SEQ ID NO: 11918 - protein, 9 aa, Artificial Sequence
  F-box only protein 32 (160-168)
RPAFKGLTF

SEQ ID NO: 11919 - protein, 9 aa, Artificial Sequence
  Transcription cofactor vestigial-like protein 4 (144-152)
RPAGLSPTL

SEQ ID NO: 11920 - protein, 10 aa, Artificial Sequence
  26S proteasome non-ATPase regulatory subunit 13 (284-293)
RPANHRQLTF

SEQ ID NO: 11921 - protein, 9 aa, Artificial Sequence
  SH3 domain-binding protein 1 (567-575)
RPAPARPTM

SEQ ID NO: 11922 - protein, 9 aa, Artificial Sequence
  Epsin-2 (471-479)
RPAPPAQSL

SEQ ID NO: 11923 - protein, 9 aa, Artificial Sequence
  Sterol regulatory element-binding protein 2 (1026-1034)
RPAYRKVFL

SEQ ID NO: 11924 - protein, 10 aa, Artificial Sequence
  Protein O-GlcNAcase (828-837)
RPDDKRILEF

SEQ ID NO: 11925 - protein, 9 aa, Artificial Sequence
  Transcription factor 25 (211-219)
RPENRSFYL

SEQ ID NO: 11926 - protein, 9 aa, Artificial Sequence
  NFX1-type zinc finger-containing protein 1 (350-358)
RPFLRPNII

SEQ ID NO: 11927 - protein, 9 aa, Artificial Sequence
  Procollagen-lysine,2-oxoglutarate 5-dioxygenase 2 (137-145)
RPHHDASTF

SEQ ID NO: 11928 - protein, 9 aa, Artificial Sequence
  Transducin beta-like protein 3 (564-572)
RPHTVLTVI

SEQ ID NO: 11929 - protein, 10 aa, Artificial Sequence
  Mitogen-activated protein kinase 3 (229-238)
RPIFPGKHYL

SEQ ID NO: 11930 - protein, 9 aa, Artificial Sequence
  Ragulator complex protein LAMTOR2 (3-11)
RPKALTQVL

SEQ ID NO: 11931 - protein, 10 aa, Artificial Sequence
  Pre-mRNA-processing factor 19 (62-71)
RPKPPSATSI

SEQ ID NO: 11932 - protein, 10 aa, Artificial Sequence
  Poly(rC)-binding protein 2 (183-192)
RPKPSSSPVI

SEQ ID NO: 11933 - protein, 9 aa, Artificial Sequence
  Mitogen-activated protein kinase 9 (263-271)
RPKYPGIKF

SEQ ID NO: 11934 - protein, 9 aa, Artificial Sequence
  Probable ATP-dependent RNA helicase DDX27 (196-204)
RPLLKAITA

SEQ ID NO: 11935 - protein, 10 aa, Artificial Sequence
  Protein transport protein Sec23B (243-252)
RPLRSTGVAL

SEQ ID NO: 11936 - protein, 9 aa, Artificial Sequence
  RNA-binding protein 39 (297-305)
RPMKVGHVT

SEQ ID NO: 11937 - protein, 9 aa, Artificial Sequence
  UAP56-interacting factor (71-79)
RPNGVITGL

SEQ ID NO: 11938 - protein, 9 aa, Artificial Sequence
  Adipocyte plasma membrane-associated protein (337-345)
RPNPGFSML

SEQ ID NO: 11939 - protein, 9 aa, Artificial Sequence
  Induced myeloid leukemia cell differentiation protein Mcl-1 (78-86)
RPPPIGAEV

SEQ ID NO: 11940 - protein, 9 aa, Artificial Sequence
  Sterol regulatory element-binding protein 1 (1003-1011)
RPQASALEL

SEQ ID NO: 11941 - protein, 9 aa, Artificial Sequence
  (Pyruvate dehydrogenase (acetyl-transferring))-phosphatase 1, mitochondrial (443-451)
RPQDKFLVL

SEQ ID NO: 11942 - protein, 9 aa, Artificial Sequence
  RuvB-like 1 (249-257)
RPQGGQDIL

SEQ ID NO: 11943 - protein, 9 aa, Artificial Sequence
  28S ribosomal protein S12, mitochondrial (55-63)
RPQLKGVVL

SEQ ID NO: 11944 - protein, 10 aa, Artificial Sequence
  WD repeat and FYVE domain-containing protein 1 (8-17)
RPQSSRPVLL

SEQ ID NO: 11945 - protein, 9 aa, Artificial Sequence
  Renin receptor (59-67)
RPRATVMVM

SEQ ID NO: 11946 - protein, 10 aa, Artificial Sequence
  Protein OS-9 (186-195)
RPREAEVRFL

SEQ ID NO: 11947 - protein, 8 aa, Artificial Sequence
  Protein disulfide-isomerase A4 (2-9)
RPRKAFLL

SEQ ID NO: 11948 - protein, 10 aa, Artificial Sequence
  Protein disulfide-isomerase A4 (2-11)
RPRKAFLLLL

SEQ ID NO: 11949 - protein, 11 aa, Artificial Sequence
  Glycogen synthase kinase-3 beta (306-316)
RPRTPPEAIAL

SEQ ID NO: 11950 - protein, 10 aa, Artificial Sequence
  Apolipoprotein L1 (285-294)
RPRVTEPISA

SEQ ID NO: 11951 - protein, 9 aa, Artificial Sequence
  ATP-dependent RNA helicase A (272-280)
RPSAAGINL

SEQ ID NO: 11952 - protein, 9 aa, Artificial Sequence
  Protein DEPP (195-203)
RPSSVLRTL

SEQ ID NO: 11953 - protein, 9 aa, Artificial Sequence
  Filamin-B (69-77)
RPTFRQMQL

SEQ ID NO: 11954 - protein, 9 aa, Artificial Sequence
  Antigen peptide transporter 2 (168-176)
RPVLKGLTF

SEQ ID NO: 11955 - protein, 9 aa, Artificial Sequence
  FAS-associated factor 1 (77-85)
RPVMPSRQI

SEQ ID NO: 11956 - protein, 9 aa, Artificial Sequence
  CDC42 small effector protein 1 (69-77)
RPWSNSRGL

SEQ ID NO: 11957 - protein, 10 aa, Artificial Sequence
  Cyclin-dependent kinase 13 (254-263)
RPYTNKVITL

SEQ ID NO: 11958 - protein, 12 aa, Artificial Sequence
  Rac GTPase-activating protein 1 (547-558)
RQGNFFASPMLK

SEQ ID NO: 11959 - protein, 11 aa, Artificial Sequence
  SEC14-like protein 1 (168-178)
RQLEEEGITFV

SEQ ID NO: 11960 - protein, 10 aa, Artificial Sequence
  Ubiquitin carboxyl-terminal hydrolase 22 (419-428)
RRKITTYVSF

SEQ ID NO: 11961 - protein, 9 aa, Artificial Sequence
  MICOS complex subunit MIC10 (38-46)
RRMWPLAFG

SEQ ID NO: 11962 - protein, 9 aa, Artificial Sequence
  Protein transport protein Sec23B (569-577)
RRSPFLQVF

SEQ ID NO: 11963 - protein, 9 aa, Artificial Sequence
  Protein transport protein Sec23A (585-593)
RRSSFLQVF

SEQ ID NO: 11964 - protein, 9 aa, Artificial Sequence
  Nicastrin (225-233)
RRSSIQSTF

SEQ ID NO: 11965 - protein, 9 aa, Artificial Sequence
  Protein FAM73A (222-230)
RRWEQALTF

SEQ ID NO: 11966 - protein, 9 aa, Artificial Sequence
  Complement C1q subcomponent subunit C (184-192)
RSGVKVVTF

SEQ ID NO: 11967 - protein, 11 aa, Artificial Sequence
  RNA polymerase II subunit A C-terminal domain phosphatase SSU72 (18-28)
RSMEAHNILSK

SEQ ID NO: 11968 - protein, 10 aa, Artificial Sequence
  Heterogeneous nuclear ribonucleoproteins A2/B1 (60-69)
RSRGFGFVTF

SEQ ID NO: 11969 - protein, 9 aa, Artificial Sequence
  Dynamin-2 (199-207)
RTIGVITKL

SEQ ID NO: 11970 - protein, 11 aa, Artificial Sequence
  Profilin-1 (87-97)
RTKSTGGAPTF

SEQ ID NO: 11971 - protein, 11 aa, Artificial Sequence
  28S ribosomal protein S7, mitochondrial (198-208)
RTLMPEKLSHK

SEQ ID NO: 11972 - protein, 10 aa, Artificial Sequence
  Protein SDA1 homolog (403-412)
RTLNPQMLQK

SEQ ID NO: 11973 - protein, 9 aa, Artificial Sequence
  Serine/threonine-protein kinase TAO1 (49-57)
RTNEVVAIK

SEQ ID NO: 11974 - protein, 10 aa, Artificial Sequence
  Serine/threonine-protein kinase TAO1 (49-58)
RTNEVVAIKK

SEQ ID NO: 11975 - protein, 10 aa, Artificial Sequence
  Ras GTPase-activating protein 3 (360-369)
RTQDPNTIFR

SEQ ID NO: 11976 - protein, 11 aa, Artificial Sequence
  Zinc finger protein 706 (45-55)
RTQMPDPKTFK

SEQ ID NO: 11977 - protein, 12 aa, Artificial Sequence
  Fructose-bisphosphate aldolase A (259-270)
RTVPPAVTGITF

SEQ ID NO: 11978 - protein, 9 aa, Artificial Sequence
  Protein LDOC1L (175-183)
RTYKSPLRH

SEQ ID NO: 11979 - protein, 11 aa, Artificial Sequence
  Sorting nexin-4 (243-253)
RVADRLYGVYK

SEQ ID NO: 11980 - protein, 9 aa, Artificial Sequence
  Cell division cycle and apoptosis regulator protein 1 (148-156)
RVFTGVVTK

SEQ ID NO: 11981 - protein, 10 aa, Artificial Sequence
  Centrosomal protein of 57 kDa (325-334)
RVINSIPLAK

SEQ ID NO: 11982 - protein, 9 aa, Artificial Sequence
  Hom s 1 (22-30)
RVKAPNKSL

SEQ ID NO: 11983 - protein, 9 aa, Artificial Sequence
  Cytosolic 10-formyltetrahydrofolate dehydrogenase (894-902)
RVKTVTFEY

SEQ ID NO: 11984 - protein, 10 aa, Artificial Sequence
  E3 ubiquitin-protein ligase HUWE1 (812-821)
RVLDFDVKRK

SEQ ID NO: 11985 - protein, 10 aa, Artificial Sequence
  Eukaryotic translation initiation factor 4 gamma 3 (1045-1054)
RVLDPSKFLK

SEQ ID NO: 11986 - protein, 9 aa, Artificial Sequence
  Paired amphipathic helix protein Sin3a (631-639)
RVLEAIQKK

SEQ ID NO: 11987 - protein, 10 aa, Artificial Sequence
  Smoothelin (476-485)
RVLLPTGNQR

SEQ ID NO: 11988 - protein, 12 aa, Artificial Sequence
  40S ribosomal protein S18 (14-25)
RVLNTNIDGRRK

SEQ ID NO: 11989 - protein, 9 aa, Artificial Sequence
  WASH complex subunit strumpellin (573-581)
RVNPSMVTK

SEQ ID NO: 11990 - protein, 9 aa, Artificial Sequence
  Transcription factor 4 (552-560)
RVRDINEAF

SEQ ID NO: 11991 - protein, 9 aa, Artificial Sequence
  WW domain-binding protein 5 (82-90)
RVRNKLIVM

SEQ ID NO: 11992 - protein, 11 aa, Artificial Sequence
  Phosphatidylinositide phosphatase SAC1 (35-45)
RVSTEVTLAVK

SEQ ID NO: 11993 - protein, 11 aa, Artificial Sequence
  Periodic tryptophan protein 1 homolog (244-254)
RVWDISTVSSV

SEQ ID NO: 11994 - protein, 11 aa, Artificial Sequence
  39S ribosomal protein L3, mitochondrial (250-260)
RVWPGTKMPGK

SEQ ID NO: 11995 - protein, 9 aa, Artificial Sequence
  Inositol-trisphosphate 3-kinase B (33-41)
RVWQGTMEK

SEQ ID NO: 11996 - protein, 10 aa, Artificial Sequence
  Guanine nucleotide-binding protein subunit beta-2-like 1 (308-317)
RVWQVTIGTR

SEQ ID NO: 11997 - protein, 9 aa, Artificial Sequence
  Cip1-interacting zinc finger protein (591-599)
RYFKTPRKF

SEQ ID NO: 11998 - protein, 9 aa, Artificial Sequence
  Signal transducer and activator of transcription 3 (93-101)
RYLEKPMEI

SEQ ID NO: 11999 - protein, 9 aa, Artificial Sequence
  Erythrocyte band 7 integral membrane protein (251-259)
RYLQTLTTI

SEQ ID NO: 12000 - protein, 9 aa, Artificial Sequence
  Telomerase protein component 1 (464-472)
RYPSNLQLF

SEQ ID NO: 12001 - protein, 9 aa, Artificial Sequence
  Histone H3.1 (41-49)
RYRPGTVAL

SEQ ID NO: 12002 - protein, 9 aa, Artificial Sequence
  26S proteasome non-ATPase regulatory subunit 6 (267-275)
RYSVFFQSL

SEQ ID NO: 12003 - protein, 9 aa, Artificial Sequence
  G1/S-specific cyclin-D3 (37-45)
RYVPRASYF

SEQ ID NO: 12004 - protein, 8 aa, Artificial Sequence
  Heterogeneous nuclear ribonucleoprotein H (23-30)
SADEVQRF

SEQ ID NO: 12005 - protein, 9 aa, Artificial Sequence
  Solute carrier family 35 member E1 (53-61)
SAFPFPVTV

SEQ ID NO: 12006 - protein, 11 aa, Artificial Sequence
  Probable 28S rRNA (cytosine(4447)-C(5))-methyltransferase (511-521)
SAIDSVNATSK

SEQ ID NO: 12007 - protein, 9 aa, Artificial Sequence
  Catenin alpha-2 (667-675)
SARAIMAQL

SEQ ID NO: 12008 - protein, 9 aa, Artificial Sequence
  Large proline-rich protein BAG6 (145-153)
SAVDVHINM

SEQ ID NO: 12009 - protein, 9 aa, Artificial Sequence
  Gamma-interferon-inducible protein 16 (280-288)
SEAGPNQTF

SEQ ID NO: 12010 - protein, 9 aa, Artificial Sequence
  Y-box-binding protein 3 (149-157)
SEDAEKKVL

SEQ ID NO: 12011 - protein, 9 aa, Artificial Sequence
  Proline-, glutamic acid- and leucine-rich protein 1 (231-239)
SEDGDAHVL

SEQ ID NO: 12012 - protein, 11 aa, Artificial Sequence
  Vacuolar protein sorting-associated protein 35 (500-510)
SEDPDQQYLIL

SEQ ID NO: 12013 - protein, 12 aa, Artificial Sequence
  Actin-binding protein anillin (796-807)
SEFMPSKGSVTL

SEQ ID NO: 12014 - protein, 9 aa, Artificial Sequence
  Actin-related protein 2 (295-303)
SEFYKHIVL

SEQ ID NO: 12015 - protein, 10 aa, Artificial Sequence
  Neutral amino acid transporter A (22-31)
SEGEDLIRFF

SEQ ID NO: 12016 - protein, 10 aa, Artificial Sequence
  HCLS1-binding protein 3 (72-81)
SEIEEFYQKL

SEQ ID NO: 12017 - protein, 9 aa, Artificial Sequence
  Poly (ADP-ribose) polymerase 1 (25-33)
SESIPKDSL

SEQ ID NO: 12018 - protein, 11 aa, Artificial Sequence
  ATP-citrate synthase (769-779)
SETAVAKNQAL

SEQ ID NO: 12019 - protein, 11 aa, Artificial Sequence
  Antigen KI-67 (2326-2336)
SETSGHTQESL

SEQ ID NO: 12020 - protein, 8 aa, Artificial Sequence
  40S ribosomal protein S23 (45-52)
SHAKGIVL

SEQ ID NO: 12021 - protein, 9 aa, Artificial Sequence
  Mitogen-activated protein kinase kinase kinase 1 (497-505)
SHDFYSHEL

SEQ ID NO: 12022 - protein, 11 aa, Artificial Sequence
  Bax inhibitor 1 (17-27)
SHITPSTQQHL

SEQ ID NO: 12023 - protein, 9 aa, Artificial Sequence
  Hypoxia-inducible factor 1-alpha (52-60)
SHLDKASVM

SEQ ID NO: 12024 - protein, 9 aa, Artificial Sequence
  Ubiquitin carboxyl-terminal hydrolase 37 (54-62)
SHNIKNVVL

SEQ ID NO: 12025 - protein, 9 aa, Artificial Sequence
  Protein-L-isoaspartate(D-aspartate) O-methyltransferase (9-17)
SHSELIHNL

SEQ ID NO: 12026 - protein, 9 aa, Artificial Sequence
  Cyclin-T1 (431-439)
SHSSVILKM

SEQ ID NO: 12027 - protein, 9 aa, Artificial Sequence
  Transcriptional activator Myb (257-265)
SHVPYPVAL

SEQ ID NO: 12028 - protein, 9 aa, Artificial Sequence
  Ubiquitin carboxyl-terminal hydrolase 22 (354-362)
SHVSGTTTL

SEQ ID NO: 12029 - protein, 9 aa, Artificial Sequence
  MAP kinase-activating death domain protein (181-189)
SHYPFFSTF

SEQ ID NO: 12030 - protein, 9 aa, Artificial Sequence
  Abnormal spindle-like microcephaly-associated protein (532-540)
SIFRTPISK

SEQ ID NO: 12031 - protein, 9 aa, Artificial Sequence
  ATPase family AAA domain-containing protein 5 (1793-1801)
SIIEYLPTL

SEQ ID NO: 12032 - protein, 9 aa, Artificial Sequence
  Exportin-4 (345-353)
SIISNLITV

SEQ ID NO: 12033 - protein, 9 aa, Artificial Sequence
  LIM domain and actin-binding protein 1 (168-176)
SIKDRMAKY

SEQ ID NO: 12034 - protein, 9 aa, Artificial Sequence
  GMP reductase 1 (115-123)
SILEAVPQV

SEQ ID NO: 12035 - protein, 9 aa, Artificial Sequence
  DNA replication licensing factor MCM4 (252-260)
SILEHQIQV

SEQ ID NO: 12036 - protein, 9 aa, Artificial Sequence
  Sperm-associated antigen 7 (79-87)
SILHDVVEV

SEQ ID NO: 12037 - protein, 9 aa, Artificial Sequence
  Regulation of nuclear pre-mRNA domain-containing protein 2 (432-440)
SILSSLTSV

SEQ ID NO: 12038 - protein, 9 aa, Artificial Sequence
  E3 ubiquitin-protein ligase TRIP12 (580-588)
SINAQRNAL

SEQ ID NO: 12039 - protein, 9 aa, Artificial Sequence
  Pre-mRNA-processing-splicing factor 8 (1693-1701)
SIYPSPTGV

SEQ ID NO: 12040 - protein, 10 aa, Artificial Sequence
  40S ribosomal protein S3a (70-79)
SLADLQNDEV

SEQ ID NO: 12041 - protein, 9 aa, Artificial Sequence
  All-trans-retinol 13,14-reductase (241-249)
SLAEVLQQL

SEQ ID NO: 12042 - protein, 11 aa, Artificial Sequence
  Condensin complex subunit 1 (928-938)
SLAGDVALQQL

SEQ ID NO: 12043 - protein, 9 aa, Artificial Sequence
  AP-3 complex subunit delta-1 (220-228)
SLAPLFFKL

SEQ ID NO: 12044 - protein, 9 aa, Artificial Sequence
  Poly(rC)-binding protein 1 (337-345)
SLAQYLINA

SEQ ID NO: 12045 - protein, 11 aa, Artificial Sequence
  Tyrosine-protein kinase Fer (665-675)
SLDAAAGMLYL

SEQ ID NO: 12046 - protein, 9 aa, Artificial Sequence
  Hemoglobin subunit alpha (29-37)
SLDKFLASV

SEQ ID NO: 12047 - protein, 9 aa, Artificial Sequence
  General transcription factor 3C polypeptide 1 (202-210)
SLDKTSHSV

SEQ ID NO: 12048 - protein, 9 aa, Artificial Sequence
  Regulator of nonsense transcripts 1 (683-691)
SLFERLVVL

SEQ ID NO: 12049 - protein, 9 aa, Artificial Sequence
  MKL/myocardin-like protein 2 (820-828)
SLFGSPVAK

SEQ ID NO: 12050 - protein, 10 aa, Artificial Sequence
  Protein flightless-1 homolog (1009-1018)
SLFPGKLEVV

SEQ ID NO: 12051 - protein, 10 aa, Artificial Sequence
  Cip1-interacting zinc finger protein (720-729)
SLGHFENLQK

SEQ ID NO: 12052 - protein, 9 aa, Artificial Sequence
  T-complex protein 1 subunit eta (301-309)
SLHDAIMIV

SEQ ID NO: 12053 - protein, 10 aa, Artificial Sequence
  Coronin-1B (173-182)
SLHPDLIYNV

SEQ ID NO: 12054 - protein, 9 aa, Artificial Sequence
  T-complex protein 1 subunit zeta-2 (75-83)
SLIAKVATA

SEQ ID NO: 12055 - protein, 9 aa, Artificial Sequence
  Tyrosine-protein kinase JAK2 (367-375)
SLIDGYYRL

SEQ ID NO: 12056 - protein, 10 aa, Artificial Sequence
  Acidic leucine-rich nuclear phosphoprotein 32 family member B (48-57)
SLINVGLISV

SEQ ID NO: 12057 - protein, 9 aa, Artificial Sequence
  Protein Smaug homolog 2 (238-246)
SLIPTSPQV

SEQ ID NO: 12058 - protein, 9 aa, Artificial Sequence
  Syntaxin-binding protein 2 (433-441)
SLIRNLEQL

SEQ ID NO: 12059 - protein, 9 aa, Artificial Sequence
  Phospholipase A-2-activating protein (670-678)
SLISTILEV

SEQ ID NO: 12060 - protein, 9 aa, Artificial Sequence
  Serine/threonine-protein phosphatase PP1-beta catalytic subunit (10-18)
SLITRLLEV

SEQ ID NO: 12061 - protein, 9 aa, Artificial Sequence
  Schlafen family member 5 (473-481)
SLKQKLVNK

SEQ ID NO: 12062 - protein, 9 aa, Artificial Sequence
  Caprin-1 (184-192)
SLLDEFYKL

SEQ ID NO: 12063 - protein, 10 aa, Artificial Sequence
  Macrophage erythroblast attacher (64-73)
SLLDGVVEKL

SEQ ID NO: 12064 - protein, 8 aa, Artificial Sequence
  Cyclin-I (71-78)
SLLDRFLA

SEQ ID NO: 12065 - protein, 10 aa, Artificial Sequence
  Cyclin-I (71-80)
SLLDRFLATV

SEQ ID NO: 12066 - protein, 11 aa, Artificial Sequence
  Splicing factor 3B subunit 3 (509-519)
SLLGDDALVQV

SEQ ID NO: 12067 - protein, 9 aa, Artificial Sequence
  Histidine triad nucleotide-binding protein 1 (72-80)
SLLGHLMIV

SEQ ID NO: 12068 - protein, 11 aa, Artificial Sequence
  Acyl-CoA desaturase (80-90)
SLLHLGALYGI

SEQ ID NO: 12069 - protein, 9 aa, Artificial Sequence
  Splicing factor 3B subunit 1 (643-651)
SLLPFLKAV

SEQ ID NO: 12070 - protein, 9 aa, Artificial Sequence
  Transformation/transcription domain-associated protein (819-827)
SLLPYLPML

SEQ ID NO: 12071 - protein, 9 aa, Artificial Sequence
  Histone acetyltransferase KAT2A (320-328)
SLLRSIFTV

SEQ ID NO: 12072 - protein, 9 aa, Artificial Sequence
  Mitotic spindle assembly checkpoint protein MAD2B (114-122)
SLLSHVEQL

SEQ ID NO: 12073 - protein, 9 aa, Artificial Sequence
  Gamma-secretase C-terminal fragment 59 (436-444)
SLLYNVPAV

SEQ ID NO: 12074 - protein, 10 aa, Artificial Sequence
  Syntenin-1 (289-298)
SLMDHTIPEV

SEQ ID NO: 12075 - protein, 9 aa, Artificial Sequence
  DNA topoisomerase 2-alpha (763-771)
SLMMTIINL

SEQ ID NO: 12076 - protein, 9 aa, Artificial Sequence
  Phospholipase A-2-activating protein (625-633)
SLMSHAIEL

SEQ ID NO: 12077 - protein, 9 aa, Artificial Sequence
  RecQ-mediated genome instability protein 1 (437-445)
SLNNKILNR

SEQ ID NO: 12078 - protein, 10 aa, Artificial Sequence
  A-kinase anchor protein 13 (131-140)
SLPTVIMRNK

SEQ ID NO: 12079 - protein, 9 aa, Artificial Sequence
  Lon protease homolog 2, peroxisomal (51-59)
SLQSTILGV

SEQ ID NO: 12080 - protein, 9 aa, Artificial Sequence
  Up-regulator of cell proliferation (550-558)
SLSEKQYFL

SEQ ID NO: 12081 - protein, 9 aa, Artificial Sequence
  Pleiotropic regulator 1 (232-240)
SLTGHISTV

SEQ ID NO: 12082 - protein, 9 aa, Artificial Sequence
  Tyrosine-protein kinase JAK1 (405-413)
SLVDGYFRL

SEQ ID NO: 12083 - protein, 9 aa, Artificial Sequence
  Long-chain-fatty-acid-CoA ligase 1 (410-418)
SLWDRLIFH

SEQ ID NO: 12084 - protein, 9 aa, Artificial Sequence
  Nucleoside diphosphate kinase (246-254)
SLWFKPEEL

SEQ ID NO: 12085 - protein, 9 aa, Artificial Sequence
  Eukaryotic translation initiation factor 3 subunit C-like protein (382-390)
SLYDYNPNL

SEQ ID NO: 12086 - protein, 9 aa, Artificial Sequence
  DNA repair and recombination protein RAD54B (618-626)
SLYKGLLSV

SEQ ID NO: 12087 - protein, 9 aa, Artificial Sequence
  C-myc promoter-binding protein (1841-1849)
SLYREILFL

SEQ ID NO: 12088 - protein, 9 aa, Artificial Sequence
  Molybdate-anion transporter (297-305)
SLYRIATSK

SEQ ID NO: 12089 - protein, 11 aa, Artificial Sequence
  60S ribosome subunit biogenesis protein NIP7 homolog (135-145)
SMADIPLGFGV

SEQ ID NO: 12090 - protein, 9 aa, Artificial Sequence
  Eukaryotic translation initiation factor 3 subunit L (348-356)
SMFQRTTYK

SEQ ID NO: 12091 - protein, 9 aa, Artificial Sequence
  Probable ATP-dependent RNA helicase DDX6 (451-459)
SNIDKSLYV

SEQ ID NO: 12092 - protein, 9 aa, Artificial Sequence
  Integrator complex subunit 5 (495-503)
SPAGLKAVL

SEQ ID NO: 12093 - protein, 9 aa, Artificial Sequence
  Centrosomal protein of 170 kDa (1260-1268)
SPALKTTRL

SEQ ID NO: 12094 - protein, 8 aa, Artificial Sequence
  Cellular tumor antigen p53 (2-9)
SPALNKMF

SEQ ID NO: 12095 - protein, 9 aa, Artificial Sequence
  E3 ubiquitin-protein ligase HUWE1 (376-384)
SPAPTITSL

SEQ ID NO: 12096 - protein, 9 aa, Artificial Sequence
  Type II inositol 3,4-bisphosphate 4-phosphatase (439-447)
SPDSLKNSL

SEQ ID NO: 12097 - protein, 9 aa, Artificial Sequence
  N6-adenosine-methyltransferase 70 kDa subunit (525-533)
SPGTRKIEL

SEQ ID NO: 12098 - protein, 9 aa, Artificial Sequence
  Integrator complex subunit 1 (254-262)
SPHGGALVM

SEQ ID NO: 12099 - protein, 9 aa, Artificial Sequence
  Protein CASC5 (837-845)
SPIEKSGVL

SEQ ID NO: 12100 - protein, 9 aa, Artificial Sequence
  Ephrin-A4 (18-26)
SPLRGGSSL

SEQ ID NO: 12101 - protein, 9 aa, Artificial Sequence
  Cullin-7 (801-809)
SPNTDREVL

SEQ ID NO: 12102 - protein, 9 aa, Artificial Sequence
  Tumor suppressor p53-binding protein 1 (1028-1036)
SPQKTMSVL

SEQ ID NO: 12103 - protein, 9 aa, Artificial Sequence
  Stromal interaction molecule 2 (531-539)
SPQPQRAQL

SEQ ID NO: 12104 - protein, 10 aa, Artificial Sequence
  Polyadenylate-binding protein-interacting protein 1 (120-129)
SPQSGNFRQL

SEQ ID NO: 12105 - protein, 9 aa, Artificial Sequence
  Proteasomal ATPase-associated factor 1 (195-203)
SPRAPVQVI

SEQ ID NO: 12106 - protein, 10 aa, Artificial Sequence
  Gephyrin (270-279)
SPRAQATSRL

SEQ ID NO: 12107 - protein, 9 aa, Artificial Sequence
  Tumor suppressor p53-binding protein 1 (1656-1664)
SPRASMGVL

SEQ ID NO: 12108 - protein, 10 aa, Artificial Sequence
  Ras-related protein Rab-7a (111-120)
SPRDPENFPF

SEQ ID NO: 12109 - protein, 9 aa, Artificial Sequence
  Ankyrin repeat and LEM domain-containing protein 2 (512-520)
SPRDPVLTL

SEQ ID NO: 12110 - protein, 9 aa, Artificial Sequence
  Helicase SKI2W (1016-1024)
SPRFPAQYL

SEQ ID NO: 12111 - protein, 11 aa, Artificial Sequence
  Pleckstrin homology domain-containing family G member 2 (45-55)
SPRGSGSSTSL

SEQ ID NO: 12112 - protein, 9 aa, Artificial Sequence
  Serine/threonine-protein kinase receptor R3 (5-13)
SPRKGLLML

SEQ ID NO: 12113 - protein, 9 aa, Artificial Sequence
  Procollagen-lysine,2-oxoglutarate 5-dioxygenase 2 (174-182)
SPRKGWSFM

SEQ ID NO: 12114 - protein, 9 aa, Artificial Sequence
  Tyrosine-protein kinase BAZ1B (197-205)
SPRKLPTSL

SEQ ID NO: 12115 - protein, 9 aa, Artificial Sequence
  Mitochondrial carrier homolog 1 (89-97)
SPRLMSNAL

SEQ ID NO: 12116 - protein, 10 aa, Artificial Sequence
  Intercellular adhesion molecule 1 (5-14)
SPRPALPALL

SEQ ID NO: 12117 - protein, 9 aa, Artificial Sequence
  AP-5 complex subunit mu-1 (117-125)
SPRPPLISV

SEQ ID NO: 12118 - protein, 9 aa, Artificial Sequence
  Integrator complex subunit 1 (211-219)
SPRPVALAL

SEQ ID NO: 12119 - protein, 11 aa, Artificial Sequence
  Nuclear receptor subfamily 1 group D member 1 (405-415)
SPRQGNSKNVL

SEQ ID NO: 12120 - protein, 9 aa, Artificial Sequence
  Sorbin and SH3 domain-containing protein 2 (230-238)
SPRSYSSTL

SEQ ID NO: 12121 - protein, 9 aa, Artificial Sequence
  Baculoviral IAP repeat-containing protein 6 (4258-4266)
SPRVPNSSV

SEQ ID NO: 12122 - protein, 11 aa, Artificial Sequence
  Thymidine kinase, cytosolic (13-23)
SPSKTRGQIQV

SEQ ID NO: 12123 - protein, 9 aa, Artificial Sequence
  Histone deacetylase 9 (322-330)
SPSLPNITL

SEQ ID NO: 12124 - protein, 8 aa, Artificial Sequence
  Nucleolin (67-74)
SPTKKVAV

SEQ ID NO: 12125 - protein, 9 aa, Artificial Sequence
  Nucleolar protein 11 (166-174)
SQDPGTHVV

SEQ ID NO: 12126 - protein, 9 aa, Artificial Sequence
  Unconventional myosin-If (124-132)
SRFGKYFEI

SEQ ID NO: 12127 - protein, 10 aa, Artificial Sequence
  DnaJ homolog subfamily B member 2 (131-140)
SRHSGPFFTF

SEQ ID NO: 12128 - protein, 9 aa, Artificial Sequence
  Hyccin (228-236)
SRIPVSSGF

SEQ ID NO: 12129 - protein, 9 aa, Artificial Sequence
  Merlin (587-595)
SRVAFFEEL

SEQ ID NO: 12130 - protein, 9 aa, Artificial Sequence
  Catenin beta-1 (341-349)
SRVLKVLSV

SEQ ID NO: 12131 - protein, 11 aa, Artificial Sequence
  Stomatin-like protein 2, mitochondrial (29-39)
SSGLPRNTVVL

SEQ ID NO: 12132 - protein, 9 aa, Artificial Sequence
  General transcription factor 3C polypeptide 2 (775-783)
SSGVPNPPK

SEQ ID NO: 12133 - protein, 10 aa, Artificial Sequence
  60S ribosomal protein L10a (2-11)
SSKVSRDTLY

SEQ ID NO: 12134 - protein, 9 aa, Artificial Sequence
  Ashwin (155-163)
SSNLPVNNK

SEQ ID NO: 12135 - protein, 9 aa, Artificial Sequence
  Transmembrane protein 176A (50-58)
SSRLLVASW

SEQ ID NO: 12136 - protein, 9 aa, Artificial Sequence
  Vimentin (72-80)
SSVPGVRLL

SEQ ID NO: 12137 - protein, 9 aa, Artificial Sequence
  Synaptotagmin-like protein 2 (282-290)
STDSETLRY

SEQ ID NO: 12138 - protein, 9 aa, Artificial Sequence
  Ribosomal protein S6 kinase alpha-3 (327-335)
STIDWNKLY

SEQ ID NO: 12139 - protein, 11 aa, Artificial Sequence
  Serine/threonine-protein kinase RIO2 (494-504)
STIPPELVKQK

SEQ ID NO: 12140 - protein, 12 aa, Artificial Sequence
  AP-3 complex subunit beta-1 (26-37)
STISPSGAFGLF

SEQ ID NO: 12141 - protein, 11 aa, Artificial Sequence
  Forkhead box protein O1 (544-554)
STMPHTSGMNR

SEQ ID NO: 12142 - protein, 9 aa, Artificial Sequence
  ATP-dependent RNA helicase DDX3X (410-418)
STSENITQK

SEQ ID NO: 12143 - protein, 10 aa, Artificial Sequence
  Elongation factor 1-alpha 1 (21-30)
STTTGHLIYK

SEQ ID NO: 12144 - protein, 9 aa, Artificial Sequence
  Protein STON1-GTF2A1L (339-347)
SVAGKIHTV

SEQ ID NO: 12145 - protein, 10 aa, Artificial Sequence
  Lysine-specific demethylase 7A (208-217)
SVFPKPFVQK

SEQ ID NO: 12146 - protein, 10 aa, Artificial Sequence
  Round spermatid basic protein 1-like protein (733-742)
SVFSDKLHSK

SEQ ID NO: 12147 - protein, 10 aa, Artificial Sequence
  Disintegrin and metalloproteinase domain-containing protein 10 (118-127)
SVIDGRFEGF

SEQ ID NO: 12148 - protein, 9 aa, Artificial Sequence
  Inactive phospholipase C-like protein 2 (372-380)
SVIDIINKY

SEQ ID NO: 12149 - protein, 9 aa, Artificial Sequence
  E3 ubiquitin-protein ligase UBR2 (812-820)
SVIEAVAHF

SEQ ID NO: 12150 - protein, 9 aa, Artificial Sequence
  Transcription factor MafG (149-157)
SVITIVKSK

SEQ ID NO: 12151 - protein, 10 aa, Artificial Sequence
  Probable E3 ubiquitin-protein ligase HERC4 (549-558)
SVLEPPLFLK

SEQ ID NO: 12152 - protein, 10 aa, Artificial Sequence
  40S ribosomal protein S6 (105-114)
SVLNLVIVKK

SEQ ID NO: 12153 - protein, 10 aa, Artificial Sequence
  Pumilio homolog 1 (183-192)
SVSQPIMVQR

SEQ ID NO: 12154 - protein, 9 aa, Artificial Sequence
  Phosphatidylinositol 3-kinase regulatory subunit gamma (51-59)
SVVELINHY

SEQ ID NO: 12155 - protein, 9 aa, Artificial Sequence
  Dolichyl-diphosphooligosaccharide-proteinosyltransferase subunit DAD1 (4-12)
SVVSVISRF

SEQ ID NO: 12156 - protein, 9 aa, Artificial Sequence
  Protein TBRG4 (151-159)
SVWHGTLSK

SEQ ID NO: 12157 - protein, 9 aa, Artificial Sequence
  Nesprin-1 (4541-4549)
SVYDSVLQK

SEQ ID NO: 12158 - protein, 11 aa, Artificial Sequence
  Protein ELYS (1415-1425)
SVYEGKIFTQK

SEQ ID NO: 12159 - protein, 10 aa, Artificial Sequence
  ATPase family AAA domain-containing protein 2 (757-766)
SVYENGLSQK

SEQ ID NO: 12160 - protein, 9 aa, Artificial Sequence
  Type I inositol 1,4,5-trisphosphate 5-phosphatase (94-102)
SVYSGIRHK

SEQ ID NO: 12161 - protein, 9 aa, Artificial Sequence
  Disks large homolog 3 (45-53)
SYGDILHVI

SEQ ID NO: 12162 - protein, 9 aa, Artificial Sequence
  Long-chain-fatty-acid-CoA ligase 5 (359-367)
SYLPLAHMF

SEQ ID NO: 12163 - protein, 9 aa, Artificial Sequence
  Trafficking protein particle complex subunit 1 (132-140)
SYVRSLPFF

SEQ ID NO: 12164 - protein, 9 aa, Artificial Sequence
  HLA class I histocompatibility antigen, B-15 alpha chain (158-166)
TAADTAAQI

SEQ ID NO: 12165 - protein, 9 aa, Artificial Sequence
  Bromodomain testis-specific protein (144-152)
TAAPPAQPL

SEQ ID NO: 12166 - protein, 8 aa, Artificial Sequence
  Heterochromatin protein 1-binding protein 3 (363-370)
TALKKYVL

SEQ ID NO: 12167 - protein, 8 aa, Artificial Sequence
  Probable E3 ubiquitin-protein ligase HERC4 (592-599)
TALKVLEI

SEQ ID NO: 12168 - protein, 8 aa, Artificial Sequence
  Histone H1.3 (4-11)
TAPLAPTI

SEQ ID NO: 12169 - protein, 9 aa, Artificial Sequence
  Malectin (10-18)
TAVALLRLL

SEQ ID NO: 12170 - protein, 9 aa, Artificial Sequence
  Glyoxalase domain-containing protein 4 (117-125)
TEAPGGYKF

SEQ ID NO: 12171 - protein, 9 aa, Artificial Sequence
  SRSF protein kinase 2 (529-537)
TEDIQTRQY

SEQ ID NO: 12172 - protein, 12 aa, Artificial Sequence
  Twinfilin-2 (164-175)
TEISVESKHQTL

SEQ ID NO: 12173 - protein, 9 aa, Artificial Sequence
  Nucleolar protein 14 (741-749)
TEMESQKQL

SEQ ID NO: 12174 - protein, 9 aa, Artificial Sequence
  ATPase WRNIP1 (477-485)
TENDVKEGL

SEQ ID NO: 12175 - protein, 10 aa, Artificial Sequence
  4F2 cell-surface antigen heavy chain (5-14)
TEVDMKEVEL

SEQ ID NO: 12176 - protein, 9 aa, Artificial Sequence
  Transgelin (191-199)
TGYGRPRQI

SEQ ID NO: 12177 - protein, 9 aa, Artificial Sequence
  Splicing factor 3A subunit 3 (238-246)
THAGAHLDL

SEQ ID NO: 12178 - protein, 9 aa, Artificial Sequence
  Histone-binding protein RBBP4 (37-45)
THALEWPSL

SEQ ID NO: 12179 - protein, 9 aa, Artificial Sequence
  Bifunctional glutamate/proline-tRNA ligase (614-622)
THALPIPVI

SEQ ID NO: 12180 - protein, 9 aa, Artificial Sequence
  Activator of 90 kDa heat shock protein ATPase homolog 1 (236-244)
THAPATLEA

SEQ ID NO: 12181 - protein, 9 aa, Artificial Sequence
  Integrin beta-7 (446-454)
THCLPEPHL

SEQ ID NO: 12182 - protein, 10 aa, Artificial Sequence
  Echinoderm microtubule-associated protein-like 3 (848-857)
THDDSHLVSL

SEQ ID NO: 12183 - protein, 9 aa, Artificial Sequence
  Double-stranded RNA-specific adenosine deaminase (1054-1062)
THFLQPIYL

SEQ ID NO: 12184 - protein, 9 aa, Artificial Sequence
  Histone deacetylase complex subunit SAP18 (85-93)
THFNFAIVF

SEQ ID NO: 12185 - protein, 9 aa, Artificial Sequence
  Ubiquitin carboxyl-terminal hydrolase 34 (2105-2113)
THFSFPLRL

SEQ ID NO: 12186 - protein, 9 aa, Artificial Sequence
  Syntaxin-binding protein 1 (570-578)
THILTPQKL

SEQ ID NO: 12187 - protein, 10 aa, Artificial Sequence
  Telomere-associated protein RIF1 (62-71)
THISSQNSEL

SEQ ID NO: 12188 - protein, 10 aa, Artificial Sequence
  RE1-silencing transcription factor (917-926)
THISSSGQNL

SEQ ID NO: 12189 - protein, 9 aa, Artificial Sequence
  Microtubule-actin cross-linking factor 1, isoforms 1/2/3/5 (6374-6382)
THMELYSQL

SEQ ID NO: 12190 - protein, 9 aa, Artificial Sequence
  ATP-citrate synthase (409-417)
THMTAIVGM

SEQ ID NO: 12191 - protein, 9 aa, Artificial Sequence
  Protein tyrosine phosphatase type IVA 1 (22-30)
THNPTNATL

SEQ ID NO: 12192 - protein, 9 aa, Artificial Sequence
  Phospholipase D3 (389-397)
THSDIQVKL

SEQ ID NO: 12193 - protein, 9 aa, Artificial Sequence
  General transcription factor IIH subunit 5 (41-49)
THVFVIAEL

SEQ ID NO: 12194 - protein, 10 aa, Artificial Sequence
  DNA replication licensing factor MCM6 (781-790)
THYDHVLIEL

SEQ ID NO: 12195 - protein, 9 aa, Artificial Sequence
  Microfibrillar-associated protein 1 (372-380)
TILPKVMQV

SEQ ID NO: 12196 - protein, 9 aa, Artificial Sequence
  Putative protein arginine N-methyltransferase 9 (164-172)
TIYNAAIQK

SEQ ID NO: 12197 - protein, 9 aa, Artificial Sequence
  Protein NYNRIN (1487-1495)
TLADIIARL

SEQ ID NO: 12198 - protein, 9 aa, Artificial Sequence
  Ankyrin repeat and KH domain-containing protein 1 (1028-1036)
TLDDLIAAV

SEQ ID NO: 12199 - protein, 9 aa, Artificial Sequence
  TGF-beta-activated kinase 1 and MAP3K7-binding protein 1 (426-434)
TLDEATPTL

SEQ ID NO: 12200 - protein, 9 aa, Artificial Sequence
  Exocyst complex component 1 (91-99)
TLGNVLVTV

SEQ ID NO: 12201 - protein, 10 aa, Artificial Sequence
  Spliceosome RNA helicase DDX39B (114-123)
TLHGLQQYYV

SEQ ID NO: 12202 - protein, 9 aa, Artificial Sequence
  Hexokinase-1 (35-43)
TLIDIMTRF

SEQ ID NO: 12203 - protein, 9 aa, Artificial Sequence
  Short transient receptor potential channel 4-associated protein (209-217)
TLIEDILGV

SEQ ID NO: 12204 - protein, 9 aa, Artificial Sequence
  Cullin-7 (386-394)
TLISELVQA

SEQ ID NO: 12205 - protein, 11 aa, Artificial Sequence
  T-complex protein 1 subunit eta (11-21)
TLLAAEFLKQV

SEQ ID NO: 12206 - protein, 11 aa, Artificial Sequence
  NADH-cytochrome b5 reductase 1 (39-49)
TLLDPNEKYLL

SEQ ID NO: 12207 - protein, 9 aa, Artificial Sequence
  Centrosomal protein POC5 (254-262)
TLLKKVWKV

SEQ ID NO: 12208 - protein, 9 aa, Artificial Sequence
  Protrudin (88-96)
TLLNSTLFL

SEQ ID NO: 12209 - protein, 9 aa, Artificial Sequence
  Eukaryotic translation initiation factor 3 subunit M (163-171)
TLLRLLYEA

SEQ ID NO: 12210 - protein, 9 aa, Artificial Sequence
  DNA mismatch repair protein Msh6 (739-747)
TLNNLEIFL

SEQ ID NO: 12211 - protein, 9 aa, Artificial Sequence
  Protein SDA1 homolog (404-412)
TLNPQMLQK

SEQ ID NO: 12212 - protein, 9 aa, Artificial Sequence
  Testis-expressed sequence 10 protein (436-444)
TLSDIMVSL

SEQ ID NO: 12213 - protein, 9 aa, Artificial Sequence
  Transcription initiation factor TFIID subunit 8 (89-97)
TLSDIVVTL

SEQ ID NO: 12214 - protein, 9 aa, Artificial Sequence
  Serine/threonine-protein kinase SIK2 (269-277)
TLSEVTNQL

SEQ ID NO: 12215 - protein, 9 aa, Artificial Sequence
  MAP kinase-activating death domain protein (291-299)
TLVDFPLHL

SEQ ID NO: 12216 - protein, 11 aa, Artificial Sequence
  Motile sperm domain-containing protein 1 (39-49)
TLYNPYEFALK

SEQ ID NO: 12217 - protein, 9 aa, Artificial Sequence
  Chondroitin sulfate proteoglycan 4 (21-29)
TMLARLASA

SEQ ID NO: 12218 - protein, 9 aa, Artificial Sequence
  Poly (ADP-ribose) polymerase 14 (1511-1519)
TMNEKQLFH

SEQ ID NO: 12219 - protein, 9 aa, Artificial Sequence
  ATP-binding cassette sub-family F member 2 (218-226)
TPAMQRKKL

SEQ ID NO: 12220 - protein, 9 aa, Artificial Sequence
  Splicing factor, arginine/serine-rich 19 (1147-1155)
TPAPVPTSL

SEQ ID NO: 12221 - protein, 9 aa, Artificial Sequence
  SCAN domain-containing protein 1 (132-140)
TPGPAGSRL

SEQ ID NO: 12222 - protein, 9 aa, Artificial Sequence
  Dolichyl-diphosphooligosaccharide-proteinosyltransferase subunit 2 (291-299)
TPHQTFVRL

SEQ ID NO: 12223 - protein, 9 aa, Artificial Sequence
  Protein ELYS (1773-1781)
TPKMPGQSV

SEQ ID NO: 12224 - protein, 9 aa, Artificial Sequence
  Microtubule-associated protein 4 (892-900)
TPMPSRPST

SEQ ID NO: 12225 - protein, 8 aa, Artificial Sequence
  Nucleophosmin (95-102)
TPPVVLRL

SEQ ID NO: 12226 - protein, 11 aa, Artificial Sequence
  Filamin-A (812-822)
TPRGAGSYTIM

SEQ ID NO: 12227 - protein, 11 aa, Artificial Sequence
  40S ribosomal protein S9 (15-25)
TPRRPFEKSRL

SEQ ID NO: 12228 - protein, 9 aa, Artificial Sequence
  BTB/POZ domain-containing adapter for CUL3-mediated RhoA degradation protein 2 (290-298)
TPRVPDNSL

SEQ ID NO: 12229 - protein, 9 aa, Artificial Sequence
  Sentrin-specific protease 3 (353-361)
TPSRKGLVL

SEQ ID NO: 12230 - protein, 8 aa, Artificial Sequence
  Interferon regulatory factor 1 (54-61)
TPVRLPSI

SEQ ID NO: 12231 - protein, 9 aa, Artificial Sequence
  Replication protein A 70 kDa DNA-binding subunit (191-199)
TPYQSKWTI

SEQ ID NO: 12232 - protein, 9 aa, Artificial Sequence
  Splicing factor U2AF 65 kDa subunit (179-187)
TQAPGNPVL

SEQ ID NO: 12233 - protein, 9 aa, Artificial Sequence
  GPN-loop GTPase 1 (88-96)
TRFDQVMKF

SEQ ID NO: 12234 - protein, 9 aa, Artificial Sequence
  RuvB-like 2 (391-399)
TRIGLETSL

SEQ ID NO: 12235 - protein, 9 aa, Artificial Sequence
  40S ribosomal protein S4, Y isoform 2 (220-228)
TRISNIFVI

SEQ ID NO: 12236 - protein, 9 aa, Artificial Sequence
  40S ribosomal protein S4, X isoform (201-209)
TRLSNIFVI

SEQ ID NO: 12237 - protein, 9 aa, Artificial Sequence
  Transmembrane protein 147 (157-165)
TRYDLYHTF

SEQ ID NO: 12238 - protein, 10 aa, Artificial Sequence
  Transcriptional regulator Kaiso (365-374)
TSFDGSLIQK

SEQ ID NO: 12239 - protein, 8 aa, Artificial Sequence
  HCG2043421, isoform CRA_c (58-65)
TSKQPVGF

SEQ ID NO: 12240 - protein, 9 aa, Artificial Sequence
  WD repeat-containing protein 78 (675-683)
TSVVYDVAW

SEQ ID NO: 12241 - protein, 9 aa, Artificial Sequence
  Non-POU domain-containing octamer-binding protein (127-135)
TTFPRPVTV

SEQ ID NO: 12242 - protein, 11 aa, Artificial Sequence
  Nicotinamide phosphoribosyltransferase (220-230)
TVAGLALIKKY

SEQ ID NO: 12243 - protein, 9 aa, Artificial Sequence
  1,2-dihydroxy-3-keto-5-methylthiopentene dioxygenase (150-158)
TVDEKNYTK

SEQ ID NO: 12244 - protein, 10 aa, Artificial Sequence
  Aldehyde dehydrogenase family 16 member A1 (661-670)
TVFPAGLANV

SEQ ID NO: 12245 - protein, 9 aa, Artificial Sequence
  Protein phosphatase 1D (261-269)
TVIDQIPFL

SEQ ID NO: 12246 - protein, 9 aa, Artificial Sequence
  Integrin beta-7 (200-208)
TVLPFVSTV

SEQ ID NO: 12247 - protein, 9 aa, Artificial Sequence
  Caspase-1 (49-57)
TVMDKTRAL

SEQ ID NO: 12248 - protein, 9 aa, Artificial Sequence
  Kelch-like protein 8 (200-208)
TVMGKIFAV

SEQ ID NO: 12249 - protein, 9 aa, Artificial Sequence
  CMP-N-acetylneuraminate-beta-galactosamide-alpha-2,3-sialyltransf erase 1 (229-237)
TYIPVPAKI

SEQ ID NO: 12250 - protein, 9 aa, Artificial Sequence
  Vacuolar protein sorting-associated protein 13C (2564-2572)
TYISWKEEL

SEQ ID NO: 12251 - protein, 9 aa, Artificial Sequence
  Rho GTPase-activating protein 18 (597-605)
TYMKDLYQL

SEQ ID NO: 12252 - protein, 9 aa, Artificial Sequence
  Plexin-B2 (1279-1287)
TYTDRVFFL

SEQ ID NO: 12253 - protein, 9 aa, Artificial Sequence
  Poly (ADP-ribose) polymerase 14 (1544-1552)
VAYGKGTYF

SEQ ID NO: 12254 - protein, 9 aa, Artificial Sequence
  Zinc finger SWIM domain-containing protein 1 (322-330)
VESHIQHSL

SEQ ID NO: 12255 - protein, 9 aa, Artificial Sequence
  Putative 40S ribosomal protein S10-like (27-35)
VHMPKHPEL

SEQ ID NO: 12256 - protein, 10 aa, Artificial Sequence
  Inosine-5'-monophosphate dehydrogenase 2 (361-370)
VIADGGIQNV

SEQ ID NO: 12257 - protein, 9 aa, Artificial Sequence
  Protein DENND6A (261-269)
VILPTVHEV

SEQ ID NO: 12258 - protein, 9 aa, Artificial Sequence
  N-glycosylase/DNA lyase (58-66)
VLADQVWTL

SEQ ID NO: 12259 - protein, 9 aa, Artificial Sequence
  CREB-binding protein (238-246)
VLAETLTQV

SEQ ID NO: 12260 - protein, 9 aa, Artificial Sequence
  Transmembrane protein 209 (29-37)
VLAWGLLNV

SEQ ID NO: 12261 - protein, 9 aa, Artificial Sequence
  Kelch-like protein 5 (324-332)
VLDDKLYVV

SEQ ID NO: 12262 - protein, 9 aa, Artificial Sequence
  RNA-binding protein 40 (490-498)
VLFGKPMVV

SEQ ID NO: 12263 - protein, 9 aa, Artificial Sequence
  Pre-mRNA-splicing factor ATP-dependent RNA helicase PRP16 (663-671)
VLFGLLREV

SEQ ID NO: 12264 - protein, 12 aa, Artificial Sequence
  Translocon-associated protein subunit alpha (19-30)
VLFRGGPRGLLA

SEQ ID NO: 12265 - protein, 12 aa, Artificial Sequence
  Translocon-associated protein subunit alpha (19-30)
VLFRGGPRGSLA

SEQ ID NO: 12266 - protein, 11 aa, Artificial Sequence
  Major prion protein (226-236)
VLFSSPPVILL

SEQ ID NO: 12267 - protein, 9 aa, Artificial Sequence
  Fibroblast growth factor receptor substrate 2 (252-260)
VLGPTPVQK

SEQ ID NO: 12268 - protein, 10 aa, Artificial Sequence
  Actin-related protein 2/3 complex subunit 4 (61-70)
VLIEGSINSV

SEQ ID NO: 12269 - protein, 10 aa, Artificial Sequence
  mRNA cap guanine-N7 methyltransferase (182-191)
VLIGEFLEKV

SEQ ID NO: 12270 - protein, 10 aa, Artificial Sequence
  Trabeculin-alpha (4505-4514)
VLIKNLLVSV

SEQ ID NO: 12271 - protein, 9 aa, Artificial Sequence
  ATP-binding cassette sub-family F member 3 (85-93)
VLLDAPIQL

SEQ ID NO: 12272 - protein, 9 aa, Artificial Sequence
  Vacuolar protein sorting-associated protein 8 homolog (414-422)
VLLDSVEKL

SEQ ID NO: 12273 - protein, 10 aa, Artificial Sequence
  Fragile X mental retardation protein 1 (19-28)
VLLDYHLNYL

SEQ ID NO: 12274 - protein, 9 aa, Artificial Sequence
  Signal recognition particle 14 kDa protein (2-10)
VLLESEQFL

SEQ ID NO: 12275 - protein, 12 aa, Artificial Sequence
  Signal recognition particle 14 kDa protein (2-13)
VLLESEQFLTEL

SEQ ID NO: 12276 - protein, 9 aa, Artificial Sequence
  Leucine-tRNA ligase, cytoplasmic (328-336)
VLMENIVYL

SEQ ID NO: 12277 - protein, 10 aa, Artificial Sequence
  E3 ubiquitin-protein ligase MARCH6 (457-466)
VLPNFLPYNV

SEQ ID NO: 12278 - protein, 9 aa, Artificial Sequence
  DNA replication licensing factor MCM5 (120-128)
VLQDIQVML

SEQ ID NO: 12279 - protein, 9 aa, Artificial Sequence
  Sarcolemmal membrane-associated protein (140-148)
VLQEKIEVV

SEQ ID NO: 12280 - protein, 9 aa, Artificial Sequence
  Trabeculin-alpha (2088-2096)
VLQGKLAEV

SEQ ID NO: 12281 - protein, 9 aa, Artificial Sequence
  Cytoplasmic dynein 1 heavy chain 1 (1781-1789)
VLSNVEVTL

SEQ ID NO: 12282 - protein, 9 aa, Artificial Sequence
  5-formyltetrahydrofolate cyclo-ligase (35-43)
VLSQKVIAH

SEQ ID NO: 12283 - protein, 8 aa, Artificial Sequence
  Signal transducer and activator of transcription 1-alpha/beta (300-307)
VLWDRTFS

SEQ ID NO: 12284 - protein, 10 aa, Artificial Sequence
  Signal transducer and activator of transcription 1-alpha/beta (300-309)
VLWDRTFSLF

SEQ ID NO: 12285 - protein, 9 aa, Artificial Sequence
  Pre-rRNA-processing protein TSR1 homolog (678-686)
VLWFKPVEL

SEQ ID NO: 12286 - protein, 9 aa, Artificial Sequence
  Dolichol-phosphate mannosyltransferase subunit 3 (58-66)
VLWPLPAYL

SEQ ID NO: 12287 - protein, 11 aa, Artificial Sequence
  Msx2-interacting protein (557-567)
VLYNEIEYAQA

SEQ ID NO: 12288 - protein, 9 aa, Artificial Sequence
  2',5'-phosphodiesterase 12 (419-427)
VLYPSAQEK

SEQ ID NO: 12289 - protein, 9 aa, Artificial Sequence
  Serine/threonine-protein kinase ATR (2265-2273)
VMIPTLPSI

SEQ ID NO: 12290 - protein, 9 aa, Artificial Sequence
  Receptor-type tyrosine-protein phosphatase U (975-983)
VMITKLVEV

SEQ ID NO: 12291 - protein, 9 aa, Artificial Sequence
  Translocon-associated protein subunit gamma (64-72)
VMTLVSTYL

SEQ ID NO: 12292 - protein, 8 aa, Artificial Sequence
  60S ribosomal protein L13a (120-127)
VPAALKVV

SEQ ID NO: 12293 - protein, 9 aa, Artificial Sequence
  Ankyrin repeat and KH domain-containing protein 1 (1721-1729)
VPASVVSRI

SEQ ID NO: 12294 - protein, 9 aa, Artificial Sequence
  Protein UXT (95-103)
VPDTSRIYV

SEQ ID NO: 12295 - protein, 9 aa, Artificial Sequence
  Guanine nucleotide-binding protein-like 3 (295-303)
VPLDKQITI

SEQ ID NO: 12296 - protein, 9 aa, Artificial Sequence
  Pumilio homolog 1 (345-353)
VPLDPMEHV

SEQ ID NO: 12297 - protein, 9 aa, Artificial Sequence
  Myotubularin (85-93)
VPLGVISRI

SEQ ID NO: 12298 - protein, 8 aa, Artificial Sequence
  Ran-binding protein 6 (956-963)
VPLLVKVI

SEQ ID NO: 12299 - protein, 9 aa, Artificial Sequence
  Cytoplasmic dynein 1 heavy chain 1 (2524-2532)
VPLPTAPNI

SEQ ID NO: 12300 - protein, 9 aa, Artificial Sequence
  Transcriptional regulator Kaiso (118-126)
VPLSQVKSI

SEQ ID NO: 12301 - protein, 9 aa, Artificial Sequence
  Transcription factor Sp4 (217-225)
VPNLQTVSV

SEQ ID NO: 12302 - protein, 9 aa, Artificial Sequence
  L-lactate dehydrogenase B chain (19-27)
VPNNKITVV

SEQ ID NO: 12303 - protein, 9 aa, Artificial Sequence
  Histone deacetylase complex subunit SAP130 (800-808)
VPPLATNTV

SEQ ID NO: 12304 - protein, 10 aa, Artificial Sequence
  Endoplasmic reticulum resident protein 29 (5-14)
VPRAAFLSPL

SEQ ID NO: 12305 - protein, 9 aa, Artificial Sequence
  Myotubularin (35-43)
VPRLPGETL

SEQ ID NO: 12306 - protein, 9 aa, Artificial Sequence
  Adapter protein CIKS (387-395)
VPRPPSNPP

SEQ ID NO: 12307 - protein, 9 aa, Artificial Sequence
  Histone H2A deubiquitinase MYSM1 (446-454)
VPRPTKSSF

SEQ ID NO: 12308 - protein, 10 aa, Artificial Sequence
  PDZ and LIM domain protein 5 (203-212)
VPRQPTVTSV

SEQ ID NO: 12309 - protein, 11 aa, Artificial Sequence
  Filamin-A (1503-1513)
VPRSPFKVKVL

SEQ ID NO: 12310 - protein, 9 aa, Artificial Sequence
  Ankyrin repeat domain-containing protein 40 (223-231)
VPSKPPMSL

SEQ ID NO: 12311 - protein, 9 aa, Artificial Sequence
  Uroporphyrinogen decarboxylase (106-114)
VPYLVGQVV

SEQ ID NO: 12312 - protein, 8 aa, Artificial Sequence
  Puromycin-sensitive aminopeptidase-like protein (298-305)
VPYPLPKI

SEQ ID NO: 12313 - protein, 12 aa, Artificial Sequence
  Elongation factor 1-beta (214-225)
VQSMDVAAFNKI

SEQ ID NO: 12314 - protein, 10 aa, Artificial Sequence
  DNA repair protein RAD51 homolog 3 (23-32)
VRVKLVSAGF

SEQ ID NO: 12315 - protein, 9 aa, Artificial Sequence
  CGG triplet repeat-binding protein 1 (6-14)
VTAPPARNR

SEQ ID NO: 12316 - protein, 9 aa, Artificial Sequence
  UDP-N-acetylhexosamine pyrophosphorylase-like protein 1 (35-43)
VTYPKGMYR

SEQ ID NO: 12317 - protein, 9 aa, Artificial Sequence
  Transformation/transcription domain-associated protein (246-254)
VVAEFVPLI

SEQ ID NO: 12318 - protein, 9 aa, Artificial Sequence
  Ubiquitin carboxyl-terminal hydrolase BAP1 (172-180)
VVKPPGSSL

SEQ ID NO: 12319 - protein, 9 aa, Artificial Sequence
  Ran-binding protein 9 (33-41)
VVLPAPPAV

SEQ ID NO: 12320 - protein, 10 aa, Artificial Sequence
  ATP-dependent DNA helicase Q1 (430-439)
VVMENVGQQK

SEQ ID NO: 12321 - protein, 9 aa, Artificial Sequence
  Heterogeneous nuclear ribonucleoprotein A1 (44-52)
VVMRDPNTK

SEQ ID NO: 12322 - protein, 10 aa, Artificial Sequence
  G2/mitotic-specific cyclin-B1 (387-396)
VVMVNQGLTK

SEQ ID NO: 12323 - protein, 9 aa, Artificial Sequence
  Ral GTPase-activating protein subunit beta (37-45)
VVRPLGQVL

SEQ ID NO: 12324 - protein, 9 aa, Artificial Sequence
  CTD small phosphatase-like protein 2 (354-362)
VYADKLLNI

SEQ ID NO: 12325 - protein, 9 aa, Artificial Sequence
  Sorting nexin-8 (400-408)
VYLPLTSHI

SEQ ID NO: 12326 - protein, 9 aa, Artificial Sequence
  Tuftelin-interacting protein 11 (428-436)
VYPLMKEYF

SEQ ID NO: 12327 - protein, 9 aa, Artificial Sequence
  Syntaxin-binding protein 6 (92-100)
WMLEQLRQV

SEQ ID NO: 12328 - protein, 9 aa, Artificial Sequence
  Protein syndesmos (33-41)
YAANPGQLF

SEQ ID NO: 12329 - protein, 9 aa, Artificial Sequence
  Heat shock cognate 71 kDa protein (545-553)
YAFNMKATV

SEQ ID NO: 12330 - protein, 9 aa, Artificial Sequence
  HLA class I histocompatibility antigen, alpha chain G (115-123)
YAYDGKDYL

SEQ ID NO: 12331 - protein, 10 aa, Artificial Sequence
  RHO/RAC effector protein (1011-1020)
YEIDMKQYTL

SEQ ID NO: 12332 - protein, 9 aa, Artificial Sequence
  Actin, alpha skeletal muscle (36-44)
YELPDGQVI

SEQ ID NO: 12333 - protein, 12 aa, Artificial Sequence
  Mitogen-activated protein kinase kinase kinase 6 (112-123)
YEYTETGERLVL

SEQ ID NO: 12334 - protein, 9 aa, Artificial Sequence
  Gametogenetin-binding protein 2 (25-33)
YIDDTLTMV

SEQ ID NO: 12335 - protein, 9 aa, Artificial Sequence
  ATP-dependent 6-phosphofructokinase, muscle type (292-300)
YIFEEPFTI

SEQ ID NO: 12336 - protein, 9 aa, Artificial Sequence
  Sphingomyelin phosphodiesterase 4 (105-113)
YKFDFPVSY

SEQ ID NO: 12337 - protein, 9 aa, Artificial Sequence
  Microsomal glutathione S-transferase 3 (36-44)
YKVEYPIMY

SEQ ID NO: 12338 - protein, 9 aa, Artificial Sequence
  Zinc finger BED domain-containing protein 5 (476-484)
YLADIFTKL

SEQ ID NO: 12339 - protein, 9 aa, Artificial Sequence
  SH3 domain-binding protein 1 (145-153)
YLADLYHFV

SEQ ID NO: 12340 - protein, 9 aa, Artificial Sequence
  E3 ubiquitin-protein ligase UBR4 (824-832)
YLADVTNAL

SEQ ID NO: 12341 - protein, 9 aa, Artificial Sequence
  Exportin-4 (318-326)
YLAHFIEGL

SEQ ID NO: 12342 - protein, 9 aa, Artificial Sequence
  ATP-dependent RNA helicase DHX8 (756-764)
YLDASLITV

SEQ ID NO: 12343 - protein, 10 aa, Artificial Sequence
  ADP-ribosylation factor-like protein 6-interacting protein 1 (32-41)
YLDPSVLSGV

SEQ ID NO: 12344 - protein, 11 aa, Artificial Sequence
  Protein dpy-30 homolog (56-66)
YLDQTVVPILL

SEQ ID NO: 12345 - protein, 10 aa, Artificial Sequence
  Trafficking protein particle complex subunit 1 (7-16)
YLFDRNGVCL

SEQ ID NO: 12346 - protein, 8 aa, Artificial Sequence
  Sphingomyelin phosphodiesterase 2 (372-379)
YLFHVQEV

SEQ ID NO: 12347 - protein, 9 aa, Artificial Sequence
  Protein yippee-like 1 (49-57)
YLFNSVVNV

SEQ ID NO: 12348 - protein, 9 aa, Artificial Sequence
  Coatomer subunit alpha (738-746)
YLGDVSERV

SEQ ID NO: 12349 - protein, 9 aa, Artificial Sequence
  26S protease regulatory subunit 6B (239-247)
YLGEGPRMV

SEQ ID NO: 12350 - protein, 9 aa, Artificial Sequence
  U2 snRNP-associated SURP motif-containing protein (276-284)
YLGNINPQM

SEQ ID NO: 12351 - protein, 9 aa, Artificial Sequence
  Mortality factor 4-like protein 1 (290-298)
YLHDFLKYL

SEQ ID NO: 12352 - protein, 11 aa, Artificial Sequence
  Coatomer subunit epsilon (127-137)
YLHDQNPDAAL

SEQ ID NO: 12353 - protein, 9 aa, Artificial Sequence
  Antigen peptide transporter 2 (25-33)
YLHSQVVSV

SEQ ID NO: 12354 - protein, 9 aa, Artificial Sequence
  Signal recognition particle subunit SRP68 (347-355)
YLHSYLTYI

SEQ ID NO: 12355 - protein, 10 aa, Artificial Sequence
  ATP-binding cassette sub-family E member 1 (483-492)
YLIDEPSAYL

SEQ ID NO: 12356 - protein, 9 aa, Artificial Sequence
  Probable ATP-dependent RNA helicase DDX6 (139-147)
YLIPLLERL

SEQ ID NO: 12357 - protein, 9 aa, Artificial Sequence
  Mitotic checkpoint serine/threonine-protein kinase BUB1 (44-52)
YLITLLEHL

SEQ ID NO: 12358 - protein, 9 aa, Artificial Sequence
  60S ribosomal protein L19 (105-113)
YLKVKGNVF

SEQ ID NO: 12359 - protein, 9 aa, Artificial Sequence
  E3 ubiquitin-protein ligase MARCH6 (514-522)
YLLDLHSYL

SEQ ID NO: 12360 - protein, 9 aa, Artificial Sequence
  Ras-like protein family member 11A (22-30)
YLLPKDIKL

SEQ ID NO: 12361 - protein, 9 aa, Artificial Sequence
  Nuclear pore complex protein Nup160 (542-550)
YLLPYENLL

SEQ ID NO: 12362 - protein, 9 aa, Artificial Sequence
  E3 ubiquitin-protein ligase MGRN1 (248-256)
YLLQEIYGI

SEQ ID NO: 12363 - protein, 9 aa, Artificial Sequence
  Eukaryotic initiation factor 4A-III (207-215)
YLPPATQVV

SEQ ID NO: 12364 - protein, 9 aa, Artificial Sequence
  COP9 signalosome complex subunit 1 (211-219)
YLQNWSHVL

SEQ ID NO: 12365 - protein, 11 aa, Artificial Sequence
  Leucyl-cystinyl aminopeptidase (548-558)
YLSEDVFQHAV

SEQ ID NO: 12366 - protein, 9 aa, Artificial Sequence
  Core histone macro-H2A.1 (55-63)
YLTAEILEL

SEQ ID NO: 12367 - protein, 9 aa, Artificial Sequence
  U1 small nuclear ribonucleoprotein C (12-20)
YLTHDSPSV

SEQ ID NO: 12368 - protein, 9 aa, Artificial Sequence
  Cohesin subunit SA-2 (775-783)
YLTNVNTTV

SEQ ID NO: 12369 - protein, 9 aa, Artificial Sequence
  Vacuolar protein sorting-associated protein 16 homolog (308-316)
YLVPELDGV

SEQ ID NO: 12370 - protein, 9 aa, Artificial Sequence
  Lamin-B receptor (474-482)
YLVSHPNEV

SEQ ID NO: 12371 - protein, 10 aa, Artificial Sequence
  DNA topoisomerase 2-alpha (684-693)
YLYGQTTTYL

SEQ ID NO: 12372 - protein, 9 aa, Artificial Sequence
  ER lumen protein-retaining receptor 2 (196-204)
YLYITKVLK

SEQ ID NO: 12373 - protein, 9 aa, Artificial Sequence
  V-type proton ATPase subunit d 1 (27-35)
YMIDNVILL

SEQ ID NO: 12374 - protein, 9 aa, Artificial Sequence
  Ras GTPase-activating protein-binding protein 2 (294-302)
YPDSHQLFV

SEQ ID NO: 12375 - protein, 9 aa, Artificial Sequence
  Transcription factor p65 (479-487)
YPEAITRLV

SEQ ID NO: 12376 - protein, 9 aa, Artificial Sequence
  Neuropathy target esterase (299-307)
YPESLVRVV

SEQ ID NO: 12377 - protein, 9 aa, Artificial Sequence
  Ral GTPase-activating protein subunit beta (25-33)
YPESVGREV

SEQ ID NO: 12378 - protein, 8 aa, Artificial Sequence
  Ubiquitin-conjugating enzyme E2 L3 (61-68)
YPFKPPKI

SEQ ID NO: 12379 - protein, 8 aa, Artificial Sequence
  Phosphatidate cytidylyltransferase 1 (350-357)
YPFQIHSI

SEQ ID NO: 12380 - protein, 9 aa, Artificial Sequence
  LIM and SH3 domain protein 1 (57-65)
YPKQSFTMV

SEQ ID NO: 12381 - protein, 9 aa, Artificial Sequence
  Pumilio homolog 1 (841-849)
YPNLQLREI

SEQ ID NO: 12382 - protein, 9 aa, Artificial Sequence
  Ubiquitin-associated protein 2-like (268-276)
YPPAPFMHI

SEQ ID NO: 12383 - protein, 9 aa, Artificial Sequence
  Splicing factor 3A subunit 1 (44-52)
YPPPEVRNI

SEQ ID NO: 12384 - protein, 9 aa, Artificial Sequence
  Putative oxidoreductase GLYR1 (19-27)
YPPWPGKIV

SEQ ID NO: 12385 - protein, 9 aa, Artificial Sequence
  ETS-related transcription factor Elf-1 (354-362)
YPTQLFRTV

SEQ ID NO: 12386 - protein, 9 aa, Artificial Sequence
  39S ribosomal protein L37, mitochondrial (283-291)
YPYPYPHTL

SEQ ID NO: 12387 - protein, 9 aa, Artificial Sequence
  LEM domain-containing protein 2 (134-142)
YPYVGILHV

SEQ ID NO: 12388 - protein, 9 aa, Artificial Sequence
  HLA class II histocompatibility antigen, DQ beta 1 chain (78-86)
YQLELRTTL

SEQ ID NO: 12389 - protein, 9 aa, Artificial Sequence
  Farnesyl pyrophosphate synthase (158-166)
YQTEIGQTL

SEQ ID NO: 12390 - protein, 8 aa, Artificial Sequence
  Mitogen-activated protein kinase 14 (188-195)
YRAPEIML

SEQ ID NO: 12391 - protein, 8 aa, Artificial Sequence
  Mitogen-activated protein kinase 7 (227-234)
YRAPELML

SEQ ID NO: 12392 - protein, 9 aa, Artificial Sequence
  Endoplasmic reticulum lectin 1 (115-123)
YRIESYWTY

SEQ ID NO: 12393 - protein, 9 aa, Artificial Sequence
  Transmembrane protein 258 (9-17)
YTSPVNPAV

SEQ ID NO: 12394 - protein, 9 aa, Artificial Sequence
  Protein SZT2 (2368-2376)
YVADHASSY

SEQ ID NO: 12395 - protein, 10 aa, Artificial Sequence
  DDB1- and CUL4-associated factor 8 (338-347)
YVNPANTHQF

SEQ ID NO: 12396 - protein, 8 aa, Artificial Sequence
  Tubulin beta chain (79-86)
YVPRAILV

SEQ ID NO: 12397 - protein, 9 aa, Artificial Sequence
  E3 ubiquitin-protein ligase MARCH7 (172-180)
YVQDRVPSY

SEQ ID NO: 12398 - protein, 9 aa, Artificial Sequence
  Single-stranded DNA-binding protein 2 (25-33)
YVYEYLLHV

SEQ ID NO: 12399 - protein, 9 aa, Artificial Sequence
  Tyrosine-protein kinase Fyn (213-221)
YYITTRAQF

SEQ ID NO: 12400 - protein, 9 aa, Artificial Sequence
  Heat shock cognate 71 kDa protein (16-24)
AMNPTNTVF

SEQ ID NO: 12401 - protein, 9 aa, Artificial Sequence
  HLA class II histocompatibility antigen, DP alpha 1 chain (32-40)
IKADHVSTY

SEQ ID NO: 12402 - protein, 9 aa, Artificial Sequence
  Protein SSX2 (41-49)
KASEKIFYV

SEQ ID NO: 12403 - protein, 9 aa, Artificial Sequence
  Paired amphipathic helix protein Sin3a (790-798)
AAALIIHHV

SEQ ID NO: 12404 - protein, 9 aa, Artificial Sequence
  Rho GTPase-activating protein 17 (420-428)
AAATSVHVV

SEQ ID NO: 12405 - protein, 11 aa, Artificial Sequence
  Abhydrolase domain-containing protein 2 (342-352)
AADDPLVHESL

SEQ ID NO: 12406 - protein, 9 aa, Artificial Sequence
  Pre-mRNA-processing factor 19 (410-418)
AADDSSVKL

SEQ ID NO: 12407 - protein, 9 aa, Artificial Sequence
  Ubiquitin carboxyl-terminal hydrolase 4 (677-685)
AADGKLLKL

SEQ ID NO: 12408 - protein, 11 aa, Artificial Sequence
  EP300-interacting inhibitor of differentiation 1 (69-79)
AALEEADKMFL

SEQ ID NO: 12409 - protein, 9 aa, Artificial Sequence
  Vacuolar protein sorting-associated protein 51 homolog (131-139)
AATEIVERV

SEQ ID NO: 12410 - protein, 10 aa, Artificial Sequence
  Codanin-1 (412-421)
AAYEGSVAKV

SEQ ID NO: 12411 - protein, 9 aa, Artificial Sequence
  Tetratricopeptide repeat protein 19, mitochondrial (92-100)
AEAEIIQLL

SEQ ID NO: 12412 - protein, 11 aa, Artificial Sequence
  40S ribosomal protein S10 (140-150)
AEAGAGSATEF

SEQ ID NO: 12413 - protein, 9 aa, Artificial Sequence
  A-kinase anchor protein 11 (1199-1207)
AEALATHIL

SEQ ID NO: 12414 - protein, 9 aa, Artificial Sequence
  Staphylococcal nuclease domain-containing protein 1 (426-434)
AEALVSKGL

SEQ ID NO: 12415 - protein, 9 aa, Artificial Sequence
  DnaJ homolog subfamily C member 3 (124-132)
AEDDFKKVL

SEQ ID NO: 12416 - protein, 9 aa, Artificial Sequence
  Cyclin-dependent kinase 11B (701-709)
AEDGLKHEY

SEQ ID NO: 12417 - protein, 10 aa, Artificial Sequence
  High affinity cationic amino acid transporter 1 (354-363)
AEDGLLFKFL

SEQ ID NO: 12418 - protein, 10 aa, Artificial Sequence
  Protein strawberry notch homolog 2 (92-101)
AEELGHTETY

SEQ ID NO: 12419 - protein, 10 aa, Artificial Sequence
  Casein kinase II subunit alpha (179-188)
AEFYHPGQEY

SEQ ID NO: 12420 - protein, 10 aa, Artificial Sequence
  Probable E3 ubiquitin-protein ligase HERC4 (886-895)
AEHPTIKIFW

SEQ ID NO: 12421 - protein, 8 aa, Artificial Sequence
  Rabankyrin-5 (229-236)
AEIIASHW

SEQ ID NO: 12422 - protein, 10 aa, Artificial Sequence
  26S proteasome non-ATPase regulatory subunit 6 (244-253)
AEILEVLHSL

SEQ ID NO: 12423 - protein, 10 aa, Artificial Sequence
  Son of sevenless homolog 2 (963-972)
AEITGEIQQY

SEQ ID NO: 12424 - protein, 9 aa, Artificial Sequence
  Leucine-rich repeat and calponin homology domain-containing protein 3 (340-348)
AEITKEQRL

SEQ ID NO: 12425 - protein, 10 aa, Artificial Sequence
  HEAT repeat-containing protein 6 (209-218)
AEKDGVSSSF

SEQ ID NO: 12426 - protein, 9 aa, Artificial Sequence
  Transformation/transcription domain-associated protein (2625-2633)
AEKTWVQLF

SEQ ID NO: 12427 - protein, 11 aa, Artificial Sequence
  Glycerol-3-phosphate acyltransferase 3 (4-14)
AELAGKILSTW

SEQ ID NO: 12428 - protein, 9 aa, Artificial Sequence
  Hom s 1 (495-503)
AELELQKQL

SEQ ID NO: 12429 - protein, 9 aa, Artificial Sequence
  HEAT repeat-containing protein 1 (617-625)
AEMKIAIYL

SEQ ID NO: 12430 - protein, 9 aa, Artificial Sequence
  Mitochondrial antiviral-signaling protein (471-479)
AENPSIQLL

SEQ ID NO: 12431 - protein, 10 aa, Artificial Sequence
  Exocyst complex component 1 (513-522)
AEQDFISKFF

SEQ ID NO: 12432 - protein, 9 aa, Artificial Sequence
  Liprin-alpha-1 (374-382)
AEQKLQQTL

SEQ ID NO: 12433 - protein, 9 aa, Artificial Sequence
  Chromodomain-helicase-DNA-binding protein 9 (618-626)
AEQMPQHTL

SEQ ID NO: 12434 - protein, 10 aa, Artificial Sequence
  F-box DNA helicase 1 (868-877)
AEQRIGPLAF

SEQ ID NO: 12435 - protein, 11 aa, Artificial Sequence
  Nuclear cap-binding protein subunit 1 (577-587)
AESDEGKLHVL

SEQ ID NO: 12436 - protein, 11 aa, Artificial Sequence
  Ras-specific guanine nucleotide-releasing factor RalGPS2 (418-428)
AESEDLAVHLY

SEQ ID NO: 12437 - protein, 9 aa, Artificial Sequence
  Transmembrane 9 superfamily member 1 (89-97)
AESLYEIRF

SEQ ID NO: 12438 - protein, 10 aa, Artificial Sequence
  Glycerol-3-phosphate dehydrogenase, mitochondrial (535-544)
AEVKYGIKEY

SEQ ID NO: 12439 - protein, 10 aa, Artificial Sequence
  Protein PRRC2C (2815-2824)
AEVLQSTQRF

SEQ ID NO: 12440 - protein, 8 aa, Artificial Sequence
  Eukaryotic translation initiation factor 3 subunit D (442-449)
AGSEYLKL

SEQ ID NO: 12441 - protein, 9 aa, Artificial Sequence
  Coatomer subunit gamma-2 (147-155)
AIVDKVSSV

SEQ ID NO: 12442 - protein, 11 aa, Artificial Sequence
  Dipeptidyl peptidase 2 (134-144)
ALADFAELLRA

SEQ ID NO: 12443 - protein, 9 aa, Artificial Sequence
  Mediator of RNA polymerase II transcription subunit 23 (388-396)
ALADFLPVM

SEQ ID NO: 12444 - protein, 10 aa, Artificial Sequence
  Coatomer subunit gamma-2 (844-853)
ALADGVTMQV

SEQ ID NO: 12445 - protein, 9 aa, Artificial Sequence
  Nicastrin (466-474)
ALADVATVL

SEQ ID NO: 12446 - protein, 9 aa, Artificial Sequence
  Lysophosphatidylcholine acyltransferase 1 (178-186)
ALAEGQLRL

SEQ ID NO: 12447 - protein, 9 aa, Artificial Sequence
  Filamin-A (1713-1721)
ALAGDQPSV

SEQ ID NO: 12448 - protein, 9 aa, Artificial Sequence
  CAD protein (1492-1500)
ALAGGITMV

SEQ ID NO: 12449 - protein, 9 aa, Artificial Sequence
  Microtubule-associated protein 4 (259-267)
ALAKDMALA

SEQ ID NO: 12450 - protein, 10 aa, Artificial Sequence
  E1A-binding protein p400 (910-919)
ALAKPPVVSV

SEQ ID NO: 12451 - protein, 9 aa, Artificial Sequence
  Transcription factor p65 (361-369)
ALAPAPPQV

SEQ ID NO: 12452 - protein, 9 aa, Artificial Sequence
  HEAT repeat-containing protein 2 (159-167)
ALAPHLDDA

SEQ ID NO: 12453 - protein, 9 aa, Artificial Sequence
  DNA fragmentation factor subunit alpha (236-244)
ALASHILTA

SEQ ID NO: 12454 - protein, 9 aa, Artificial Sequence
  DNA mismatch repair protein Mlh1 (103-111)
ALASISHVA

SEQ ID NO: 12455 - protein, 9 aa, Artificial Sequence
  Intraflagellar transport protein 81 homolog (503-511)
ALASVIKEL

SEQ ID NO: 12456 - protein, 9 aa, Artificial Sequence
  T-complex protein 1 subunit zeta (19-27)
ALAVNISAA

SEQ ID NO: 12457 - protein, 10 aa, Artificial Sequence
  Elongation factor 2 (191-200)
ALCEENMRGV

SEQ ID NO: 12458 - protein, 9 aa, Artificial Sequence
  DNA repair protein RAD50 (1090-1098)
ALDEPTTNL

SEQ ID NO: 12459 - protein, 9 aa, Artificial Sequence
  Perilipin-3 (400-408)
ALDHMVEYV

SEQ ID NO: 12460 - protein, 11 aa, Artificial Sequence
  Receptor-interacting serine/threonine-protein kinase 4 (482-492)
ALDSGASLLHL

SEQ ID NO: 12461 - protein, 9 aa, Artificial Sequence
  Centrosomal protein of 104 kDa (617-625)
ALEHRVYEV

SEQ ID NO: 12462 - protein, 9 aa, Artificial Sequence
  Alpha-tubulin N-acetyltransferase 1 (9-17)
ALFPERITV

SEQ ID NO: 12463 - protein, 11 aa, Artificial Sequence
  SEC14-like protein 1 (357-367)
ALGEEALLRYV

SEQ ID NO: 12464 - protein, 11 aa, Artificial Sequence
  HLA class I histocompatibility antigen, B-40 alpha chain (204-214)
ALGFYPAEITL

SEQ ID NO: 12465 - protein, 10 aa, Artificial Sequence
  Dystonin (3724-3733)
ALIEQKLNEA

SEQ ID NO: 12466 - protein, 9 aa, Artificial Sequence
  RILP-like protein 1 (221-229)
ALIEQKVEL

SEQ ID NO: 12467 - protein, 11 aa, Artificial Sequence
  Aminopeptidase B (193-203)
ALIEVPDGFTA

SEQ ID NO: 12468 - protein, 11 aa, Artificial Sequence
  Coatomer subunit zeta-1 (3-13)
ALILEPSLYTV

SEQ ID NO: 12469 - protein, 11 aa, Artificial Sequence
  Protein fem-1 homolog A (362-372)
ALITDPDEMRM

SEQ ID NO: 12470 - protein, 9 aa, Artificial Sequence
  Rapamycin-insensitive companion of mTOR (226-234)
ALITTILHL

SEQ ID NO: 12471 - protein, 9 aa, Artificial Sequence
  DNA polymerase alpha catalytic subunit (520-528)
ALKPDLVNV

SEQ ID NO: 12472 - protein, 9 aa, Artificial Sequence
  Agrin (1405-1413)
ALLDGRVQL

SEQ ID NO: 12473 - protein, 10 aa, Artificial Sequence
  Protein DGCR6L (54-63)
ALLDGTVFEI

SEQ ID NO: 12474 - protein, 10 aa, Artificial Sequence
  Trabeculin-alpha (3432-3441)
ALLDQALSNA

SEQ ID NO: 12475 - protein, 9 aa, Artificial Sequence
  Talin-1 (1760-1768)
ALLDQTKTL

SEQ ID NO: 12476 - protein, 11 aa, Artificial Sequence
  Histone deacetylase 10 (587-597)
ALLEENSTPQL

SEQ ID NO: 12477 - protein, 9 aa, Artificial Sequence
  LEM domain-containing protein 2 (268-276)
ALLELLHEL

SEQ ID NO: 12478 - protein, 10 aa, Artificial Sequence
  Dystonin (5785-5794)
ALLELVPWRA

SEQ ID NO: 12479 - protein, 11 aa, Artificial Sequence
  Telomerase protein component 1 (281-291)
ALLEPEFILKA

SEQ ID NO: 12480 - protein, 11 aa, Artificial Sequence
  Midasin (2257-2267)
ALLEPGGVLTI

SEQ ID NO: 12481 - protein, 10 aa, Artificial Sequence
  DENN domain-containing protein 4B (1391-1400)
ALLESVLRHV

SEQ ID NO: 12482 - protein, 9 aa, Artificial Sequence
  Transmembrane protein 102 (468-476)
ALLGELARL

SEQ ID NO: 12483 - protein, 9 aa, Artificial Sequence
  Inhibitor of growth protein 4 (58-66)
ALLKQIQEA

SEQ ID NO: 12484 - protein, 9 aa, Artificial Sequence
  Sorting and assembly machinery component 50 homolog (277-285)
ALLKVNQEL

SEQ ID NO: 12485 - protein, 9 aa, Artificial Sequence
  ATP-dependent RNA helicase A (638-646)
ALLKYIETL

SEQ ID NO: 12486 - protein, 10 aa, Artificial Sequence
  Nucleolar protein 11 (404-413)
ALLNAILHSA

SEQ ID NO: 12487 - protein, 9 aa, Artificial Sequence
  Rapamycin-insensitive companion of mTOR (91-99)
ALLNEAKEV

SEQ ID NO: 12488 - protein, 9 aa, Artificial Sequence
  Lysosomal alpha-glucosidase (501-509)
ALLPHLYTL

SEQ ID NO: 12489 - protein, 9 aa, Artificial Sequence
  Coiled-coil domain-containing protein 189 isoform 2 (146-154)
ALLQDLHKA

SEQ ID NO: 12490 - protein, 9 aa, Artificial Sequence
  Cell differentiation protein RCD1 homolog (65-73)
ALLQEIVNI

SEQ ID NO: 12491 - protein, 9 aa, Artificial Sequence
  GSK3-beta interaction protein (125-133)
ALLQRLEAL

SEQ ID NO: 12492 - protein, 9 aa, Artificial Sequence
  Mitochondrial import receptor subunit TOM5 homolog (36-44)
ALLRVTPFI

SEQ ID NO: 12493 - protein, 9 aa, Artificial Sequence
  Catenin alpha-1 (130-138)
ALLSAVTRL

SEQ ID NO: 12494 - protein, 10 aa, Artificial Sequence
  DNA-dependent protein kinase catalytic subunit (2867-2876)
ALLSLDPAAV

SEQ ID NO: 12495 - protein, 9 aa, Artificial Sequence
  Multiple inositol polyphosphate phosphatase 1 (26-34)
ALLSSLARC

SEQ ID NO: 12496 - protein, 9 aa, Artificial Sequence
  DNA-directed RNA polymerase I subunit RPA1 (343-351)
ALMAQEQKL

SEQ ID NO: 12497 - protein, 9 aa, Artificial Sequence
  Brefeldin A-inhibited guanine nucleotide-exchange protein 1 (924-932)
ALMEAVSHV

SEQ ID NO: 12498 - protein, 10 aa, Artificial Sequence
  THAP domain-containing protein 11 (268-277)
ALMEVKMKEM

SEQ ID NO: 12499 - protein, 9 aa, Artificial Sequence
  Junction plakoglobin (178-186)
ALMGSPQLV

SEQ ID NO: 12500 - protein, 9 aa, Artificial Sequence
  Probable E3 ubiquitin-protein ligase HECTD4 (327-335)
ALMPQLVQL

SEQ ID NO: 12501 - protein, 11 aa, Artificial Sequence
  Synaptosomal-associated protein 29 (65-75)
ALMYESEKVGV

SEQ ID NO: 12502 - protein, 9 aa, Artificial Sequence
  F-box only protein 21 (284-292)
ALNLYMHQV

SEQ ID NO: 12503 - protein, 10 aa, Artificial Sequence
  Immunoglobulin-binding protein 1 (279-288)
ALPDQGIAKA

SEQ ID NO: 12504 - protein, 10 aa, Artificial Sequence
  Coatomer subunit gamma-1 (711-720)
ALPKEDPTAV

SEQ ID NO: 12505 - protein, 9 aa, Artificial Sequence
  EVI5-like protein (617-625)
ALQEKLQYL

SEQ ID NO: 12506 - protein, 9 aa, Artificial Sequence
  Signal recognition particle receptor subunit alpha (360-368)
ALQESLVQI

SEQ ID NO: 12507 - protein, 9 aa, Artificial Sequence
  Dolichyl-diphosphooligosaccharide-proteinosyltransferase subunit 2 (5-13)
ALSALTARL

SEQ ID NO: 12508 - protein, 9 aa, Artificial Sequence
  Fas apoptotic inhibitory molecule 1 (45-53)
ALSDGVHKI

SEQ ID NO: 12509 - protein, 10 aa, Artificial Sequence
  T-complex protein 1 subunit delta (308-317)
ALSDLALHFL

SEQ ID NO: 12510 - protein, 9 aa, Artificial Sequence
  Coiled-coil domain-containing protein 93 (85-93)
ALSEKIVSV

SEQ ID NO: 12511 - protein, 9 aa, Artificial Sequence
  Uncharacterized protein C1orf43 (148-156)
ALSELATAV

SEQ ID NO: 12512 - protein, 9 aa, Artificial Sequence
  Lanosterol 14-alpha demethylase (197-205)
ALSELIILT

SEQ ID NO: 12513 - protein, 9 aa, Artificial Sequence
  26S proteasome non-ATPase regulatory subunit 14 (135-143)
ALSERAVAV

SEQ ID NO: 12514 - protein, 9 aa, Artificial Sequence
  Inversin (365-373)
ALSGHVSTV

SEQ ID NO: 12515 - protein, 9 aa, Artificial Sequence
  Small integral membrane protein 10 (21-29)
ALSGLAVRL

SEQ ID NO: 12516 - protein, 9 aa, Artificial Sequence
  Kinesin light chain 1 (87-95)
ALSNHLNAV

SEQ ID NO: 12517 - protein, 9 aa, Artificial Sequence
  tRNA-splicing endonuclease subunit Sen2 (347-355)
ALSRVSVNV

SEQ ID NO: 12518 - protein, 9 aa, Artificial Sequence
  FAST kinase domain-containing protein 2 (485-493)
ALTGYLHTI

SEQ ID NO: 12519 - protein, 9 aa, Artificial Sequence
  Putative phospholipase B-like 2 (16-24)
ALTRALALA

SEQ ID NO: 12520 - protein, 9 aa, Artificial Sequence
  AP-1 complex subunit gamma-1 (331-339)
ALTSLLKTV

SEQ ID NO: 12521 - protein, 10 aa, Artificial Sequence
  E3 ubiquitin-protein ligase RFWD2 (46-55)
ALVSGGVAQA

SEQ ID NO: 12522 - protein, 9 aa, Artificial Sequence
  Nesprin-2 (3479-3487)
ALWEKWLSL

SEQ ID NO: 12523 - protein, 9 aa, Artificial Sequence
  Integrin alpha-X (412-420)
ALWKGVQSL

SEQ ID NO: 12524 - protein, 9 aa, Artificial Sequence
  Helicase with zinc finger domain 2 (1826-1834)
ALWKQLLEL

SEQ ID NO: 12525 - protein, 9 aa, Artificial Sequence
  Rabankyrin-5 (638-646)
ALWTGMHTI

SEQ ID NO: 12526 - protein, 10 aa, Artificial Sequence
  CDK5 regulatory subunit-associated protein 3 (102-111)
ALYEKDNTYL

SEQ ID NO: 12527 - protein, 9 aa, Artificial Sequence
  Small subunit processome component 20 homolog (799-807)
ALYHEQLAL

SEQ ID NO: 12528 - protein, 11 aa, Artificial Sequence
  Prohibitin (26-36)
ALYNVDAGHRA

SEQ ID NO: 12529 - protein, 9 aa, Artificial Sequence
  Receptor expression-enhancing protein 3 (46-54)
ALYTVIETV

SEQ ID NO: 12530 - protein, 9 aa, Artificial Sequence
  Heterogeneous nuclear ribonucleoproteins A2/B1 (66-74)
AMAARPHSI

SEQ ID NO: 12531 - protein, 10 aa, Artificial Sequence
  Leucine-tRNA ligase, cytoplasmic (67-76)
AMADAGILRL

SEQ ID NO: 12532 - protein, 11 aa, Artificial Sequence
  Translocon-associated protein subunit delta (3-13)
AMASLGALALL

SEQ ID NO: 12533 - protein, 11 aa, Artificial Sequence
  Phosphatidylinositol 4-kinase alpha (1043-1053)
AMATESILHFA

SEQ ID NO: 12534 - protein, 9 aa, Artificial Sequence
  Nuclear cap-binding protein subunit 1 (147-155)
AMFENFVSV

SEQ ID NO: 12535 - protein, 10 aa, Artificial Sequence
  Eukaryotic translation initiation factor 3 subunit K (2-11)
AMFEQMRANV

SEQ ID NO: 12536 - protein, 9 aa, Artificial Sequence
  U4/U6 small nuclear ribonucleoprotein Prp3 (237-245)
AMGIAPPKV

SEQ ID NO: 12537 - protein, 9 aa, Artificial Sequence
  Chitobiosyldiphosphodolichol beta-mannosyltransferase (57-65)
AMHGFSVTL

SEQ ID NO: 12538 - protein, 9 aa, Artificial Sequence
  Tripartite motif-containing protein 44 (233-241)
AMIELVERL

SEQ ID NO: 12539 - protein, 9 aa, Artificial Sequence
  Importin subunit beta-1 (122-130)
AMKSDIDEV

SEQ ID NO: 12540 - protein, 9 aa, Artificial Sequence
  Intraflagellar transport protein 172 homolog (30-38)
AMLEKNYKL

SEQ ID NO: 12541 - protein, 9 aa, Artificial Sequence
  E3 ubiquitin-protein ligase RNF31 (159-167)
AMLNEPWAV

SEQ ID NO: 12542 - protein, 10 aa, Artificial Sequence
  HLA class II histocompatibility antigen, DQ beta 1 chain (23-32)
AMLSTPVAEG

SEQ ID NO: 12543 - protein, 9 aa, Artificial Sequence
  AP-1 complex subunit gamma-1 (266-274)
AMNDILAQV

SEQ ID NO: 12544 - protein, 9 aa, Artificial Sequence
  Splicing factor 3A subunit 3 (45-53)
AMQDRYMEV

SEQ ID NO: 12545 - protein, 11 aa, Artificial Sequence
  Guanine nucleotide-binding protein G(s) subunit alpha isoforms short (95-105)
AMSNLVPPVEL

SEQ ID NO: 12546 - protein, 9 aa, Artificial Sequence
  Heat shock 70 kDa protein 1-like (450-458)
AMTKDNNLL

SEQ ID NO: 12547 - protein, 9 aa, Artificial Sequence
  F-box only protein 21 (416-424)
AMYPDQVQL

SEQ ID NO: 12548 - protein, 10 aa, Artificial Sequence
  Vascular endothelial growth factor A (130-139)
APAARAPQAL

SEQ ID NO: 12549 - protein, 9 aa, Artificial Sequence
  Sister chromatid cohesion protein PDS5 homolog A (368-376)
APAERQIDL

SEQ ID NO: 12550 - protein, 9 aa, Artificial Sequence
  Host cell factor 1 (810-818)
APAKIITAV

SEQ ID NO: 12551 - protein, 10 aa, Artificial Sequence
  Histone H1.4 (11-20)
APAPAEKTPV

SEQ ID NO: 12552 - protein, 9 aa, Artificial Sequence
  Zinc finger protein 428 (123-131)
APAPEGRAL

SEQ ID NO: 12553 - protein, 10 aa, Artificial Sequence
  Pleckstrin homology domain-containing family B member 2 (137-146)
APAPEVGRTL

SEQ ID NO: 12554 - protein, 11 aa, Artificial Sequence
  Cathepsin D (16-26)
APASALVRIPL

SEQ ID NO: 12555 - protein, 9 aa, Artificial Sequence
  Liprin-beta-1 (819-827)
APNLRGSGV

SEQ ID NO: 12556 - protein, 11 aa, Artificial Sequence
  Double-stranded RNA-binding protein Staufen homolog 1 (362-372)
APNPAKATVTA

SEQ ID NO: 12557 - protein, 10 aa, Artificial Sequence
  Zinc finger HIT domain-containing protein 2 (59-68)
APPSRLASAL

SEQ ID NO: 12558 - protein, 11 aa, Artificial Sequence
  Putative sodium-coupled neutral amino acid transporter 10 (841-851)
APRAAGTVKEL

SEQ ID NO: 12559 - protein, 11 aa, Artificial Sequence
  RELT-like protein 1 (2-12)
APRALPGSAVL

SEQ ID NO: 12560 - protein, 9 aa, Artificial Sequence
  Rhotekin (385-393)
APRKPPQAL

SEQ ID NO: 12561 - protein, 9 aa, Artificial Sequence
  Long-chain fatty acid transport protein 1 (264-272)
APYARPIFL

SEQ ID NO: 12562 - protein, 9 aa, Artificial Sequence
  Coiled-coil domain-containing protein 50 (69-77)
AQAQLQKRY

SEQ ID NO: 12563 - protein, 9 aa, Artificial Sequence
  Pumilio homolog 2 (180-188)
AQQPHIAGV

SEQ ID NO: 12564 - protein, 9 aa, Artificial Sequence
  E3 ubiquitin-protein ligase HUWE1 (1181-1189)
AQVALVNEV

SEQ ID NO: 12565 - protein, 9 aa, Artificial Sequence
  Unconventional myosin-If (36-44)
AQYENPPHI

SEQ ID NO: 12566 - protein, 11 aa, Artificial Sequence
  Alpha-actinin-1 (231-241)
ARPDEKAIMTY

SEQ ID NO: 12567 - protein, 9 aa, Artificial Sequence
  Vacuolar protein sorting-associated protein 54 (467-475)
ATLNIIHSV

SEQ ID NO: 12568 - protein, 10 aa, Artificial Sequence
  Cullin-2 (577-586)
AVDEDRKMYL

SEQ ID NO: 12569 - protein, 11 aa, Artificial Sequence
  Erlin-1 (214-224)
AVIEAEKIAQV

SEQ ID NO: 12570 - protein, 9 aa, Artificial Sequence
  Ubiquitin carboxyl-terminal hydrolase 28 (743-751)
AVMESIQGV

SEQ ID NO: 12571 - protein, 9 aa, Artificial Sequence
  40S ribosomal protein S5 (172-180)
CLADELINA

SEQ ID NO: 12572 - protein, 10 aa, Artificial Sequence
  Protein transport protein Sec23B (288-297)
DELKIPIRSW

SEQ ID NO: 12573 - protein, 10 aa, Artificial Sequence
  Serine/threonine-protein kinase 11-interacting protein (963-972)
DEVSRLESFW

SEQ ID NO: 12574 - protein, 9 aa, Artificial Sequence
  Guanine nucleotide-binding protein G(I)/G(S)/G(T) subunit beta-2 (170-178)
DIETGQQTV

SEQ ID NO: 12575 - protein, 8 aa, Artificial Sequence
  Tuberin (529-536)
DIIEKVMA

SEQ ID NO: 12576 - protein, 8 aa, Artificial Sequence
  E3 ubiquitin-protein ligase RNF213 (2081-2088)
DINGKMWL

SEQ ID NO: 12577 - protein, 9 aa, Artificial Sequence
  Echinoderm microtubule-associated protein-like 5 (1134-1142)
DIRGKLLQV

SEQ ID NO: 12578 - protein, 8 aa, Artificial Sequence
  Negative elongation factor A (258-265)
DISELDMV

SEQ ID NO: 12579 - protein, 9 aa, Artificial Sequence
  Golgin subfamily A member 4 (852-860)
DLETERILL

SEQ ID NO: 12580 - protein, 10 aa, Artificial Sequence
  GRB2-associated-binding protein 1 (123-132)
DPVKPPGSSL

SEQ ID NO: 12581 - protein, 9 aa, Artificial Sequence
  Signal recognition particle 54 kDa protein (388-396)
DSTDGAKVF

SEQ ID NO: 12582 - protein, 9 aa, Artificial Sequence
  Protein BANP (72-80)
EAKLQALEA

SEQ ID NO: 12583 - protein, 9 aa, Artificial Sequence
  Endothelial differentiation-related factor 1 (36-44)
EDVETSKKW

SEQ ID NO: 12584 - protein, 10 aa, Artificial Sequence
  Clathrin heavy chain 1 (1066-1075)
EEAFAIFRKF

SEQ ID NO: 12585 - protein, 10 aa, Artificial Sequence
  DNA excision repair protein ERCC-1 (203-212)
EEAGRYLETY

SEQ ID NO: 12586 - protein, 9 aa, Artificial Sequence
  cAMP-dependent protein kinase type I-alpha regulatory subunit (60-68)
EEAKQIQNL

SEQ ID NO: 12587 - protein, 9 aa, Artificial Sequence
  Zinc finger protein 548 (56-64)
EEAPSQQGF

SEQ ID NO: 12588 - protein, 10 aa, Artificial Sequence
  Zinc finger and BTB domain-containing protein 17 (715-724)
EEDPNTHILY

SEQ ID NO: 12589 - protein, 10 aa, Artificial Sequence
  Cullin-4A (268-277)
EEEGDRVITY

SEQ ID NO: 12590 - protein, 9 aa, Artificial Sequence
  S-phase kinase-associated protein 1 (120-128)
EEIRKTFNI

SEQ ID NO: 12591 - protein, 8 aa, Artificial Sequence
  Nuclear transcription factor Y subunit gamma (28-35)
EEIRNLTV

SEQ ID NO: 12592 - protein, 10 aa, Artificial Sequence
  Flotillin-1 (118-127)
EEIYKDRQKF

SEQ ID NO: 12593 - protein, 9 aa, Artificial Sequence
  Microtubule-associated protein 4 (105-113)
EEKMAYQEY

SEQ ID NO: 12594 - protein, 9 aa, Artificial Sequence
  Eukaryotic translation initiation factor 3 subunit D (172-180)
EEMDFPQLM

SEQ ID NO: 12595 - protein, 10 aa, Artificial Sequence
  HEAT repeat-containing protein 1 (411-420)
EEMDSNKVSL

SEQ ID NO: 12596 - protein, 9 aa, Artificial Sequence
  BRISC and BRCA1-A complex member 1 (257-265)
EEMSWKDMF

SEQ ID NO: 12597 - protein, 10 aa, Artificial Sequence
  Mitotic checkpoint serine/threonine-protein kinase BUB1 (35-44)
EENFPENKEY

SEQ ID NO: 12598 - protein, 10 aa, Artificial Sequence
  Autophagy-related protein 16-1 (158-167)
EENQELVTRW

SEQ ID NO: 12599 - protein, 9 aa, Artificial Sequence
  Eukaryotic translation initiation factor 3 subunit C-like protein (786-794)
EESLRTYLF

SEQ ID NO: 12600 - protein, 9 aa, Artificial Sequence
  Segment polarity protein dishevelled homolog DVL-2 (23-31)
EETPYLVKI

SEQ ID NO: 12601 - protein, 10 aa, Artificial Sequence
  GRIP1-associated protein 1 (706-715)
EEVAELFQRL

SEQ ID NO: 12602 - protein, 9 aa, Artificial Sequence
  Glutaredoxin-3 (9-17)
ELAKELPQV

SEQ ID NO: 12603 - protein, 9 aa, Artificial Sequence
  Nuclear factor of activated T-cells 5 (953-961)
ELFSSPPAV

SEQ ID NO: 12604 - protein, 8 aa, Artificial Sequence
  Cyclin-J-like protein (62-69)
EQLRLQEL

SEQ ID NO: 12605 - protein, 9 aa, Artificial Sequence
  Nucleolar RNA helicase 2 (172-180)
FAIPLIEKL

SEQ ID NO: 12606 - protein, 9 aa, Artificial Sequence
  Tristetraprolin (304-312)
FAPPQPVAA

SEQ ID NO: 12607 - protein, 10 aa, Artificial Sequence
  Laminin subunit gamma-1 (1227-1236)
FEIEELNRKY

SEQ ID NO: 12608 - protein, 9 aa, Artificial Sequence
  Nucleolar pre-ribosomal-associated protein 1 (1554-1562)
FEQKTEQKW

SEQ ID NO: 12609 - protein, 9 aa, Artificial Sequence
  Non-POU domain-containing octamer-binding protein (174-182)
FEYEYAMRW

SEQ ID NO: 12610 - protein, 9 aa, Artificial Sequence
  Antizyme inhibitor 1 (4-12)
FIDDANYSV

SEQ ID NO: 12611 - protein, 10 aa, Artificial Sequence
  Activator of 90 kDa heat shock protein ATPase homolog 1 (215-224)
FIDKNGETEL

SEQ ID NO: 12612 - protein, 9 aa, Artificial Sequence
  Ral GTPase-activating protein subunit alpha-1 (86-94)
FIFEKILQL

SEQ ID NO: 12613 - protein, 9 aa, Artificial Sequence
  DENN domain-containing protein 5B (1150-1158)
FIWDFIEKV

SEQ ID NO: 12614 - protein, 10 aa, Artificial Sequence
  Dipeptidyl peptidase 8 (19-28)
FIYGGPQVQL

SEQ ID NO: 12615 - protein, 9 aa, Artificial Sequence
  Caspase recruitment domain-containing protein 19 (155-163)
FLADDLGGL

SEQ ID NO: 12616 - protein, 11 aa, Artificial Sequence
  Protein YIF1B (55-65)
FLADPVSNMAM

SEQ ID NO: 12617 - protein, 9 aa, Artificial Sequence
  Interferon-induced GTP-binding protein Mx2 (30-38)
FLAKDFNFL

SEQ ID NO: 12618 - protein, 9 aa, Artificial Sequence
  Eukaryotic translation initiation factor 4 gamma 2 (315-323)
FLDNGPKTI

SEQ ID NO: 12619 - protein, 9 aa, Artificial Sequence
  Phospholipase DDHD1 (681-689)
FLDSAYFRL

SEQ ID NO: 12620 - protein, 9 aa, Artificial Sequence
  Condensin complex subunit 3 (699-707)
FLDSEVSEL

SEQ ID NO: 12621 - protein, 9 aa, Artificial Sequence
  Microtubule-associated protein 1B (32-40)
FLDSKFYLL

SEQ ID NO: 12622 - protein, 9 aa, Artificial Sequence
  Catenin alpha-2 (392-400)
FLETNVPLL

SEQ ID NO: 12623 - protein, 10 aa, Artificial Sequence
  Calnexin (139-148)
FLFDTKPLIV

SEQ ID NO: 12624 - protein, 9 aa, Artificial Sequence
  Vacuolar protein sorting-associated protein 51 homolog (106-114)
FLFELPSRL

SEQ ID NO: 12625 - protein, 10 aa, Artificial Sequence
  Ankyrin repeat and LEM domain-containing protein 2 (825-834)
FLFGEEPSKL

SEQ ID NO: 12626 - protein, 9 aa, Artificial Sequence
  Cullin-4B (289-297)
FLFLDRTYV

SEQ ID NO: 12627 - protein, 9 aa, Artificial Sequence
  Elongation of very long chain fatty acids protein 1 (87-95)
FLFSKFIEL

SEQ ID NO: 12628 - protein, 8 aa, Artificial Sequence
  Sacsin (645-652)
FLGKIYQI

SEQ ID NO: 12629 - protein, 9 aa, Artificial Sequence
  UDP-N-acetylglucosamine-dolichyl-phosphate N-acetylglucosaminephosphotransferase (221-229)
FLGTFILKV

SEQ ID NO: 12630 - protein, 9 aa, Artificial Sequence
  DNA ligase 3 (616-624)
FLHDNMVEI

SEQ ID NO: 12631 - protein, 9 aa, Artificial Sequence
  Major facilitator superfamily domain-containing protein 1 (150-158)
FLIDRVFGI

SEQ ID NO: 12632 - protein, 9 aa, Artificial Sequence
  ATP-dependent RNA helicase DHX36 (519-527)
FLIIPLHSL

SEQ ID NO: 12633 - protein, 10 aa, Artificial Sequence
  Beta-glucuronidase (117-126)
FLINGKPFYF

SEQ ID NO: 12634 - protein, 9 aa, Artificial Sequence
  Isoleucine-tRNA ligase, cytoplasmic (662-670)
FLIQNVLRL

SEQ ID NO: 12635 - protein, 9 aa, Artificial Sequence
  Puromycin-sensitive aminopeptidase (846-854)
FLISRLIKL

SEQ ID NO: 12636 - protein, 9 aa, Artificial Sequence
  Myotubularin-related protein 2 (121-129)
FLITILDHL

SEQ ID NO: 12637 - protein, 9 aa, Artificial Sequence
  Putative protein PLEKHA9 (298-306)
FLKGFLTEV

SEQ ID NO: 12638 - protein, 10 aa, Artificial Sequence
  Regulator of nonsense transcripts 1 (192-201)
FLLGFIPAKA

SEQ ID NO: 12639 - protein, 10 aa, Artificial Sequence
  Alpha-N-acetylglucosaminidase (616-625)
FLLGSWLEQA

SEQ ID NO: 12640 - protein, 9 aa, Artificial Sequence
  Probable ATP-dependent RNA helicase DDX59 (257-265)
FLLPVIMRA

SEQ ID NO: 12641 - protein, 10 aa, Artificial Sequence
  HLA class II histocompatibility antigen, DP alpha 1 chain (22-31)
FLLSLRGAGA

SEQ ID NO: 12642 - protein, 9 aa, Artificial Sequence
  Putative histone H2B type 2-D (86-94)
FLNDIFERI

SEQ ID NO: 12643 - protein, 9 aa, Artificial Sequence
  A-kinase anchor protein 9 (956-964)
FLNEEVKSL

SEQ ID NO: 12644 - protein, 9 aa, Artificial Sequence
  Osteopetrosis-associated transmembrane protein 1 (171-179)
FLNLFNHTL

SEQ ID NO: 12645 - protein, 10 aa, Artificial Sequence
  Structure-specific endonuclease subunit SLX1 (220-229)
FLQEEPGQLL

SEQ ID NO: 12646 - protein, 9 aa, Artificial Sequence
  Golgin subfamily A member 4 (1152-1160)
FLQEQLVEL

SEQ ID NO: 12647 - protein, 9 aa, Artificial Sequence
  Endoplasmic reticulum-Golgi intermediate compartment protein 3 (5-13)
FLSELQYYL

SEQ ID NO: 12648 - protein, 9 aa, Artificial Sequence
  Nicalin (262-270)
FLSTLEHHL

SEQ ID NO: 12649 - protein, 9 aa, Artificial Sequence
  Uncharacterized protein KIAA1109 (19-27)
FLTEHNSNV

SEQ ID NO: 12650 - protein, 9 aa, Artificial Sequence
  Zinc finger BED domain-containing protein 5 (533-541)
FLTEINSTV

SEQ ID NO: 12651 - protein, 10 aa, Artificial Sequence
  Signal transducer and activator of transcription 6 (163-172)
FLVEKQPPQV

SEQ ID NO: 12652 - protein, 10 aa, Artificial Sequence
  Phospholipase D3 (58-67)
FLWEYGDLHL

SEQ ID NO: 12653 - protein, 9 aa, Artificial Sequence
  Transcription factor 25 (382-390)
FLWKEPATM

SEQ ID NO: 12654 - protein, 9 aa, Artificial Sequence
  Cytochrome b (107-115)
FLYSETWNI

SEQ ID NO: 12655 - protein, 10 aa, Artificial Sequence
  E3 ubiquitin-protein ligase XIAP (52-61)
FLYTGEGDTV

SEQ ID NO: 12656 - protein, 9 aa, Artificial Sequence
  Putative oxidoreductase GLYR1 (382-390)
FMATIAEGL

SEQ ID NO: 12657 - protein, 9 aa, Artificial Sequence
  Probable helicase senataxin (266-274)
FMQSILHTM

SEQ ID NO: 12658 - protein, 9 aa, Artificial Sequence
  Alpha-adducin (97-105)
FMTTNVPNV

SEQ ID NO: 12659 - protein, 9 aa, Artificial Sequence
  Ubiquitin carboxyl-terminal hydrolase 11 (94-102)
FQDEINWRL

SEQ ID NO: 12660 - protein, 11 aa, Artificial Sequence
  E3 ubiquitin-protein ligase TRIP12 (633-643)
FQHEENLLQQV

SEQ ID NO: 12661 - protein, 9 aa, Artificial Sequence
  Threonine-tRNA ligase, cytoplasmic (598-606)
FQLPIRFNL

SEQ ID NO: 12662 - protein, 9 aa, Artificial Sequence
  RNA-binding protein EWS (267-275)
FRQDHPSSM

SEQ ID NO: 12663 - protein, 8 aa, Artificial Sequence
  Spliceosome RNA helicase DDX39B (106-113)
FVDDETKL

SEQ ID NO: 12664 - protein, 9 aa, Artificial Sequence
  Cytoplasmic dynein 1 heavy chain 1 (4145-4153)
FVFEPPPGV

SEQ ID NO: 12665 - protein, 9 aa, Artificial Sequence
  General transcription factor IIH subunit 5 (44-52)
FVIAELVNV

SEQ ID NO: 12666 - protein, 9 aa, Artificial Sequence
  Transmembrane protein 147 (181-189)
FVMETFVHL

SEQ ID NO: 12667 - protein, 9 aa, Artificial Sequence
  Rhomboid domain-containing protein 2 (68-76)
FVYENPISL

SEQ ID NO: 12668 - protein, 9 aa, Artificial Sequence
  ER degradation-enhancing alpha-mannosidase-like protein 1 (33-41)
FYQRFPLSF

SEQ ID NO: 12669 - protein, 9 aa, Artificial Sequence
  Filamin-A (998-1006)
GADNSVVRF

SEQ ID NO: 12670 - protein, 9 aa, Artificial Sequence
  FACT complex subunit SPT16 (233-241)
GADPSTVEM

SEQ ID NO: 12671 - protein, 10 aa, Artificial Sequence
  Telomere length regulation protein TEL2 homolog (189-198)
GEEVVRVLQA

SEQ ID NO: 12672 - protein, 10 aa, Artificial Sequence
  Leucine-rich repeat serine/threonine-protein kinase 2 (1802-1811)
GEGETLLKKW

SEQ ID NO: 12673 - protein, 10 aa, Artificial Sequence
  Nuclear factor erythroid 2-related factor 2 (521-530)
GENDKSLHLL

SEQ ID NO: 12674 - protein, 9 aa, Artificial Sequence
  AT-rich interactive domain-containing protein 2 (80-88)
GESSLIKQL

SEQ ID NO: 12675 - protein, 10 aa, Artificial Sequence
  Acetyl-CoA carboxylase 1 (1979-1988)
GGIPVGVVAV

SEQ ID NO: 12676 - protein, 8 aa, Artificial Sequence
  DNA damage-binding protein 1 (59-66)
GKIAVMEL

SEQ ID NO: 12677 - protein, 9 aa, Artificial Sequence
  Cyclin-dependent kinase 12 (1103-1111)
GLADITQQL

SEQ ID NO: 12678 - protein, 11 aa, Artificial Sequence
  ATPase WRNIP1 (548-558)
GLADPSALTQA

SEQ ID NO: 12679 - protein, 10 aa, Artificial Sequence
  Negative regulator of reactive oxygen species (203-212)
GLAELRHLNL

SEQ ID NO: 12680 - protein, 9 aa, Artificial Sequence
  Flap endonuclease 1 (5-13)
GLAKLIADV

SEQ ID NO: 12681 - protein, 9 aa, Artificial Sequence
  GPN-loop GTPase 1 (234-242)
GLDELFVQV

SEQ ID NO: 12682 - protein, 10 aa, Artificial Sequence
  Probable ATP-dependent RNA helicase DDX27 (497-506)
GLDIEGVKTV

SEQ ID NO: 12683 - protein, 11 aa, Artificial Sequence
  U3 small nucleolar RNA-associated protein 18 homolog (107-117)
GLDNAVSLFQV

SEQ ID NO: 12684 - protein, 9 aa, Artificial Sequence
  26S protease regulatory subunit 4 (189-197)
GLDNQIQEI

SEQ ID NO: 12685 - protein, 10 aa, Artificial Sequence
  DNA mismatch repair protein Msh2 (438-447)
GLDPGKQIKL

SEQ ID NO: 12686 - protein, 9 aa, Artificial Sequence
  CAP-Gly domain-containing linker protein 1 (270-278)
GLFAPVHKV

SEQ ID NO: 12687 - protein, 11 aa, Artificial Sequence
  Ras suppressor protein 1 (35-45)
GLFTLSHITQL

SEQ ID NO: 12688 - protein, 11 aa, Artificial Sequence
  Autophagy-related protein 13 (84-94)
GLGEGFQTVRV

SEQ ID NO: 12689 - protein, 11 aa, Artificial Sequence
  WD repeat and FYVE domain-containing protein 3 (1077-1087)
GLIDGAVVSGI

SEQ ID NO: 12690 - protein, 11 aa, Artificial Sequence
  Structural maintenance of chromosomes flexible hinge domain-containing protein 1 (829-839)
GLLDLPFRVGV

SEQ ID NO: 12691 - protein, 10 aa, Artificial Sequence
  Nucleolar complex protein 4 homolog (332-341)
GLLDPSVFHV

SEQ ID NO: 12692 - protein, 9 aa, Artificial Sequence
  Transcription initiation factor TFIID subunit 4B (694-702)
GLLEKLTAI

SEQ ID NO: 12693 - protein, 9 aa, Artificial Sequence
  Vigilin (1000-1008)
GLLERVKEL

SEQ ID NO: 12694 - protein, 11 aa, Artificial Sequence
  Vigilin (354-364)
GLLERVKELQA

SEQ ID NO: 12695 - protein, 9 aa, Artificial Sequence
  Phosphatidylinositol N-acetylglucosaminyltransferase subunit H (75-83)
GLLGYLHFV

SEQ ID NO: 12696 - protein, 9 aa, Artificial Sequence
  Thyroid adenoma-associated protein (229-237)
GLLSIFTKV

SEQ ID NO: 12697 - protein, 11 aa, Artificial Sequence
  Trafficking protein particle complex subunit 2-like protein (29-39)
GLLYPTEDYKV

SEQ ID NO: 12698 - protein, 9 aa, Artificial Sequence
  Nuclear receptor corepressor 1 (313-321)
GLMEDPMKV

SEQ ID NO: 12699 - protein, 11 aa, Artificial Sequence
  Importin-4 (301-311)
GLMGEGLAPHL

SEQ ID NO: 12700 - protein, 9 aa, Artificial Sequence
  Adiponectin receptor protein 2 (286-294)
GLSGIIPTL

SEQ ID NO: 12701 - protein, 9 aa, Artificial Sequence
  Protein GPR107 (398-406)
GLWKDSLFL

SEQ ID NO: 12702 - protein, 9 aa, Artificial Sequence
  Chromodomain-helicase-DNA-binding protein 8 (115-123)
GMDEKEFTV

SEQ ID NO: 12703 - protein, 9 aa, Artificial Sequence
  DnaJ homolog subfamily A member 1 (168-176)
GMVQQIQSV

SEQ ID NO: 12704 - protein, 10 aa, Artificial Sequence
  Cysteine and histidine-rich protein 1 (139-148)
GMWGGAMLGV

SEQ ID NO: 12705 - protein, 11 aa, Artificial Sequence
  Rab GTPase-activating protein 1-like (35-45)
GMWNPNAPVFL

SEQ ID NO: 12706 - protein, 9 aa, Artificial Sequence
  Tumor protein p53-inducible protein 13 (212-220)
GPQPTRSAL

SEQ ID NO: 12707 - protein, 9 aa, Artificial Sequence
  Ubiquitin carboxyl-terminal hydrolase 48 (545-553)
GPRLTVKAL

SEQ ID NO: 12708 - protein, 10 aa, Artificial Sequence
  Filamin-A (2186-2195)
GPRLVSNHSL

SEQ ID NO: 12709 - protein, 9 aa, Artificial Sequence
  Apoptosis-stimulating of p53 protein 2 (99-107)
GPRSQDPSL

SEQ ID NO: 12710 - protein, 9 aa, Artificial Sequence
  Interleukin-6 receptor subunit beta (849-857)
GQVERFETV

SEQ ID NO: 12711 - protein, 10 aa, Artificial Sequence
  HLA class I histocompatibility antigen, B-15 alpha chain (25-34)
GSHSMRYFYT

SEQ ID NO: 12712 - protein, 10 aa, Artificial Sequence
  Nucleolar protein 56 (116-125)
GVIAEILRGV

SEQ ID NO: 12713 - protein, 10 aa, Artificial Sequence
  Perilipin-2 (347-356)
GVMAGDIYSV

SEQ ID NO: 12714 - protein, 11 aa, Artificial Sequence
  Golgi resident protein GCP60 (488-498)
HEEVYAGSHQY

SEQ ID NO: 12715 - protein, 9 aa, Artificial Sequence
  Small subunit processome component 20 homolog (748-756)
HEMENKQFW

SEQ ID NO: 12716 - protein, 9 aa, Artificial Sequence
  Kelch domain-containing protein 3 (196-204)
HILDFSPSL

SEQ ID NO: 12717 - protein, 11 aa, Artificial Sequence
  Leucine-rich repeat and calponin homology domain-containing protein 3 (744-754)
HILEEKGLSQV

SEQ ID NO: 12718 - protein, 11 aa, Artificial Sequence
  Leucine-rich repeat and calponin homology domain-containing protein 1 (668-678)
HILEEKGLVKV

SEQ ID NO: 12719 - protein, 10 aa, Artificial Sequence
  Vascular endothelial growth factor receptor 1 (327-336)
HIYDKAFITV

SEQ ID NO: 12720 - protein, 11 aa, Artificial Sequence
  Phenylalanine-tRNA ligase alpha subunit (365-375)
HLAEFHQIEGV

SEQ ID NO: 12721 - protein, 9 aa, Artificial Sequence
  ZW10 interactor (166-174)
HLAEVSAEV

SEQ ID NO: 12722 - protein, 9 aa, Artificial Sequence
  Gamma-adducin (155-163)
HLANTYISV

SEQ ID NO: 12723 - protein, 9 aa, Artificial Sequence
  Transcription factor E2-alpha (182-190)
HLDEAIHVL

SEQ ID NO: 12724 - protein, 9 aa, Artificial Sequence
  Pre-mRNA-processing factor 17 (71-79)
HLDPAVKEV

SEQ ID NO: 12725 - protein, 9 aa, Artificial Sequence
  Membrane-associated tyrosine- and threonine-specific cdc2-inhibitory kinase (162-170)
HLDVKPANI

SEQ ID NO: 12726 - protein, 9 aa, Artificial Sequence
  DEP domain-containing protein 1B (290-298)
HLFDAFVSV

SEQ ID NO: 12727 - protein, 9 aa, Artificial Sequence
  Clathrin heavy chain 1 (1233-1241)
HLGEYQAAV

SEQ ID NO: 12728 - protein, 9 aa, Artificial Sequence
  Neutral alpha-glucosidase AB (77-85)
HLIHEVTKV

SEQ ID NO: 12729 - protein, 10 aa, Artificial Sequence
  Heat shock protein HSP 90-beta (110-119)
HLKEDQTEYL

SEQ ID NO: 12730 - protein, 9 aa, Artificial Sequence
  Centromere protein F (2031-2039)
HLQEKLQSL

SEQ ID NO: 12731 - protein, 9 aa, Artificial Sequence
  Late secretory pathway protein AVL9 homolog (517-525)
HLSDAIVEV

SEQ ID NO: 12732 - protein, 9 aa, Artificial Sequence
  Leupaxin (99-107)
HLTEMQAKV

SEQ ID NO: 12733 - protein, 11 aa, Artificial Sequence
  Transmembrane protein 2 (1314-1324)
HLYDKGSTIFL

SEQ ID NO: 12734 - protein, 9 aa, Artificial Sequence
  Huntingtin-interacting protein 1 (192-200)
HLYDYTVKL

SEQ ID NO: 12735 - protein, 9 aa, Artificial Sequence
  Beta-lactamase-like protein 2 (145-153)
HTDDHMALL

SEQ ID NO: 12736 - protein, 8 aa, Artificial Sequence
  DNA topoisomerase 2-beta (834-841)
HTDTTVKF

SEQ ID NO: 12737 - protein, 9 aa, Artificial Sequence
  NIPA-like protein 3 (122-130)
IAITAGAIF

SEQ ID NO: 12738 - protein, 9 aa, Artificial Sequence
  Cyclin-dependent kinase 1 (136-144)
IDDKGTIKL

SEQ ID NO: 12739 - protein, 9 aa, Artificial Sequence
  Glucosamine-6-phosphate isomerase 2 (146-154)
IEEGVNHMW

SEQ ID NO: 12740 - protein, 10 aa, Artificial Sequence
  Zinc finger protein ZPR1 (195-204)
IIDDPSGNSF

SEQ ID NO: 12741 - protein, 9 aa, Artificial Sequence
  U5 small nuclear ribonucleoprotein 200 kDa helicase (612-620)
IILDEIHLL

SEQ ID NO: 12742 - protein, 9 aa, Artificial Sequence
  ATP-dependent RNA helicase DDX1 (707-715)
ILAPTVQEL

SEQ ID NO: 12743 - protein, 10 aa, Artificial Sequence
  Prohibitin (164-173)
ILDDVSLTHL

SEQ ID NO: 12744 - protein, 9 aa, Artificial Sequence
  Dihydroxyacetone phosphate acyltransferase (106-114)
ILDEMSHKL

SEQ ID NO: 12745 - protein, 9 aa, Artificial Sequence
  ATP-binding cassette sub-family F member 3 (633-641)
ILDEPTNHL

SEQ ID NO: 12746 - protein, 9 aa, Artificial Sequence
  ATP-binding cassette sub-family F member 1 (765-773)
ILDEPTNNL

SEQ ID NO: 12747 - protein, 9 aa, Artificial Sequence
  U6 snRNA-associated Sm-like protein LSm8 (16-24)
ILDESHERV

SEQ ID NO: 12748 - protein, 9 aa, Artificial Sequence
  Coiled-coil domain-containing protein 66 (307-315)
ILDQSRETV

SEQ ID NO: 12749 - protein, 9 aa, Artificial Sequence
  Heterogeneous nuclear ribonucleoprotein U (458-466)
ILDQTNVSA

SEQ ID NO: 12750 - protein, 10 aa, Artificial Sequence
  Actin-like protein 6A (127-136)
ILDSGATHTT

SEQ ID NO: 12751 - protein, 9 aa, Artificial Sequence
  Putative pre-mRNA-splicing factor ATP-dependent RNA helicase DHX16 (531-539)
ILFGLIKDV

SEQ ID NO: 12752 - protein, 9 aa, Artificial Sequence
  Pecanex-like protein 1 (1442-1450)
ILFNKLWEL

SEQ ID NO: 12753 - protein, 11 aa, Artificial Sequence
  Copper chaperone for superoxide dismutase (92-102)
ILGGPGTVQGV

SEQ ID NO: 12754 - protein, 9 aa, Artificial Sequence
  Major facilitator superfamily domain-containing protein 8 (444-452)
ILGPKPQGV

SEQ ID NO: 12755 - protein, 11 aa, Artificial Sequence
  Matrin-3 (67-77)
ILGPPPPSFHL

SEQ ID NO: 12756 - protein, 9 aa, Artificial Sequence
  Integrator complex subunit 7 (849-857)
ILGTHNITV

SEQ ID NO: 12757 - protein, 9 aa, Artificial Sequence
  Cytoplasmic dynein 1 light intermediate chain 2 (245-253)
ILHENFTTV

SEQ ID NO: 12758 - protein, 11 aa, Artificial Sequence
  Adenosylhomocysteinase (339-349)
ILLAEGRLVNL

SEQ ID NO: 12759 - protein, 9 aa, Artificial Sequence
  Protein angel homolog 1 (409-417)
ILLAEVDKV

SEQ ID NO: 12760 - protein, 11 aa, Artificial Sequence
  Arginine-tRNA ligase, cytoplasmic (564-574)
ILLDHEKEWKL

SEQ ID NO: 12761 - protein, 9 aa, Artificial Sequence
  MAP kinase-activating death domain protein (316-324)
ILLEHKVVL

SEQ ID NO: 12762 - protein, 9 aa, Artificial Sequence
  Eukaryotic translation initiation factor 3 subunit K (69-77)
ILLKALTNL

SEQ ID NO: 12763 - protein, 11 aa, Artificial Sequence
  Serine/threonine-protein kinase TAO1 (157-167)
ILLTEPGQVKL

SEQ ID NO: 12764 - protein, 9 aa, Artificial Sequence
  Ubiquitin carboxyl-terminal hydrolase 34 (46-54)
ILMDERTFL

SEQ ID NO: 12765 - protein, 10 aa, Artificial Sequence
  Protein BIVM-ERCC5 (1331-1340)
ILNEFPGHGL

SEQ ID NO: 12766 - protein, 10 aa, Artificial Sequence
  Unconventional myosin-Ic (579-588)
ILQSKEPAYV

SEQ ID NO: 12767 - protein, 9 aa, Artificial Sequence
  Cohesin subunit SA-2 (1002-1010)
ILSEFSSKL

SEQ ID NO: 12768 - protein, 9 aa, Artificial Sequence
  TELO2-interacting protein 1 homolog (373-381)
ILSESLHSL

SEQ ID NO: 12769 - protein, 9 aa, Artificial Sequence
  Nuclear pore complex protein Nup153 (39-47)
ILSRVTESV

SEQ ID NO: 12770 - protein, 9 aa, Artificial Sequence
  XAGE1D protein (105-113)
ILTSIQSLL

SEQ ID NO: 12771 - protein, 9 aa, Artificial Sequence
  Importin-11 (663-671)
ILTTLIHLV

SEQ ID NO: 12772 - protein, 9 aa, Artificial Sequence
  A-kinase anchor protein 10, mitochondrial (437-445)
ILYDKYFSL

SEQ ID NO: 12773 - protein, 9 aa, Artificial Sequence
  Signal transducer and activator of transcription 3 (96-104)
IMDATNILV

SEQ ID NO: 12774 - protein, 9 aa, Artificial Sequence
  Long-chain-fatty-acid-CoA ligase 3 (386-394)
IMDRIYKNV

SEQ ID NO: 12775 - protein, 11 aa, Artificial Sequence
  Syntaxin-binding protein 6 (160-170)
IMGGNSILHSA

SEQ ID NO: 12776 - protein, 10 aa, Artificial Sequence
  Small nuclear ribonucleoprotein E (64-73)
IMLKGDNITL

SEQ ID NO: 12777 - protein, 9 aa, Artificial Sequence
  Talin-1 (100-108)
IMVDDSKTV

SEQ ID NO: 12778 - protein, 9 aa, Artificial Sequence
  Zinc finger MIZ domain-containing protein 1 (736-744)
IQHSEFEEV

SEQ ID NO: 12779 - protein, 9 aa, Artificial Sequence
  L-lactate dehydrogenase A chain (329-337)
ISDLVKVTL

SEQ ID NO: 12780 - protein, 9 aa, Artificial Sequence
  Protein cramped-like (737-745)
ISTEVNPKL

SEQ ID NO: 12781 - protein, 9 aa, Artificial Sequence
  Transmembrane protein 261 (13-21)
ITAPPGTAA

SEQ ID NO: 12782 - protein, 10 aa, Artificial Sequence
  Apoptosis-resistant E3 ubiquitin protein ligase 1 (140-149)
ITVKLGGLNV

SEQ ID NO: 12783 - protein, 9 aa, Artificial Sequence
  Alpha-adducin (206-214)
IVDRGSTNL

SEQ ID NO: 12784 - protein, 8 aa, Artificial Sequence
  NADH dehydrogenase (ubiquinone) 1 beta subcomplex subunit 10 (34-41)
IVDRPVTL

SEQ ID NO: 12785 - protein, 9 aa, Artificial Sequence
  1-phosphatidylinositol 3-phosphate 5-kinase (742-750)
IVDVRPTLV

SEQ ID NO: 12786 - protein, 9 aa, Artificial Sequence
  Cytoplasmic dynein 1 heavy chain 1 (132-140)
IVMQEVETV

SEQ ID NO: 12787 - protein, 9 aa, Artificial Sequence
  Eukaryotic translation initiation factor 3 subunit B (187-195)
IVVDNVPQV

SEQ ID NO: 12788 - protein, 9 aa, Artificial Sequence
  Trifunctional purine biosynthetic protein adenosine-3 (125-133)
KAFTKPEEA

SEQ ID NO: 12789 - protein, 9 aa, Artificial Sequence
  T-complex protein 1 subunit zeta (84-92)
KALQFLEEV

SEQ ID NO: 12790 - protein, 9 aa, Artificial Sequence
  Endonuclease G, mitochondrial (153-161)
KAMDDTFYL

SEQ ID NO: 12791 - protein, 9 aa, Artificial Sequence
  Histone-lysine N-methyltransferase NSD2 (573-581)
KAMEAASSL

SEQ ID NO: 12792 - protein, 9 aa, Artificial Sequence
  Tubulin alpha-1C chain (350-358)
KAYHEQLTV

SEQ ID NO: 12793 - protein, 10 aa, Artificial Sequence
  Melanoma-associated antigen 1 (160-169)
KEADPTGHSY

SEQ ID NO: 12794 - protein, 10 aa, Artificial Sequence
  Melanoma-associated antigen D2 (337-346)
KEIDKNDHLY

SEQ ID NO: 12795 - protein, 9 aa, Artificial Sequence
  Lysine-specific demethylase 5A (1136-1144)
KEIEAMHSL

SEQ ID NO: 12796 - protein, 9 aa, Artificial Sequence
  Something about silencing protein 10 (380-388)
KEIEDRQKL

SEQ ID NO: 12797 - protein, 10 aa, Artificial Sequence
  Plectin (705-714)
KENAAYFQFF

SEQ ID NO: 12798 - protein, 9 aa, Artificial Sequence
  ATP-binding cassette sub-family F member 3 (472-480)
KESEVVMKF

SEQ ID NO: 12799 - protein, 9 aa, Artificial Sequence
  Kinetochore protein Nuf2 (447-455)
KIDEKTAEL

SEQ ID NO: 12800 - protein, 11 aa, Artificial Sequence
  Interferon-induced, double-stranded RNA-activated protein kinase (388-398)
KIGDFGLVTSL

SEQ ID NO: 12801 - protein, 9 aa, Artificial Sequence
  Cyclin-dependent kinase 1 (9-17)
KIGEGTYGV

SEQ ID NO: 12802 - protein, 9 aa, Artificial Sequence
  DNA mismatch repair protein Msh6 (740-748)
KIIGIMEEV

SEQ ID NO: 12803 - protein, 11 aa, Artificial Sequence
  Arginine-tRNA ligase, cytoplasmic (587-597)
KILDDLFLHTL

SEQ ID NO: 12804 - protein, 10 aa, Artificial Sequence
  Vacuolar protein sorting-associated protein 41 homolog (318-327)
KILDIGLAYI

SEQ ID NO: 12805 - protein, 10 aa, Artificial Sequence
  Signal transducer and activator of transcription 3 (658-667)
KIMDATNILV

SEQ ID NO: 12806 - protein, 9 aa, Artificial Sequence
  UPF0568 protein C14orf166 (218-226)
KINEAIVAV

SEQ ID NO: 12807 - protein, 9 aa, Artificial Sequence
  Cell division cycle protein 27 homolog (380-388)
KISTITPQI

SEQ ID NO: 12808 - protein, 9 aa, Artificial Sequence
  Calpain-7 (56-64)
KITEYLERV

SEQ ID NO: 12809 - protein, 11 aa, Artificial Sequence
  Pre-mRNA-processing factor 19 (375-385)
KIWDLKERTNV

SEQ ID NO: 12810 - protein, 11 aa, Artificial Sequence
  Probable ATP-dependent RNA helicase DDX60 (16-26)
KLADMNQEYQL

SEQ ID NO: 12811 - protein, 9 aa, Artificial Sequence
  WD repeat-containing protein 11 (1062-1070)
KLAEGVQLL

SEQ ID NO: 12812 - protein, 9 aa, Artificial Sequence
  KAT8 regulatory NSL complex subunit 1 (21-29)
KLAPPSSTL

SEQ ID NO: 12813 - protein, 9 aa, Artificial Sequence
  Dolichol-phosphate mannosyltransferase subunit 3 (24-32)
KLAQWLWGL

SEQ ID NO: 12814 - protein, 9 aa, Artificial Sequence
  DnaJ homolog subfamily C member 7 (322-330)
KLDDTYIKA

SEQ ID NO: 12815 - protein, 9 aa, Artificial Sequence
  Nuclear transcription factor Y subunit gamma (53-61)
KLDEDVKMI

SEQ ID NO: 12816 - protein, 9 aa, Artificial Sequence
  Coronin-1C (493-501)
KLDEILKEI

SEQ ID NO: 12817 - protein, 9 aa, Artificial Sequence
  Protein LAP2 (759-767)
KLDHINMNL

SEQ ID NO: 12818 - protein, 9 aa, Artificial Sequence
  Protein NPAT (88-96)
KLDHTLSQI

SEQ ID NO: 12819 - protein, 9 aa, Artificial Sequence
  Rab3 GTPase-activating protein catalytic subunit (784-792)
KLEEIIHQI

SEQ ID NO: 12820 - protein, 10 aa, Artificial Sequence
  Vacuolar protein sorting-associated protein 35 (323-332)
KLFDIFSQQV

SEQ ID NO: 12821 - protein, 9 aa, Artificial Sequence
  Transmembrane protein 223 (189-197)
KLFDNTVGA

SEQ ID NO: 12822 - protein, 9 aa, Artificial Sequence
  tRNA wybutosine-synthesizing protein 2 homolog (32-40)
KLFDTQHRV

SEQ ID NO: 12823 - protein, 11 aa, Artificial Sequence
  Testin (65-75)
KLFEDTKYTTL

SEQ ID NO: 12824 - protein, 9 aa, Artificial Sequence
  T-complex protein 11-like protein 2 (131-139)
KLFEEIREI

SEQ ID NO: 12825 - protein, 9 aa, Artificial Sequence
  Exportin-1 (568-576)
KLFEFMHET

SEQ ID NO: 12826 - protein, 9 aa, Artificial Sequence
  TATA box-binding protein-associated factor RNA polymerase I subunit B (312-320)
KLFEKKYSV

SEQ ID NO: 12827 - protein, 11 aa, Artificial Sequence
  Retinoic acid-induced protein 1 (1841-1851)
KLFGLQEAMKV

SEQ ID NO: 12828 - protein, 9 aa, Artificial Sequence
  Rab-like protein 2A (105-113)
KLFNDAIRL

SEQ ID NO: 12829 - protein, 9 aa, Artificial Sequence
  WD repeat-containing protein 3 (837-845)
KLFNEFIQL

SEQ ID NO: 12830 - protein, 11 aa, Artificial Sequence
  Asparagine synthetase (glutamine-hydrolyzing) (138-148)
KLFPGFEIETV

SEQ ID NO: 12831 - protein, 9 aa, Artificial Sequence
  Splicing factor 3B subunit 3 (769-777)
KLGAVFNQV

SEQ ID NO: 12832 - protein, 9 aa, Artificial Sequence
  Membrane-associated tyrosine- and threonine-specific cdc2-inhibitory kinase (179-187)
KLGDFGLLV

SEQ ID NO: 12833 - protein, 8 aa, Artificial Sequence
  Pre-mRNA-splicing factor ATP-dependent RNA helicase PRP16 (474-481)
KLGDIMGV

SEQ ID NO: 12834 - protein, 9 aa, Artificial Sequence
  Inactive ubiquitin carboxyl-terminal hydrolase 54 (272-280)
KLGDLFFRV

SEQ ID NO: 12835 - protein, 9 aa, Artificial Sequence
  Probable ATP-dependent RNA helicase DHX37 (678-686)
KLGDLMVLL

SEQ ID NO: 12836 - protein, 8 aa, Artificial Sequence
  Ras GTPase-activating-like protein IQGAP1 (161-168)
KLGLAPQI

SEQ ID NO: 12837 - protein, 9 aa, Artificial Sequence
  Neutral amino acid transporter B(0) (45-53)
KLGPEGELL

SEQ ID NO: 12838 - protein, 10 aa, Artificial Sequence
  Nicotinamide phosphoribosyltransferase (189-198)
KLHDFGYRGV

SEQ ID NO: 12839 - protein, 9 aa, Artificial Sequence
  AP-2 complex subunit beta (147-155)
KLHDINAQM

SEQ ID NO: 12840 - protein, 9 aa, Artificial Sequence
  Inner nuclear membrane protein Man1 (532-540)
KLHDRLAQL

SEQ ID NO: 12841 - protein, 9 aa, Artificial Sequence
  Ribosomal protein S6 kinase alpha-4 (94-102)
KLHLILDYV

SEQ ID NO: 12842 - protein, 9 aa, Artificial Sequence
  E3 ubiquitin-protein ligase HECTD1 (525-533)
KLIAVLESI

SEQ ID NO: 12843 - protein, 9 aa, Artificial Sequence
  Serine/threonine-protein phosphatase 6 regulatory subunit 3 (43-51)
KLIEFLLKA

SEQ ID NO: 12844 - protein, 9 aa, Artificial Sequence
  ATP-dependent RNA helicase DDX18 (507-515)
KLIEKNYFL

SEQ ID NO: 12845 - protein, 9 aa, Artificial Sequence
  Early endosome antigen 1 (1075-1083)
KLIQELKTA

SEQ ID NO: 12846 - protein, 9 aa, Artificial Sequence
  Centrosomal protein of 57 kDa (383-391)
KLIQESPTV

SEQ ID NO: 12847 - protein, 9 aa, Artificial Sequence
  Transmembrane protein 209 (50-58)
KLISSYYNV

SEQ ID NO: 12848 - protein, 9 aa, Artificial Sequence
  Kelch-like protein 7 (25-33)
KLLAGFMGV

SEQ ID NO: 12849 - protein, 10 aa, Artificial Sequence
  Vacuolar protein sorting-associated protein 35 (14-23)
KLLDEAIQAV

SEQ ID NO: 12850 - protein, 11 aa, Artificial Sequence
  40S ribosomal protein S17 (107-117)
KLLDFGSLSNL

SEQ ID NO: 12851 - protein, 9 aa, Artificial Sequence
  Ligand of Numb protein X 2 (105-113)
KLLDKLLVL

SEQ ID NO: 12852 - protein, 11 aa, Artificial Sequence
  DDB1- and CUL4-associated factor 16 (79-89)
KLLDPSTPVHI

SEQ ID NO: 12853 - protein, 11 aa, Artificial Sequence
  HCG2044777 (36-46)
KLLDTMVDTFL

SEQ ID NO: 12854 - protein, 11 aa, Artificial Sequence
  E3 ubiquitin-protein ligase DTX3L (386-396)
KLLETELLQEI

SEQ ID NO: 12855 - protein, 9 aa, Artificial Sequence
  GRIP and coiled-coil domain-containing protein 2 (1083-1091)
KLLEVQILE

SEQ ID NO: 12856 - protein, 10 aa, Artificial Sequence
  GRIP and coiled-coil domain-containing protein 2 (1083-1092)
KLLEVQILEV

SEQ ID NO: 12857 - protein, 11 aa, Artificial Sequence
  V-type proton ATPase subunit H (396-406)
KLLEVSDDPQV

SEQ ID NO: 12858 - protein, 9 aa, Artificial Sequence
  TELO2-interacting protein 2 (122-130)
KLLGKVETA

SEQ ID NO: 12859 - protein, 10 aa, Artificial Sequence
  TELO2-interacting protein 1 homolog (409-418)
KLLGPKINFV

SEQ ID NO: 12860 - protein, 9 aa, Artificial Sequence
  Bromodomain-containing protein 9 (476-484)
KLLQDLHEA

SEQ ID NO: 12861 - protein, 9 aa, Artificial Sequence
  Zinc finger protein 644 (475-483)
KLMEEIREL

SEQ ID NO: 12862 - protein, 9 aa, Artificial Sequence
  ATP-binding cassette sub-family F member 2 (188-196)
KLMELYERL

SEQ ID NO: 12863 - protein, 9 aa, Artificial Sequence
  Dual specificity protein phosphatase 10 (474-482)
KLMGVETVV

SEQ ID NO: 12864 - protein, 9 aa, Artificial Sequence
  Tax1-binding protein 1 (296-304)
KLMSEVQTL

SEQ ID NO: 12865 - protein, 9 aa, Artificial Sequence
  S-adenosylmethionine synthase isoform type-2 (159-167)
KLNAKLAEL

SEQ ID NO: 12866 - protein, 9 aa, Artificial Sequence
  Coatomer subunit alpha (1002-1010)
KLNDLIQRL

SEQ ID NO: 12867 - protein, 9 aa, Artificial Sequence
  THAP domain-containing protein 4 (389-397)
KLQEKLDEL

SEQ ID NO: 12868 - protein, 9 aa, Artificial Sequence
  E3 ubiquitin-protein ligase BRE1A (194-202)
KLQEKVELL

SEQ ID NO: 12869 - protein, 9 aa, Artificial Sequence
  DNA topoisomerase I, mitochondrial (529-537)
KLQEQLAQL

SEQ ID NO: 12870 - protein, 11 aa, Artificial Sequence
  Ectopic P granules protein 5 homolog (535-545)
KLQPTPGIQKV

SEQ ID NO: 12871 - protein, 9 aa, Artificial Sequence
  Unconventional myosin-Id (406-414)
KLQQLFIQL

SEQ ID NO: 12872 - protein, 9 aa, Artificial Sequence
  NFATC2-interacting protein (17-25)
KLSEVNKRL

SEQ ID NO: 12873 - protein, 9 aa, Artificial Sequence
  ATPase family AAA domain-containing protein 1 (68-76)
KLSEYEMSI

SEQ ID NO: 12874 - protein, 9 aa, Artificial Sequence
  Serpin H1 (262-270)
KLSSLIILM

SEQ ID NO: 12875 - protein, 9 aa, Artificial Sequence
  Coiled-coil domain-containing protein 93 (26-34)
KLTEILELL

SEQ ID NO: 12876 - protein, 9 aa, Artificial Sequence
  Protein Hook homolog 1 (556-564)
KLTEVHEEL

SEQ ID NO: 12877 - protein, 9 aa, Artificial Sequence
  Polypeptide N-acetylgalactosaminyltransferase 18 (204-212)
KLTEYVDKV

SEQ ID NO: 12878 - protein, 9 aa, Artificial Sequence
  Kinesin-like protein KIF1C (839-847)
KLTGILQEV

SEQ ID NO: 12879 - protein, 9 aa, Artificial Sequence
  Actin-related protein 2/3 complex subunit 4 (130-138)
KLVDFVIHF

SEQ ID NO: 12880 - protein, 11 aa, Artificial Sequence
  Caprin-1 (191-201)
KLVDPERDMSL

SEQ ID NO: 12881 - protein, 9 aa, Artificial Sequence
  Lysine-tRNA ligase (474-482)
KLVGEFLEV

SEQ ID NO: 12882 - protein, 9 aa, Artificial Sequence
  Baculoviral IAP repeat-containing protein 6 (860-868)
KLVNILVQL

SEQ ID NO: 12883 - protein, 9 aa, Artificial Sequence
  Eukaryotic peptide chain release factor GTP-binding subunit ERF3A (239-247)
KLVPFLKKV

SEQ ID NO: 12884 - protein, 9 aa, Artificial Sequence
  Trafficking protein particle complex subunit 11 (245-253)
KLWADRISL

SEQ ID NO: 12885 - protein, 9 aa, Artificial Sequence
  Pecanex-like protein 1 (1446-1454)
KLWELLYKL

SEQ ID NO: 12886 - protein, 9 aa, Artificial Sequence
  Intraflagellar transport protein 27 homolog (77-85)
KLWESPNVL

SEQ ID NO: 12887 - protein, 11 aa, Artificial Sequence
  Transducin-like enhancer protein 4 (308-318)
KLWTGGLDNTV

SEQ ID NO: 12888 - protein, 10 aa, Artificial Sequence
  Cytochrome P450 4V2 (91-100)
KLWVGPVPMV

SEQ ID NO: 12889 - protein, 9 aa, Artificial Sequence
  Intraflagellar transport protein 172 homolog (352-360)
KLYDDMIRL

SEQ ID NO: 12890 - protein, 9 aa, Artificial Sequence
  General transcription factor II-I repeat domain-containing protein 2B (841-849)
KLYESELTL

SEQ ID NO: 12891 - protein, 9 aa, Artificial Sequence
  DNA-directed RNA polymerase I subunit RPA1 (386-394)
KLYNIWIRL

SEQ ID NO: 12892 - protein, 11 aa, Artificial Sequence
  Regulator of nonsense transcripts 1 (816-826)
KLYQEVEIASV

SEQ ID NO: 12893 - protein, 9 aa, Artificial Sequence
  Glutamine-tRNA ligase (401-409)
KMDPVAYRV

SEQ ID NO: 12894 - protein, 9 aa, Artificial Sequence
  Adiponectin receptor protein 1 (79-87)
KMEEFVYKV

SEQ ID NO: 12895 - protein, 9 aa, Artificial Sequence
  NADH dehydrogenase (ubiquinone) iron-sulfur protein 2, mitochondrial (1-9)
KMFEFYERV

SEQ ID NO: 12896 - protein, 10 aa, Artificial Sequence
  cAMP-dependent protein kinase type II-alpha regulatory subunit (222-231)
KMFESFIESV

SEQ ID NO: 12897 - protein, 10 aa, Artificial Sequence
  3-hydroxy-3-methylglutaryl-coenzyme A reductase (314-323)
KMISMDIEQV

SEQ ID NO: 12898 - protein, 11 aa, Artificial Sequence
  Serine/threonine-protein kinase SIK2 (72-82)
KMLDHPHIIKL

SEQ ID NO: 12899 - protein, 9 aa, Artificial Sequence
  Transmembrane protein 245 (455-463)
KMLDKIISI

SEQ ID NO: 12900 - protein, 10 aa, Artificial Sequence
  Acetyl-CoA acetyltransferase, mitochondrial (365-374)
KMLEIDPQKV

SEQ ID NO: 12901 - protein, 11 aa, Artificial Sequence
  HLA class II histocompatibility antigen, DQ beta 1 chain (229-239)
KMLSGIGGFVL

SEQ ID NO: 12902 - protein, 11 aa, Artificial Sequence
  HLA class II histocompatibility antigen, DRB1-11 beta chain (227-237)
KMLSGVGGFVL

SEQ ID NO: 12903 - protein, 9 aa, Artificial Sequence
  DNA replication licensing factor MCM4 (578-586)
KMNESTRSV

SEQ ID NO: 12904 - protein, 9 aa, Artificial Sequence
  MAP kinase-activating death domain protein (389-397)
KMPDDVWLV

SEQ ID NO: 12905 - protein, 9 aa, Artificial Sequence
  Mitotic spindle assembly checkpoint protein MAD1 (294-302)
KMQETLVGL

SEQ ID NO: 12906 - protein, 9 aa, Artificial Sequence
  Rho GTPase-activating protein 5 (514-522)
KMSEIHTVL

SEQ ID NO: 12907 - protein, 9 aa, Artificial Sequence
  Centromere protein F (1431-1439)
KMSELQTYV

SEQ ID NO: 12908 - protein, 9 aa, Artificial Sequence
  Nucleolar protein 56 (288-296)
KMSQVAPSL

SEQ ID NO: 12909 - protein, 9 aa, Artificial Sequence
  AP-1 complex subunit sigma-1A (29-37)
KMVRELMQV

SEQ ID NO: 12910 - protein, 11 aa, Artificial Sequence
  mRNA export factor (111-121)
KMWDLSSNQAI

SEQ ID NO: 12911 - protein, 9 aa, Artificial Sequence
  Ski oncogene (28-36)
KPSSWLRTL

SEQ ID NO: 12912 - protein, 9 aa, Artificial Sequence
  Breast cancer type 2 susceptibility protein (1180-1188)
KQFEGTVEI

SEQ ID NO: 12913 - protein, 9 aa, Artificial Sequence
  E3 UFM1-protein ligase 1 (402-410)
KQISTLESV

SEQ ID NO: 12914 - protein, 9 aa, Artificial Sequence
  General transcription factor II-I (532-540)
KQVEEIFNL

SEQ ID NO: 12915 - protein, 9 aa, Artificial Sequence
  Ribonuclease H2 subunit B (295-303)
KSIDTFFGV

SEQ ID NO: 12916 - protein, 9 aa, Artificial Sequence
  Zinc finger MYM-type protein 3 (414-422)
KTGEVLHEV

SEQ ID NO: 12917 - protein, 11 aa, Artificial Sequence
  PRELI domain-containing protein 1, mitochondrial (157-167)
KTMKGFEYILA

SEQ ID NO: 12918 - protein, 9 aa, Artificial Sequence
  Sister chromatid cohesion protein PDS5 homolog A (1070-1078)
KTNEKLYTV

SEQ ID NO: 12919 - protein, 9 aa, Artificial Sequence
  Pre-rRNA-processing protein TSR1 homolog (106-114)
KVADTILFL

SEQ ID NO: 12920 - protein, 9 aa, Artificial Sequence
  TNFAIP3-interacting protein 2 (330-338)
KVASLLHQV

SEQ ID NO: 12921 - protein, 9 aa, Artificial Sequence
  Polyadenylate-binding protein 4 (602-610)
KVDEAVAVL

SEQ ID NO: 12922 - protein, 10 aa, Artificial Sequence
  Beta-secretase 2 (314-323)
KVFDAVVEAV

SEQ ID NO: 12923 - protein, 9 aa, Artificial Sequence
  Melanoma inhibitory activity protein 3 (259-267)
KVLDKVFRA

SEQ ID NO: 12924 - protein, 9 aa, Artificial Sequence
  Lipopolysaccharide-responsive and beige-like anchor protein (136-144)
KVLGKIEKV

SEQ ID NO: 12925 - protein, 9 aa, Artificial Sequence
  Protein SET (137-145)
KVLSKEFHL

SEQ ID NO: 12926 - protein, 11 aa, Artificial Sequence
  E3 ubiquitin-protein ligase RNF213 (3249-3259)
KVSEEAKSILL

SEQ ID NO: 12927 - protein, 10 aa, Artificial Sequence
  T-complex protein 1 subunit delta (232-241)
KVSNSGITRV

SEQ ID NO: 12928 - protein, 10 aa, Artificial Sequence
  Inhibitor of nuclear factor kappa-B kinase subunit alpha (394-403)
KVWAEAVHYV

SEQ ID NO: 12929 - protein, 9 aa, Artificial Sequence
  TRIO and F-actin-binding protein (548-556)
KYQDVYVEL

SEQ ID NO: 12930 - protein, 9 aa, Artificial Sequence
  Growth arrest-specific protein 7 (317-325)
LADEAEVHL

SEQ ID NO: 12931 - protein, 8 aa, Artificial Sequence
  Heat shock protein HSP 90-beta (497-504)
LDKKVEKV

SEQ ID NO: 12932 - protein, 9 aa, Artificial Sequence
  Glutamine-tRNA ligase (170-178)
LEADLEKKF

SEQ ID NO: 12933 - protein, 9 aa, Artificial Sequence
  GRIP and coiled-coil domain-containing protein 2 (490-498)
LENEQVQKL

SEQ ID NO: 12934 - protein, 9 aa, Artificial Sequence
  ERO1-like protein alpha (69-77)
LESDYFRYY

SEQ ID NO: 12935 - protein, 11 aa, Artificial Sequence
  Lethal(2) giant larvae protein homolog 2 (69-79)
LHQENNAVTQI

SEQ ID NO: 12936 - protein, 9 aa, Artificial Sequence
  Beta-hexosaminidase subunit beta (194-202)
LIDTSRHYL

SEQ ID NO: 12937 - protein, 9 aa, Artificial Sequence
  mRNA cap guanine-N7 methyltransferase (183-191)
LIGEFLEKV

SEQ ID NO: 12938 - protein, 9 aa, Artificial Sequence
  Activating signal cointegrator 1 complex subunit 3 (1174-1182)
LIIDEIHLL

SEQ ID NO: 12939 - protein, 9 aa, Artificial Sequence
  Elongation factor 2 (292-300)
LILDPIFKV

SEQ ID NO: 12940 - protein, 9 aa, Artificial Sequence
  Zinc finger protein 532 (468-476)
LKLANNTTV

SEQ ID NO: 12941 - protein, 9 aa, Artificial Sequence
  Protein TBRG4 (214-222)
LLAELLTHL

SEQ ID NO: 12942 - protein, 9 aa, Artificial Sequence
  Cytoplasmic dynein 1 heavy chain 1 (1716-1724)
LLAESVTEV

SEQ ID NO: 12943 - protein, 9 aa, Artificial Sequence
  m7GpppX diphosphatase (297-305)
LLAEVIENL

SEQ ID NO: 12944 - protein, 9 aa, Artificial Sequence
  E3 ubiquitin-protein ligase UBR2 (617-625)
LLAGLHVLL

SEQ ID NO: 12945 - protein, 11 aa, Artificial Sequence
  MAP kinase-activating death domain protein (367-377)
LLAPTPYIIGV

SEQ ID NO: 12946 - protein, 9 aa, Artificial Sequence
  Peroxiredoxin-5, mitochondrial (164-172)
LLDDSLVSI

SEQ ID NO: 12947 - protein, 10 aa, Artificial Sequence
  Beta-adrenergic receptor kinase 1 (324-333)
LLDEHGHVRI

SEQ ID NO: 12948 - protein, 9 aa, Artificial Sequence
  Lon protease homolog 2, peroxisomal (678-686)
LLDNTDIHL

SEQ ID NO: 12949 - protein, 9 aa, Artificial Sequence
  Coatomer subunit gamma-1 (848-856)
LLDTVTMQV

SEQ ID NO: 12950 - protein, 9 aa, Artificial Sequence
  Serine-protein kinase ATM (1590-1598)
LLEEINHFL

SEQ ID NO: 12951 - protein, 11 aa, Artificial Sequence
  DNA-directed RNA polymerase II subunit RPB11-a (11-21)
LLFEGEKKITI

SEQ ID NO: 12952 - protein, 9 aa, Artificial Sequence
  GCN1 general control of amino-acid synthesis 1-like 1 (1599-1607)
LLGDLLFHI

SEQ ID NO: 12953 - protein, 9 aa, Artificial Sequence
  Transport and Golgi organization protein 6 homolog (991-999)
LLGSVVHEV

SEQ ID NO: 12954 - protein, 9 aa, Artificial Sequence
  Nucleoprotein TPR (1158-1166)
LLHDQIEKL

SEQ ID NO: 12955 - protein, 9 aa, Artificial Sequence
  Sentrin-specific protease 5 (328-336)
LLIPIHLEV

SEQ ID NO: 12956 - protein, 9 aa, Artificial Sequence
  cAMP-dependent protein kinase type I-alpha regulatory subunit (30-38)
LLKDSIVQL

SEQ ID NO: 12957 - protein, 10 aa, Artificial Sequence
  Coatomer subunit gamma-1 (847-856)
LLLDTVTMQV

SEQ ID NO: 12958 - protein, 9 aa, Artificial Sequence
  ATP-binding cassette sub-family B member 8, mitochondrial (150-158)
LLLGQLVEV

SEQ ID NO: 12959 - protein, 11 aa, Artificial Sequence
  Ubiquitin/ISG15-conjugating enzyme E2 L6 (38-48)
LLLPDQPPYHL

SEQ ID NO: 12960 - protein, 11 aa, Artificial Sequence
  E3 ubiquitin-protein ligase listerin (646-656)
LLMPSSEDLLL

SEQ ID NO: 12961 - protein, 9 aa, Artificial Sequence
  Kelch-like protein 12 (470-478)
LLNDHIYVV

SEQ ID NO: 12962 - protein, 9 aa, Artificial Sequence
  Polyadenylate-binding protein 4 (162-170)
LLNDRKVFV

SEQ ID NO: 12963 - protein, 10 aa, Artificial Sequence
  Staphylococcal nuclease domain-containing protein 1 (187-196)
LLPDYYLVTV

SEQ ID NO: 12964 - protein, 10 aa, Artificial Sequence
  tRNA-dihydrouridine(47) synthase (NAD(P)(+))-like (208-217)
LLPELRDWGV

SEQ ID NO: 12965 - protein, 9 aa, Artificial Sequence
  Activating molecule in BECN1-regulated autophagy protein 1 (810-818)
LLPEYLPYA

SEQ ID NO: 12966 - protein, 9 aa, Artificial Sequence
  Transportin-1 (394-402)
LLPHILPLL

SEQ ID NO: 12967 - protein, 9 aa, Artificial Sequence
  Angiomotin-like protein 1 (845-853)
LLPPPPTSA

SEQ ID NO: 12968 - protein, 9 aa, Artificial Sequence
  ATP-citrate synthase (43-51)
LLQDHPWLL

SEQ ID NO: 12969 - protein, 9 aa, Artificial Sequence
  Pleckstrin homology domain-containing family A member 4 (400-408)
LLQDRLVSV

SEQ ID NO: 12970 - protein, 9 aa, Artificial Sequence
  T-complex protein 1 subunit epsilon (314-322)
LLQNNLPAV

SEQ ID NO: 12971 - protein, 9 aa, Artificial Sequence
  Nuclear factor erythroid 2-related factor 1 (371-379)
LLREKVEFL

SEQ ID NO: 12972 - protein, 9 aa, Artificial Sequence
  Eukaryotic translation initiation factor 4 gamma 3 (1361-1369)
LLSEILHLL

SEQ ID NO: 12973 - protein, 9 aa, Artificial Sequence
  Liprin-alpha-3 (437-445)
LLSESNERL

SEQ ID NO: 12974 - protein, 10 aa, Artificial Sequence
  Cyclin-dependent kinase 11B (556-565)
LLSHAGILKV

SEQ ID NO: 12975 - protein, 9 aa, Artificial Sequence
  TATA-binding protein-associated factor 172 (43-51)
LLSKVLIYL

SEQ ID NO: 12976 - protein, 9 aa, Artificial Sequence
  Ras GTPase-activating protein-binding protein 1 (97-105)
LLSNNNQAL

SEQ ID NO: 12977 - protein, 9 aa, Artificial Sequence
  Fasciculation and elongation protein zeta-2 (365-373)
LLTDYILKV

SEQ ID NO: 12978 - protein, 9 aa, Artificial Sequence
  5'-nucleotidase domain-containing protein 3 (276-284)
LLWDKIHKL

SEQ ID NO: 12979 - protein, 10 aa, Artificial Sequence
  Cyclic AMP-dependent transcription factor ATF-6 beta (206-215)
LLWDVPAPSL

SEQ ID NO: 12980 - protein, 11 aa, Artificial Sequence
  Protein KIAA0100 (525-535)
LLWSPPDHMYL

SEQ ID NO: 12981 - protein, 9 aa, Artificial Sequence
  Growth arrest-specific protein 8 (22-30)
LLYEHQNNL

SEQ ID NO: 12982 - protein, 10 aa, Artificial Sequence
  ATP-dependent RNA helicase DHX29 (149-158)
LLYGGDLHSA

SEQ ID NO: 12983 - protein, 9 aa, Artificial Sequence
  Catenin alpha-1 (702-710)
LMNAVVQTV

SEQ ID NO: 12984 - protein, 9 aa, Artificial Sequence
  Transient receptor potential cation channel subfamily V member 2 (644-652)
LMSETVNSV

SEQ ID NO: 12985 - protein, 9 aa, Artificial Sequence
  5'-3' exoribonuclease 2 (347-355)
LPHLPSLEI

SEQ ID NO: 12986 - protein, 9 aa, Artificial Sequence
  Exosome component 10 (544-552)
LPKEPQGII

SEQ ID NO: 12987 - protein, 8 aa, Artificial Sequence
  Girdin (733-740)
LPRASSVI

SEQ ID NO: 12988 - protein, 9 aa, Artificial Sequence
  Cytoskeleton-associated protein 5 (598-606)
LPWTAEQVV

SEQ ID NO: 12989 - protein, 9 aa, Artificial Sequence
  SLIT-ROBO Rho GTPase-activating protein 2 (519-527)
LQHEGIFRV

SEQ ID NO: 12990 - protein, 11 aa, Artificial Sequence
  DNA dC-dU-editing enzyme APOBEC-3A (64-74)
LQLDPAQIYRV

SEQ ID NO: 12991 - protein, 9 aa, Artificial Sequence
  N-acetylgalactosamine kinase (236-244)
LQWDKVLRL

SEQ ID NO: 12992 - protein, 9 aa, Artificial Sequence
  ATP-binding cassette sub-family A member 7 (407-415)
LSLDKLEAA

SEQ ID NO: 12993 - protein, 9 aa, Artificial Sequence
  U6 snRNA-associated Sm-like protein LSm4 (4-12)
LSLLKTAQN

SEQ ID NO: 12994 - protein, 9 aa, Artificial Sequence
  Pre-mRNA-processing-splicing factor 8 (249-257)
LVDDNYFYL

SEQ ID NO: 12995 - protein, 10 aa, Artificial Sequence
  Protein PRRC2B (148-157)
LVYEGQLSQA

SEQ ID NO: 12996 - protein, 9 aa, Artificial Sequence
  E3 ubiquitin-protein ligase Hakai (268-276)
MAPPPPRSV

SEQ ID NO: 12997 - protein, 9 aa, Artificial Sequence
  Eukaryotic translation initiation factor 4 gamma 1 (1290-1298)
MEIDIPHVW

SEQ ID NO: 12998 - protein, 10 aa, Artificial Sequence
  Keratinocyte-associated transmembrane protein 2 (176-185)
MEIEQSVKSF

SEQ ID NO: 12999 - protein, 9 aa, Artificial Sequence
  E3 ubiquitin-protein ligase UBR1 (380-388)
MEMEYKKLF

SEQ ID NO: 13000 - protein, 9 aa, Artificial Sequence
  Intron-binding protein aquarius (94-102)
MEQSLFTRF

SEQ ID NO: 13001 - protein, 9 aa, Artificial Sequence
  Riboflavin kinase (85-93)
METHIMHTF

SEQ ID NO: 13002 - protein, 9 aa, Artificial Sequence
  Adenosylhomocysteinase (210-218)
MIAGKVAVV

SEQ ID NO: 13003 - protein, 9 aa, Artificial Sequence
  TFIIH basal transcription factor complex helicase XPB subunit (438-446)
MILDEVHTI

SEQ ID NO: 13004 - protein, 9 aa, Artificial Sequence
  GPN-loop GTPase 3 (162-170)
MISLEIPQV

SEQ ID NO: 13005 - protein, 9 aa, Artificial Sequence
  DNA replication licensing factor MCM5 (531-539)
MLAKHVITL

SEQ ID NO: 13006 - protein, 9 aa, Artificial Sequence
  Microtubule-associated protein RP/EB family member 1 (20-28)
MLAWINESL

SEQ ID NO: 13007 - protein, 9 aa, Artificial Sequence
  Protein SSXT (28-36)
MLDDNNHLI

SEQ ID NO: 13008 - protein, 9 aa, Artificial Sequence
  Nucleoporin NUP188 homolog (296-304)
MLDDRAYLV

SEQ ID NO: 13009 - protein, 9 aa, Artificial Sequence
  Nitrogen permease regulator 3-like protein (542-550)
MLFDKFRSV

SEQ ID NO: 13010 - protein, 11 aa, Artificial Sequence
  Protein zyg-11 homolog B (424-434)
MLIEEGGLQHL

SEQ ID NO: 13011 - protein, 9 aa, Artificial Sequence
  AP-3 complex subunit beta-1 (138-146)
MLIEVIEKL

SEQ ID NO: 13012 - protein, 9 aa, Artificial Sequence
  1-phosphatidylinositol 3-phosphate 5-kinase (763-771)
MLLEHGITL

SEQ ID NO: 13013 - protein, 10 aa, Artificial Sequence
  Eukaryotic translation initiation factor 3 subunit C-like protein (692-701)
MLLEIPYMAA

SEQ ID NO: 13014 - protein, 9 aa, Artificial Sequence
  Mitochondrial import receptor subunit TOM20 homolog (121-129)
MLLTKLPTI

SEQ ID NO: 13015 - protein, 9 aa, Artificial Sequence
  Beta-2-syntrophin (451-459)
MLNGQEVRL

SEQ ID NO: 13016 - protein, 10 aa, Artificial Sequence
  SH3KBP1-binding protein 1 (437-446)
MLSEKHLISV

SEQ ID NO: 13017 - protein, 9 aa, Artificial Sequence
  BRCA1-A complex subunit BRE (13-21)
MLSPFISSV

SEQ ID NO: 13018 - protein, 9 aa, Artificial Sequence
  Nesprin-2 (4298-4306)
MLTEIEHKV

SEQ ID NO: 13019 - protein, 9 aa, Artificial Sequence
  T-complex protein 1 subunit eta (97-105)
MMLDDLLQL

SEQ ID NO: 13020 - protein, 9 aa, Artificial Sequence
  ATP-dependent RNA helicase DDX18 (187-195)
MPRNGTGVL

SEQ ID NO: 13021 - protein, 11 aa, Artificial Sequence
  Abhydrolase domain-containing protein 2 (301-311)
MQIDDNVMRKF

SEQ ID NO: 13022 - protein, 9 aa, Artificial Sequence
  Bifunctional glutamate/proline-tRNA ligase (589-597)
NADGKIISL

SEQ ID NO: 13023 - protein, 9 aa, Artificial Sequence
  HEAT repeat-containing protein 1 (1568-1576)
NADKLTVKF

SEQ ID NO: 13024 - protein, 8 aa, Artificial Sequence
  Eukaryotic translation initiation factor 3 subunit C-like protein (434-441)
NADQPLRV

SEQ ID NO: 13025 - protein, 9 aa, Artificial Sequence
  Inner centromere protein (178-186)
NAEQHVTQL

SEQ ID NO: 13026 - protein, 9 aa, Artificial Sequence
  Serine/threonine-protein phosphatase 4 regulatory subunit 3B (168-176)
NEGYIKKLL

SEQ ID NO: 13027 - protein, 8 aa, Artificial Sequence
  tRNA (cytosine(34)-C(5))-methyltransferase (262-269)
NELPGLKW

SEQ ID NO: 13028 - protein, 9 aa, Artificial Sequence
  Nuclear factor erythroid 2-related factor 2 (459-467)
NEMMSKEQF

SEQ ID NO: 13029 - protein, 10 aa, Artificial Sequence
  DDB1- and CUL4-associated factor 8 (367-376)
NENNGVLKKF

SEQ ID NO: 13030 - protein, 9 aa, Artificial Sequence
  Syntaxin-binding protein 3 (434-442)
NESDMIRNW

SEQ ID NO: 13031 - protein, 9 aa, Artificial Sequence
  Unconventional myosin-XVIIIa (417-425)
NESSVLHTL

SEQ ID NO: 13032 - protein, 11 aa, Artificial Sequence
  FACT complex subunit SPT16 (585-595)
NIFPNPEATFV

SEQ ID NO: 13033 - protein, 9 aa, Artificial Sequence
  Ras GTPase-activating-like protein IQGAP3 (896-904)
NIMDIKIGL

SEQ ID NO: 13034 - protein, 9 aa, Artificial Sequence
  Protein TRIM6-TRIM34 (430-438)
NIVERLKEV

SEQ ID NO: 13035 - protein, 8 aa, Artificial Sequence
  Calponin-2 (7-14)
NKGPSYGL

SEQ ID NO: 13036 - protein, 9 aa, Artificial Sequence
  Developmentally-regulated GTP-binding protein 1 (83-91)
NLAGVYSEV

SEQ ID NO: 13037 - protein, 9 aa, Artificial Sequence
  Nodal modulator 3 (667-675)
NLDNPIQTV

SEQ ID NO: 13038 - protein, 9 aa, Artificial Sequence
  Ubiquitin-conjugating enzyme E2 J1 (44-52)
NLFEWHFTV

SEQ ID NO: 13039 - protein, 9 aa, Artificial Sequence
  Transcription initiation factor TFIID subunit 1 (767-775)
NLFRAPIYL

SEQ ID NO: 13040 - protein, 9 aa, Artificial Sequence
  Vacuolar fusion protein CCZ1 homolog (460-468)
NLIEVNEEV

SEQ ID NO: 13041 - protein, 9 aa, Artificial Sequence
  GCN1 general control of amino-acid synthesis 1-like 1 (846-854)
NLLRRLWVV

SEQ ID NO: 13042 - protein, 9 aa, Artificial Sequence
  Ras GTPase-activating-like protein IQGAP2 (826-834)
NLMDIKIGL

SEQ ID NO: 13043 - protein, 9 aa, Artificial Sequence
  Iron-responsive element-binding protein 2 (380-388)
NLNSIVPSV

SEQ ID NO: 13044 - protein, 9 aa, Artificial Sequence
  Phosphoserine aminotransferase (58-66)
NLVRELLAV

SEQ ID NO: 13045 - protein, 9 aa, Artificial Sequence
  Zinc finger BED domain-containing protein 4 (1063-1071)
NLWSLVAKV

SEQ ID NO: 13046 - protein, 9 aa, Artificial Sequence
  Ubiquitin-like modifier-activating enzyme 7 (733-741)
NLYAQMHGL

SEQ ID NO: 13047 - protein, 9 aa, Artificial Sequence
  Rho guanine nucleotide exchange factor 2 (717-725)
NLYGLLHGL

SEQ ID NO: 13048 - protein, 9 aa, Artificial Sequence
  RRP12-like protein (634-642)
NLYGQPVAA

SEQ ID NO: 13049 - protein, 11 aa, Artificial Sequence
  Splicing factor 3A subunit 1 (774-784)
NMANGAVIHLA

SEQ ID NO: 13050 - protein, 9 aa, Artificial Sequence
  Protein C12orf4 (534-542)
NMLPQIFRV

SEQ ID NO: 13051 - protein, 9 aa, Artificial Sequence
  Casein kinase II subunit alpha (350-358)
NMMSGISSV

SEQ ID NO: 13052 - protein, 11 aa, Artificial Sequence
  Prefoldin subunit 1 (59-69)
NMYEGVGRMFI

SEQ ID NO: 13053 - protein, 9 aa, Artificial Sequence
  Putative pre-mRNA-splicing factor ATP-dependent RNA helicase DHX16 (701-709)
NPRTGMESL

SEQ ID NO: 13054 - protein, 9 aa, Artificial Sequence
  Histone acetyltransferase p300 (478-486)
NQMPTQPQV

SEQ ID NO: 13055 - protein, 9 aa, Artificial Sequence
  Phosphatidate phosphatase LPIN1 (800-808)
NRPADVYSY

SEQ ID NO: 13056 - protein, 11 aa, Artificial Sequence
  Nuclear valosin-containing protein-like isoform 4 (634-644)
NRPDIIDPAIL

SEQ ID NO: 13057 - protein, 9 aa, Artificial Sequence
  Glyceraldehyde-3-phosphate dehydrogenase (287-295)
NSDTHSSTF

SEQ ID NO: 13058 - protein, 9 aa, Artificial Sequence
  Myosin regulatory light chain 12B (155-163)
NYIEFTRIL

SEQ ID NO: 13059 - protein, 9 aa, Artificial Sequence
  N-acetyllactosaminide beta-1,3-N-acetylglucosaminyltransferase 2 (208-216)
NYRDTFFNL

SEQ ID NO: 13060 - protein, 8 aa, Artificial Sequence
  Vigilin (628-635)
PAKLHNSL

SEQ ID NO: 13061 - protein, 9 aa, Artificial Sequence
  Leucine-rich repeat-containing protein 47 (93-101)
PELGPLPAL

SEQ ID NO: 13062 - protein, 9 aa, Artificial Sequence
  Mitochondrial fission regulator 1 (152-160)
PHPPPPPPP

SEQ ID NO: 13063 - protein, 9 aa, Artificial Sequence
  SCAN domain-containing protein 1 (113-121)
PLGPAPVSV

SEQ ID NO: 13064 - protein, 8 aa, Artificial Sequence
  Long-chain-fatty-acid-CoA ligase 4 (577-584)
PNQKRLTL

SEQ ID NO: 13065 - protein, 9 aa, Artificial Sequence
  Long-chain-fatty-acid-CoA ligase 4 (577-585)
PNQKRLTLL

SEQ ID NO: 13066 - protein, 10 aa, Artificial Sequence
  Proline-rich nuclear receptor coactivator 2 (6-15)
PRLNSADRPM

SEQ ID NO: 13067 - protein, 8 aa, Artificial Sequence
  Protein flightless-1 homolog (882-889)
PRQPPMSL

SEQ ID NO: 13068 - protein, 8 aa, Artificial Sequence
  RHO/RAC effector protein (1130-1137)
PRYLGPAI

SEQ ID NO: 13069 - protein, 9 aa, Artificial Sequence
  Palladin (86-94)
PSPPPPPPP

SEQ ID NO: 13070 - protein, 9 aa, Artificial Sequence
  Forkhead box protein J3 (438-446)
QAPPPPQQV

SEQ ID NO: 13071 - protein, 10 aa, Artificial Sequence
  AT-rich interactive domain-containing protein 1A (1477-1486)
QEFDSGLLHW

SEQ ID NO: 13072 - protein, 10 aa, Artificial Sequence
  Rho GTPase-activating protein 35 (914-923)
QEIDGRFTSI

SEQ ID NO: 13073 - protein, 11 aa, Artificial Sequence
  Translin-associated protein X (106-116)
QELSGEDMHQF

SEQ ID NO: 13074 - protein, 9 aa, Artificial Sequence
  Acetyl-CoA carboxylase 1 (270-278)
QENDFSKRI

SEQ ID NO: 13075 - protein, 10 aa, Artificial Sequence
  Lamin-B receptor (157-166)
QESSYIATQY

SEQ ID NO: 13076 - protein, 9 aa, Artificial Sequence
  Death-associated protein kinase 3 (122-130)
QILDGVHYL

SEQ ID NO: 13077 - protein, 9 aa, Artificial Sequence
  Dynamin-like 120 kDa protein, mitochondrial (953-961)
QLAEDLKKV

SEQ ID NO: 13078 - protein, 9 aa, Artificial Sequence
  Epidermal growth factor receptor kinase substrate 8 (455-463)
QLAESVANV

SEQ ID NO: 13079 - protein, 10 aa, Artificial Sequence
  Transforming acidic coiled-coil-containing protein 3 (776-785)
QLANEEIAQV

SEQ ID NO: 13080 - protein, 10 aa, Artificial Sequence
  E3 ubiquitin-protein ligase BRE1B (68-77)
QLDEARGLLL

SEQ ID NO: 13081 - protein, 9 aa, Artificial Sequence
  Tyrosine-protein phosphatase non-receptor type 12 (162-170)
QLFEKQLQL

SEQ ID NO: 13082 - protein, 10 aa, Artificial Sequence
  Phospholipase A1 member A (177-186)
QLFGGQLGQI

SEQ ID NO: 13083 - protein, 9 aa, Artificial Sequence
  CDK5 regulatory subunit-associated protein 2 (1222-1230)
QLFSEIHNL

SEQ ID NO: 13084 - protein, 9 aa, Artificial Sequence
  Trinucleotide repeat-containing gene 18 protein (900-908)
QLFSQQHFL

SEQ ID NO: 13085 - protein, 9 aa, Artificial Sequence
  Dual specificity protein phosphatase 14 (157-165)
QLIDYERQL

SEQ ID NO: 13086 - protein, 9 aa, Artificial Sequence
  Eyes absent homolog 2 (420-428)
QLIPALAKV

SEQ ID NO: 13087 - protein, 9 aa, Artificial Sequence
  Dual specificity protein phosphatase 6 (193-201)
QLLDFERTL

SEQ ID NO: 13088 - protein, 10 aa, Artificial Sequence
  Circadian clock protein PASD1 (39-48)
QLLDGFMITL

SEQ ID NO: 13089 - protein, 9 aa, Artificial Sequence
  Transport and Golgi organization protein 6 homolog (720-728)
QLLPLLEKV

SEQ ID NO: 13090 - protein, 9 aa, Artificial Sequence
  AP-1 complex subunit beta-1 (483-491)
QLLTAIVKL

SEQ ID NO: 13091 - protein, 9 aa, Artificial Sequence
  tRNA (guanine(26)-N(2))-dimethyltransferase (198-206)
QLNDVAHLV

SEQ ID NO: 13092 - protein, 9 aa, Artificial Sequence
  WD repeat-containing protein 36 (690-698)
QLNEQLVTL

SEQ ID NO: 13093 - protein, 9 aa, Artificial Sequence
  COMM domain-containing protein 8 (116-124)
QLQDFDWQV

SEQ ID NO: 13094 - protein, 9 aa, Artificial Sequence
  Thyroid receptor-interacting protein 11 (1241-1249)
QLQEELHQL

SEQ ID NO: 13095 - protein, 9 aa, Artificial Sequence
  Golgin subfamily A member 4 (1397-1405)
QLTDLNVQL

SEQ ID NO: 13096 - protein, 9 aa, Artificial Sequence
  Eyes absent homolog 3 (439-447)
QLVPALAKV

SEQ ID NO: 13097 - protein, 9 aa, Artificial Sequence
  Nuclear factor NF-kappa-B p105 subunit (558-566)
QLVRDLLEV

SEQ ID NO: 13098 - protein, 9 aa, Artificial Sequence
  Ketosamine-3-kinase (140-148)
QLYQLFHYL

SEQ ID NO: 13099 - protein, 9 aa, Artificial Sequence
  T-complex protein 1 subunit epsilon (184-192)
QMAEIAVNA

SEQ ID NO: 13100 - protein, 9 aa, Artificial Sequence
  Spectrin beta chain, non-erythrocytic 1 (1423-1431)
QMLENQMEV

SEQ ID NO: 13101 - protein, 11 aa, Artificial Sequence
  Signal transducer and activator of transcription 1-alpha/beta (8-18)
QQLDSKFLEQV

SEQ ID NO: 13102 - protein, 11 aa, Artificial Sequence
  E1A-binding protein p400 (1051-1061)
QQTPVASIQQV

SEQ ID NO: 13103 - protein, 8 aa, Artificial Sequence
  E3 ubiquitin-protein ligase RLIM (173-180)
QRPPTIVL

SEQ ID NO: 13104 - protein, 9 aa, Artificial Sequence
  Cell division cycle protein 27 homolog (580-588)
REHDIAIKF

SEQ ID NO: 13105 - protein, 9 aa, Artificial Sequence
  Small nuclear ribonucleoprotein Sm D2 (102-110)
RGDSVIVVL

SEQ ID NO: 13106 - protein, 11 aa, Artificial Sequence
  DNA topoisomerase 1 (376-386)
RIMPEDIIINC

SEQ ID NO: 13107 - protein, 9 aa, Artificial Sequence
  Cyclin-L2 (140-148)
RIRDVINVF

SEQ ID NO: 13108 - protein, 9 aa, Artificial Sequence
  Prelamin-A/C (91-99)
RLADALQEL

SEQ ID NO: 13109 - protein, 9 aa, Artificial Sequence
  Clathrin heavy chain 1 (1182-1190)
RLAELEEFI

SEQ ID NO: 13110 - protein, 10 aa, Artificial Sequence
  tRNA (cytosine(34)-C(5))-methyltransferase (514-523)
RLAQEGIYTL

SEQ ID NO: 13111 - protein, 10 aa, Artificial Sequence
  RUS1 family protein C16orf58 (165-174)
RLFADILNDV

SEQ ID NO: 13112 - protein, 9 aa, Artificial Sequence
  HEAT repeat-containing protein 2 (253-261)
RLFDDVPQV

SEQ ID NO: 13113 - protein, 9 aa, Artificial Sequence
  BTB/POZ domain-containing protein 2 (2-10)
RLFDEPQLA

SEQ ID NO: 13114 - protein, 11 aa, Artificial Sequence
  WD repeat domain phosphoinositide-interacting protein 4 (219-229)
RLFDTQSKEKL

SEQ ID NO: 13115 - protein, 11 aa, Artificial Sequence
  DDB1- and CUL4-associated factor 4-like protein 1 (246-256)
RLFHDSAVTSV

SEQ ID NO: 13116 - protein, 11 aa, Artificial Sequence
  Histone-lysine N-methyltransferase setd3 (468-478)
RLGEKEILEKA

SEQ ID NO: 13117 - protein, 9 aa, Artificial Sequence
  Plectin (462-470)
RLHERLVAI

SEQ ID NO: 13118 - protein, 9 aa, Artificial Sequence
  Probable ATP-dependent RNA helicase DDX47 (147-155)
RLIDHLENT

SEQ ID NO: 13119 - protein, 9 aa, Artificial Sequence
  Nuclear pore complex protein Nup160 (575-583)
RLIEESVTV

SEQ ID NO: 13120 - protein, 10 aa, Artificial Sequence
  Partitioning defective 3 homolog (510-519)
RLIEVNGVDL

SEQ ID NO: 13121 - protein, 9 aa, Artificial Sequence
  3-ketodihydrosphingosine reductase (236-244)
RLISETTSV

SEQ ID NO: 13122 - protein, 9 aa, Artificial Sequence
  Eukaryotic translation initiation factor 4 gamma 1 (840-848)
RLKEELEEA

SEQ ID NO: 13123 - protein, 11 aa, Artificial Sequence
  Upstream-binding protein 1 (145-155)
RLLDLDIPMSV

SEQ ID NO: 13124 - protein, 11 aa, Artificial Sequence
  Cytochrome c oxidase subunit 2 (134-144)
RLLDVDNRVVL

SEQ ID NO: 13125 - protein, 9 aa, Artificial Sequence
  Pyridoxal-dependent decarboxylase domain-containing protein 1 (603-611)
RLLENMTEV

SEQ ID NO: 13126 - protein, 11 aa, Artificial Sequence
  Xyloside xylosyltransferase 1 (295-305)
RLLEPAQVQQL

SEQ ID NO: 13127 - protein, 10 aa, Artificial Sequence
  Telomere length regulation protein TEL2 homolog (186-195)
RLLGEEVVRV

SEQ ID NO: 13128 - protein, 9 aa, Artificial Sequence
  Suppressor APC domain-containing protein 2 (290-298)
RLLPKVQEV

SEQ ID NO: 13129 - protein, 9 aa, Artificial Sequence
  Translocon-associated protein subunit beta (2-10)
RLLSFVVLA

SEQ ID NO: 13130 - protein, 9 aa, Artificial Sequence
  Vacuolar protein sorting-associated protein 33B (607-615)
RLMEAMSEV

SEQ ID NO: 13131 - protein, 11 aa, Artificial Sequence
  Probable inactiveosyltransferase 25 family member 3 (351-361)
RLMEDVEAEKL

SEQ ID NO: 13132 - protein, 11 aa, Artificial Sequence
  Vacuolar protein sorting-associated protein 13D (1845-1855)
RLPPEGILHNV

SEQ ID NO: 13133 - protein, 9 aa, Artificial Sequence
  Ribosome-binding protein 1 (569-577)
RLQEELEKL

SEQ ID NO: 13134 - protein, 11 aa, Artificial Sequence
  HMG domain-containing protein 4 (432-442)
RLQETEGMVAV

SEQ ID NO: 13135 - protein, 9 aa, Artificial Sequence
  Protein orai-3 (287-295)
RLQGELQAV

SEQ ID NO: 13136 - protein, 9 aa, Artificial Sequence
  C-1-tetrahydrofolate synthase, cytoplasmic (478-486)
RLVPSVNGV

SEQ ID NO: 13137 - protein, 11 aa, Artificial Sequence
  Guanine nucleotide-binding protein subunit beta-2-like 1 (88-98)
RLWDLTTGTTT

SEQ ID NO: 13138 - protein, 8 aa, Artificial Sequence
  Circadian clock protein PASD1 (691-698)
RLWQELSD

SEQ ID NO: 13139 - protein, 9 aa, Artificial Sequence
  Ubiquitin carboxyl-terminal hydrolase 11 (210-218)
RLYDTHITV

SEQ ID NO: 13140 - protein, 11 aa, Artificial Sequence
  TIP41-like protein (200-210)
RLYHEADKTYM

SEQ ID NO: 13141 - protein, 9 aa, Artificial Sequence
  N-acetyllactosaminide beta-1,3-N-acetylglucosaminyltransferase 2 (314-322)
RLYHITDQV

SEQ ID NO: 13142 - protein, 11 aa, Artificial Sequence
  Heterogeneous nuclear ribonucleoprotein M (511-521)
RMATGLERMGA

SEQ ID NO: 13143 - protein, 11 aa, Artificial Sequence
  Eukaryotic translation initiation factor 3 subunit A (752-762)
RMLEDRDLFVM

SEQ ID NO: 13144 - protein, 11 aa, Artificial Sequence
  N-alpha-acetyltransferase 38, NatC auxiliary subunit (104-114)
RMTDGRTLVGC

SEQ ID NO: 13145 - protein, 11 aa, Artificial Sequence
  Nucleophosmin (277-287)
RMTDQEAIQDL

SEQ ID NO: 13146 - protein, 10 aa, Artificial Sequence
  Copine-3 (121-130)
RPAGKGSITI

SEQ ID NO: 13147 - protein, 9 aa, Artificial Sequence
  Myeloid-derived growth factor (146-154)
RPGAFKAEL

SEQ ID NO: 13148 - protein, 9 aa, Artificial Sequence
  BTB/POZ domain-containing adapter for CUL3-mediated RhoA degradation protein 1 (319-327)
RPHGQQIVF

SEQ ID NO: 13149 - protein, 9 aa, Artificial Sequence
  Histone-lysine N-methyltransferase 2C (1906-1914)
RPPPVGHSF

SEQ ID NO: 13150 - protein, 9 aa, Artificial Sequence
  Calcium-independent phospholipase A2-gamma (321-329)
RPTEGVQAL

SEQ ID NO: 13151 - protein, 9 aa, Artificial Sequence
  Sperm-specific antigen 2 (241-249)
RQIEVLTTV

SEQ ID NO: 13152 - protein, 10 aa, Artificial Sequence
  Dolichyl-diphosphooligosaccharide-proteinosyltransferase subunit 1 (268-277)
RQPDSGISSI

SEQ ID NO: 13153 - protein, 9 aa, Artificial Sequence
  DNA ligase 1 (294-302)
RTFEKIEEV

SEQ ID NO: 13154 - protein, 9 aa, Artificial Sequence
  Trifunctional enzyme subunit alpha, mitochondrial (235-243)
RTIEYLEEV

SEQ ID NO: 13155 - protein, 9 aa, Artificial Sequence
  Sorting nexin-4 (243-251)
RVADRLYGV

SEQ ID NO: 13156 - protein, 10 aa, Artificial Sequence
  THO complex subunit 2 (904-913)
RVFSDIIYTV

SEQ ID NO: 13157 - protein, 9 aa, Artificial Sequence
  Glycerol-3-phosphate acyltransferase 1, mitochondrial (138-146)
RVQEAIAEV

SEQ ID NO: 13158 - protein, 9 aa, Artificial Sequence
  Putative eukaryotic translation initiation factor 2 subunit 3-like protein (416-424)
RVSAVKADL

SEQ ID NO: 13159 - protein, 9 aa, Artificial Sequence
  Regulation of nuclear pre-mRNA domain-containing protein 1A (271-279)
RVSLVRKEL

SEQ ID NO: 13160 - protein, 10 aa, Artificial Sequence
  Nuclear receptor corepressor 2 (2392-2401)
RVWEDRPSSA

SEQ ID NO: 13161 - protein, 9 aa, Artificial Sequence
  Replication initiator 1 (328-336)
SAAEPTPAV

SEQ ID NO: 13162 - protein, 9 aa, Artificial Sequence
  DAZ-associated protein 2 (62-70)
SAAFPGASL

SEQ ID NO: 13163 - protein, 9 aa, Artificial Sequence
  Serine-threonine kinase receptor-associated protein (160-168)
SADDKTVRL

SEQ ID NO: 13164 - protein, 9 aa, Artificial Sequence
  Poly (ADP-ribose) polymerase 1 (385-393)
SADKPLSNM

SEQ ID NO: 13165 - protein, 9 aa, Artificial Sequence
  Uncharacterized protein C15orf39 (994-1002)
SASPPGPTL

SEQ ID NO: 13166 - protein, 11 aa, Artificial Sequence
  Replication protein A 32 kDa subunit (93-103)
SEAGNFGGNSF

SEQ ID NO: 13167 - protein, 9 aa, Artificial Sequence
  Kelch repeat and BTB domain-containing protein 6 (137-145)
SEANVERLY

SEQ ID NO: 13168 - protein, 9 aa, Artificial Sequence
  Protein PRRC2C (867-875)
SEAQVQKFL

SEQ ID NO: 13169 - protein, 10 aa, Artificial Sequence
  Non-POU domain-containing octamer-binding protein (120-129)
SEGSFLLTTF

SEQ ID NO: 13170 - protein, 10 aa, Artificial Sequence
  Cyclin-dependent kinase 11B (629-638)
SEIDQINKVF

SEQ ID NO: 13171 - protein, 9 aa, Artificial Sequence
  Uncharacterized protein C5orf34 (564-572)
SELEKIQKF

SEQ ID NO: 13172 - protein, 10 aa, Artificial Sequence
  V-type proton ATPase subunit H (357-366)
SELKSGRLEW

SEQ ID NO: 13173 - protein, 9 aa, Artificial Sequence
  Myomegalin (838-846)
SELQALRQY

SEQ ID NO: 13174 - protein, 10 aa, Artificial Sequence
  Small subunit processome component 20 homolog (777-786)
SEQDPLLKNL

SEQ ID NO: 13175 - protein, 10 aa, Artificial Sequence
  ATP-citrate synthase (7-16)
SEQTGKELLY

SEQ ID NO: 13176 - protein, 9 aa, Artificial Sequence
  PERQ amino acid-rich with GYF domain-containing protein 2 (199-207)
SESENWRIF

SEQ ID NO: 13177 - protein, 9 aa, Artificial Sequence
  FACT complex subunit SSRP1 (657-665)
SESFKSKEF

SEQ ID NO: 13178 - protein, 9 aa, Artificial Sequence
  FAD synthase (193-201)
SIAPILAEA

SEQ ID NO: 13179 - protein, 11 aa, Artificial Sequence
  Coatomer subunit beta (249-259)
SIFGEDALANV

SEQ ID NO: 13180 - protein, 9 aa, Artificial Sequence
  Inhibitor of Bruton tyrosine kinase (562-570)
SIHDVTFQV

SEQ ID NO: 13181 - protein, 9 aa, Artificial Sequence
  Cell growth-regulating nucleolar protein (128-136)
SILDQVWNI

SEQ ID NO: 13182 - protein, 9 aa, Artificial Sequence
  Poly (ADP-ribose) polymerase 1 (711-719)
SILSEVQQA

SEQ ID NO: 13183 - protein, 8 aa, Artificial Sequence
  EF-hand domain-containing protein 1 (48-55)
SKAPVLTY

SEQ ID NO: 13184 - protein, 9 aa, Artificial Sequence
  CCR4-NOT transcription complex subunit 1 (254-262)
SLADFMQEV

SEQ ID NO: 13185 - protein, 9 aa, Artificial Sequence
  DNA replication licensing factor MCM7 (208-216)
SLADYITAA

SEQ ID NO: 13186 - protein, 9 aa, Artificial Sequence
  Ubiquitin carboxyl-terminal hydrolase 7 (543-551)
SLAEFVQSL

SEQ ID NO: 13187 - protein, 10 aa, Artificial Sequence
  X-ray repair cross-complementing protein 5 (580-589)
SLAEGSVTSV

SEQ ID NO: 13188 - protein, 9 aa, Artificial Sequence
  Exosome complex exonuclease RRP44 (720-728)
SLAESLDQA

SEQ ID NO: 13189 - protein, 10 aa, Artificial Sequence
  Phosphatidylinositol 3,4,5-trisphosphate-dependent Rac exchanger 1 protein (655-664)
SLAEVAGLQV

SEQ ID NO: 13190 - protein, 9 aa, Artificial Sequence
  Centrosome-associated protein CEP250 (112-120)
SLAEVNTQL

SEQ ID NO: 13191 - protein, 9 aa, Artificial Sequence
  Apolipoprotein L1 (249-257)
SLAGNTYQL

SEQ ID NO: 13192 - protein, 9 aa, Artificial Sequence
  SH3 domain and tetratricopeptide repeat-containing protein 1 (740-748)
SLAGSLRSV

SEQ ID NO: 13193 - protein, 11 aa, Artificial Sequence
  Kelch-like protein 21 (506-516)
SLAVLGGKLYV

SEQ ID NO: 13194 - protein, 10 aa, Artificial Sequence
  Insulin-degrading enzyme (224-233)
SLDDLTNLVV

SEQ ID NO: 13195 - protein, 9 aa, Artificial Sequence
  Bone morphogenetic protein receptor type-2 (221-229)
SLDERPVAV

SEQ ID NO: 13196 - protein, 10 aa, Artificial Sequence
  Glycogen debranching enzyme (835-844)
SLDPHAQVAV

SEQ ID NO: 13197 - protein, 9 aa, Artificial Sequence
  Cullin-9 (676-684)
SLDQHVAAV

SEQ ID NO: 13198 - protein, 9 aa, Artificial Sequence
  Protein RMD5 homolog B (28-36)
SLEELLHYV

SEQ ID NO: 13199 - protein, 9 aa, Artificial Sequence
  NAD(P)H dehydrogenase (quinone) 1 (155-163)
SLFDLNFQA

SEQ ID NO: 13200 - protein, 9 aa, Artificial Sequence
  Signal recognition particle 54 kDa protein (200-208)
SLFEEMLQV

SEQ ID NO: 13201 - protein, 10 aa, Artificial Sequence
  Zinc finger protein 451 (454-463)
SLFGQDVKAV

SEQ ID NO: 13202 - protein, 9 aa, Artificial Sequence
  Importin-8 (243-251)
SLFKDQMEL

SEQ ID NO: 13203 - protein, 9 aa, Artificial Sequence
  Optineurin (302-310)
SLFKELQEA

SEQ ID NO: 13204 - protein, 8 aa, Artificial Sequence
  Kelch domain-containing protein 10 (353-360)
SLFKIWLV

SEQ ID NO: 13205 - protein, 9 aa, Artificial Sequence
  Telomere-associated protein RIF1 (802-810)
SLFKLIVKV

SEQ ID NO: 13206 - protein, 9 aa, Artificial Sequence
  DNA polymerase alpha subunit B (295-303)
SLFPGQVVI

SEQ ID NO: 13207 - protein, 11 aa, Artificial Sequence
  Lamin-B receptor (312-322)
SLFQGVEFHYV

SEQ ID NO: 13208 - protein, 11 aa, Artificial Sequence
  Renin receptor (103-113)
SLFSEETPVVL

SEQ ID NO: 13209 - protein, 10 aa, Artificial Sequence
  Ubiquitin-protein ligase E3C (505-514)
SLFSHSLISI

SEQ ID NO: 13210 - protein, 9 aa, Artificial Sequence
  Cytoplasmic dynein 1 heavy chain 1 (2457-2465)
SLFSMLHQA

SEQ ID NO: 13211 - protein, 9 aa, Artificial Sequence
  Kelch-like protein 12 (364-372)
SLHDRIYVI

SEQ ID NO: 13212 - protein, 9 aa, Artificial Sequence
  Cytochrome P450 20A1 (53-61)
SLHEFLVNL

SEQ ID NO: 13213 - protein, 9 aa, Artificial Sequence
  Ectopic P granules protein 5 homolog (837-845)
SLHSVIIQL

SEQ ID NO: 13214 - protein, 9 aa, Artificial Sequence
  DNA-directed RNA polymerase I subunit RPA1 (382-390)
SLIDKLYNI

SEQ ID NO: 13215 - protein, 11 aa, Artificial Sequence
  Structural maintenance of chromosomes protein 6 (601-611)
SLIDMRGIETV

SEQ ID NO: 13216 - protein, 9 aa, Artificial Sequence
  Transmembrane protein 209 (11-19)
SLIDRTIKM

SEQ ID NO: 13217 - protein, 9 aa, Artificial Sequence
  Cation channel sperm-associated protein 2 (33-41)
SLIEHLQGL

SEQ ID NO: 13218 - protein, 9 aa, Artificial Sequence
  Mediator of RNA polymerase II transcription subunit 19 (129-137)
SLIEKPPIL

SEQ ID NO: 13219 - protein, 9 aa, Artificial Sequence
  Nucleolar pre-ribosomal-associated protein 1 (1761-1769)
SLIERDLKL

SEQ ID NO: 13220 - protein, 9 aa, Artificial Sequence
  Solute carrier family 35 member C2 (14-22)
SLIFKLEEL

SEQ ID NO: 13221 - protein, 9 aa, Artificial Sequence
  Solute carrier family 35 member E1 (24-32)
SLIPIISGV

SEQ ID NO: 13222 - protein, 9 aa, Artificial Sequence
  Putative Polycomb group protein ASXL2 (835-843)
SLIRIVPVV

SEQ ID NO: 13223 - protein, 9 aa, Artificial Sequence
  Carboxypeptidase D (372-380)
SLITLIEKV

SEQ ID NO: 13224 - protein, 9 aa, Artificial Sequence
  Peroxisomal biogenesis factor 3 (201-209)
SLLDLEQKL

SEQ ID NO: 13225 - protein, 9 aa, Artificial Sequence
  Zinc finger BED domain-containing protein 1 (280-288)
SLLDVAVHM

SEQ ID NO: 13226 - protein, 9 aa, Artificial Sequence
  Kinesin-like protein KIF3A (470-478)
SLLEKLSAL

SEQ ID NO: 13227 - protein, 9 aa, Artificial Sequence
  Kinesin-like protein (557-565)
SLLKDLAEI

SEQ ID NO: 13228 - protein, 9 aa, Artificial Sequence
  Phosphatidylinositol 4-phosphate 5-kinase type-1 alpha (312-320)
SLLMSIHNI

SEQ ID NO: 13229 - protein, 9 aa, Artificial Sequence
  Claspin (1254-1262)
SLLNQPKAV

SEQ ID NO: 13230 - protein, 11 aa, Artificial Sequence
  Sister chromatid cohesion protein PDS5 homolog A (36-46)
SLLPEYVVPYM

SEQ ID NO: 13231 - protein, 11 aa, Artificial Sequence
  Inositol 1,4,5-trisphosphate receptor type 1 (1393-1403)
SLLPLDDIVRV

SEQ ID NO: 13232 - protein, 9 aa, Artificial Sequence
  Lysosomal-trafficking regulator (78-86)
SLLPLVWKI

SEQ ID NO: 13233 - protein, 11 aa, Artificial Sequence
  Signal transducer and activator of transcription 2 (25-35)
SLLPVDIRQYL

SEQ ID NO: 13234 - protein, 9 aa, Artificial Sequence
  Cytoplasmic dynein 1 heavy chain 1 (3748-3756)
SLLQALNEV

SEQ ID NO: 13235 - protein, 9 aa, Artificial Sequence
  Melanoma antigen preferentially expressed in tumors (425-433)
SLLQHLIGL

SEQ ID NO: 13236 - protein, 10 aa, Artificial Sequence
  SH3KBP1-binding protein 1 (47-56)
SLLSGRISTL

SEQ ID NO: 13237 - protein, 9 aa, Artificial Sequence
  Uncharacterized aarF domain-containing protein kinase 2 (132-140)
SLLSSVFKL

SEQ ID NO: 13238 - protein, 9 aa, Artificial Sequence
  Transportin-3 (89-97)
SLLTHIQNL

SEQ ID NO: 13239 - protein, 9 aa, Artificial Sequence
  E3 ubiquitin-protein ligase TRIP12 (971-979)
SLLTSPPKA

SEQ ID NO: 13240 - protein, 10 aa, Artificial Sequence
  Mediator of RNA polymerase II transcription subunit 24 (800-809)
SLMDPPGTAL

SEQ ID NO: 13241 - protein, 9 aa, Artificial Sequence
  CAP-Gly domain-containing linker protein 2 (873-881)
SLNELRVLL

SEQ ID NO: 13242 - protein, 9 aa, Artificial Sequence
  Solute carrier family 35 member E4 (65-73)
SLNKWIFTV

SEQ ID NO: 13243 - protein, 9 aa, Artificial Sequence
  Sestrin-3 (47-55)
SLPELVHAV

SEQ ID NO: 13244 - protein, 9 aa, Artificial Sequence
  Transmembrane protein 214 (435-443)
SLQETIQSL

SEQ ID NO: 13245 - protein, 9 aa, Artificial Sequence
  Centrosome-associated protein CEP250 (2189-2197)
SLQEVAMFL

SEQ ID NO: 13246 - protein, 9 aa, Artificial Sequence
  Heat shock protein HSP 90-beta (394-402)
SLSEYVSRM

SEQ ID NO: 13247 - protein, 9 aa, Artificial Sequence
  Cell division cycle and apoptosis regulator protein 1 (1078-1086)
SLSGELREV

SEQ ID NO: 13248 - protein, 9 aa, Artificial Sequence
  RNA-binding protein 12B (105-113)
SLSNFIESV

SEQ ID NO: 13249 - protein, 9 aa, Artificial Sequence
  Bromodomain adjacent to zinc finger domain protein 1A (1093-1101)
SLSQVFLHL

SEQ ID NO: 13250 - protein, 9 aa, Artificial Sequence
  Dehydrogenase/reductase SDR family member 1 (277-285)
SLSSVLSHV

SEQ ID NO: 13251 - protein, 9 aa, Artificial Sequence
  Spectrin beta chain, erythrocytic (333-341)
SLTGVQQQL

SEQ ID NO: 13252 - protein, 10 aa, Artificial Sequence
  Conserved oligomeric Golgi complex subunit 4 (458-467)
SLVAVELEKV

SEQ ID NO: 13253 - protein, 10 aa, Artificial Sequence
  Phospholipase A1 member A (341-350)
SLVEFHLKEL

SEQ ID NO: 13254 - protein, 9 aa, Artificial Sequence
  26S proteasome non-ATPase regulatory subunit 13 (75-83)
SLVEIILHV

SEQ ID NO: 13255 - protein, 9 aa, Artificial Sequence
  Cyclin-dependent-like kinase 5 (247-255)
SLVNVVPKL

SEQ ID NO: 13256 - protein, 9 aa, Artificial Sequence
  Heat shock factor protein 2 (156-164)
SLWKEVSEL

SEQ ID NO: 13257 - protein, 9 aa, Artificial Sequence
  GRIP and coiled-coil domain-containing protein 2 (689-697)
SLYEENNKL

SEQ ID NO: 13258 - protein, 9 aa, Artificial Sequence
  Centrosome-associated protein CEP250 (1184-1192)
SLYSALQQA

SEQ ID NO: 13259 - protein, 9 aa, Artificial Sequence
  Serine/threonine-protein kinase TBK1 (413-421)
SMAKAITGV

SEQ ID NO: 13260 - protein, 11 aa, Artificial Sequence
  Erlin-2 (158-168)
SMAPGLVIQAV

SEQ ID NO: 13261 - protein, 9 aa, Artificial Sequence
  SEC14-like protein 1 (203-211)
SMAVVIPEA

SEQ ID NO: 13262 - protein, 9 aa, Artificial Sequence
  Cullin-1 (79-87)
SMISKLKQA

SEQ ID NO: 13263 - protein, 9 aa, Artificial Sequence
  Ubiquitin conjugation factor E4 B (1278-1286)
SMLEPVPEL

SEQ ID NO: 13264 - protein, 9 aa, Artificial Sequence
  Antizyme inhibitor 1 (152-160)
SMMKNFFFV

SEQ ID NO: 13265 - protein, 9 aa, Artificial Sequence
  Large proline-rich protein BAG6 (763-771)
SMVDVVMLL

SEQ ID NO: 13266 - protein, 10 aa, Artificial Sequence
  Band 4.1-like protein 3 (185-194)
SMYGVDLHHA

SEQ ID NO: 13267 - protein, 10 aa, Artificial Sequence
  Protein 4.1 (185-194)
SMYGVDLHKA

SEQ ID NO: 13268 - protein, 9 aa, Artificial Sequence
  A-kinase anchor protein 10, mitochondrial (278-286)
SPASPLKEL

SEQ ID NO: 13269 - protein, 10 aa, Artificial Sequence
  Beta-1-syntrophin (175-184)
SPDAKHTVIL

SEQ ID NO: 13270 - protein, 10 aa, Artificial Sequence
  Cytoplasmic dynein 1 heavy chain 1 (577-586)
SPDKIPWSAL

SEQ ID NO: 13271 - protein, 9 aa, Artificial Sequence
  Ubiquitin carboxyl-terminal hydrolase 22 (237-245)
SPHIPYKLL

SEQ ID NO: 13272 - protein, 10 aa, Artificial Sequence
  ADNP homeobox protein 2 (336-345)
SPLPVGQNSL

SEQ ID NO: 13273 - protein, 11 aa, Artificial Sequence
  COUP transcription factor 2 (278-288)
SPMSADRVVAF

SEQ ID NO: 13274 - protein, 9 aa, Artificial Sequence
  Ubiquitin carboxyl-terminal hydrolase 6 (1192-1200)
SPNSSPRTL

SEQ ID NO: 13275 - protein, 9 aa, Artificial Sequence
  Ubiquitin-associated protein 2-like (477-485)
SPQPAQQKL

SEQ ID NO: 13276 - protein, 10 aa, Artificial Sequence
  Acyl-CoA desaturase (281-290)
SPRENILVSL

SEQ ID NO: 13277 - protein, 9 aa, Artificial Sequence
  U3 small nucleolar RNA-associated protein 18 homolog (367-375)
SPRSGYFAL

SEQ ID NO: 13278 - protein, 10 aa, Artificial Sequence
  Integrator complex subunit 7 (289-298)
SPRSSDLVKL

SEQ ID NO: 13279 - protein, 9 aa, Artificial Sequence
  Protein Wiz (5-13)
SPSLPKKSL

SEQ ID NO: 13280 - protein, 9 aa, Artificial Sequence
  Mediator of DNA damage checkpoint protein 1 (1786-1794)
SQIQKVEPA

SEQ ID NO: 13281 - protein, 10 aa, Artificial Sequence
  DNA-directed RNA polymerases I, II, and III subunit RPABC3 (47-56)
SRADQFEYVM

SEQ ID NO: 13282 - protein, 9 aa, Artificial Sequence
  Mitochondrial fission factor (5-13)
SRIQYEMEY

SEQ ID NO: 13283 - protein, 9 aa, Artificial Sequence
  Histone H2B type 2-F (33-41)
SRKESYSVY

SEQ ID NO: 13284 - protein, 11 aa, Artificial Sequence
  Solute carrier family 35 member E1 (251-261)
SRQSYPNSYSL

SEQ ID NO: 13285 - protein, 9 aa, Artificial Sequence
  Mucin-1 (950-958)
STAPPVHNV

SEQ ID NO: 13286 - protein, 11 aa, Artificial Sequence
  T-complex protein 1 subunit beta (333-343)
STFDHPELVKL

SEQ ID NO: 13287 - protein, 9 aa, Artificial Sequence
  Exosome complex component RRP4 (55-63)
SVAGSVERV

SEQ ID NO: 13288 - protein, 9 aa, Artificial Sequence
  Rho guanine nucleotide exchange factor 18 (538-546)
SVDSKPPVI

SEQ ID NO: 13289 - protein, 9 aa, Artificial Sequence
  PDZ domain-containing protein GIPC1 (87-95)
SVIDHIHLI

SEQ ID NO: 13290 - protein, 11 aa, Artificial Sequence
  Programmed cell death 6-interacting protein (423-433)
SVIEQGGIQTV

SEQ ID NO: 13291 - protein, 9 aa, Artificial Sequence
  Nucleolar pre-ribosomal-associated protein 1 (1313-1321)
SVLDQKILL

SEQ ID NO: 13292 - protein, 9 aa, Artificial Sequence
  Serine incorporator 1 (244-252)
SVMSILPKI

SEQ ID NO: 13293 - protein, 9 aa, Artificial Sequence
  Heterogeneous nuclear ribonucleoprotein K (372-380)
SYAGGRGSY

SEQ ID NO: 13294 - protein, 9 aa, Artificial Sequence
  Nectin-2 (494-502)
SYQGKGFVM

SEQ ID NO: 13295 - protein, 9 aa, Artificial Sequence
  Transcription intermediary factor 1-beta (33-41)
TADSQPPVF

SEQ ID NO: 13296 - protein, 9 aa, Artificial Sequence
  Phosphatidylinositol 4-kinase alpha (299-307)
TEIERLITW

SEQ ID NO: 13297 - protein, 10 aa, Artificial Sequence
  Phosphatidylinositol 4-kinase alpha (299-308)
TEIERLITWY

SEQ ID NO: 13298 - protein, 11 aa, Artificial Sequence
  Putative oxidoreductase GLYR1 (385-395)
TIAEGLTLAQV

SEQ ID NO: 13299 - protein, 9 aa, Artificial Sequence
  Phosphopantothenate-cysteine ligase (151-159)
TLADYLHLL

SEQ ID NO: 13300 - protein, 10 aa, Artificial Sequence
  Paraspeckle component 1 (128-137)
TLAEIAKAEL

SEQ ID NO: 13301 - protein, 9 aa, Artificial Sequence
  Tumor necrosis factor receptor superfamily member 6 (305-313)
TLAEKIQTI

SEQ ID NO: 13302 - protein, 9 aa, Artificial Sequence
  Vacuolar protein sorting-associated protein 29 (57-65)
TLAGDVHIV

SEQ ID NO: 13303 - protein, 9 aa, Artificial Sequence
  Nuclear transcription factor Y subunit gamma (147-155)
TLAQQPTAV

SEQ ID NO: 13304 - protein, 10 aa, Artificial Sequence
  Pre-mRNA-splicing factor ATP-dependent RNA helicase DHX15 (266-275)
TLATDILMGV

SEQ ID NO: 13305 - protein, 9 aa, Artificial Sequence
  Heat shock cognate 71 kDa protein (313-321)
TLDPVEKAL

SEQ ID NO: 13306 - protein, 9 aa, Artificial Sequence
  EMILIN-2 (411-419)
TLDQKIERV

SEQ ID NO: 13307 - protein, 9 aa, Artificial Sequence
  Ubiquitin carboxyl-terminal hydrolase 33 (252-260)
TLFQGIKTV

SEQ ID NO: 13308 - protein, 9 aa, Artificial Sequence
  Cyclic AMP-responsive element-binding protein 1 (213-221)
TLIEELKAL

SEQ ID NO: 13309 - protein, 10 aa, Artificial Sequence
  Mediator of RNA polymerase II transcription subunit 14 (53-62)
TLIEFLLHRA

SEQ ID NO: 13310 - protein, 9 aa, Artificial Sequence
  Histone-lysine N-methyltransferase 2B (517-525)
TLIEKVQEA

SEQ ID NO: 13311 - protein, 10 aa, Artificial Sequence
  Protein arginine N-methyltransferase 3 (288-297)
TLIKGKIEEV

SEQ ID NO: 13312 - protein, 9 aa, Artificial Sequence
  UDP-N-acetylglucosamine-dolichyl-phosphate N-acetylglucosaminephosphotransferase (255-263)
TLINLLLKV

SEQ ID NO: 13313 - protein, 11 aa, Artificial Sequence
  Peroxisomal acyl-coenzyme A oxidase 1 (597-607)
TLIRSDAVALV

SEQ ID NO: 13314 - protein, 9 aa, Artificial Sequence
  Ubiquitin-like modifier-activating enzyme 6 (967-975)
TLLDFINAV

SEQ ID NO: 13315 - protein, 9 aa, Artificial Sequence
  Coronin (508-516)
TLLEEIKAL

SEQ ID NO: 13316 - protein, 9 aa, Artificial Sequence
  Signal-induced proliferation-associated protein 1 (365-373)
TLLGDVVRL

SEQ ID NO: 13317 - protein, 9 aa, Artificial Sequence
  2-hydroxyacyl-CoA lyase 1 (238-246)
TLLGNIHAV

SEQ ID NO: 13318 - protein, 10 aa, Artificial Sequence
  Pecanex-like protein 1 (955-964)
TLLIGSPLSL

SEQ ID NO: 13319 - protein, 9 aa, Artificial Sequence
  Kelch-like protein 22 (490-498)
TLLNKLYVI

SEQ ID NO: 13320 - protein, 9 aa, Artificial Sequence
  AP-2 complex subunit beta (483-491)
TLLTAIVKL

SEQ ID NO: 13321 - protein, 9 aa, Artificial Sequence
  Vacuolar protein sorting-associated protein 11 homolog (911-919)
TLLTDPPTA

SEQ ID NO: 13322 - protein, 9 aa, Artificial Sequence
  Fanconi anemia group I protein (1140-1148)
TLLTFFHEL

SEQ ID NO: 13323 - protein, 9 aa, Artificial Sequence
  1-phosphatidylinositol 4,5-bisphosphate phosphodiesterase gamma-1 (436-444)
TLLTKPVEI

SEQ ID NO: 13324 - protein, 10 aa, Artificial Sequence
  Pre-mRNA-processing factor 6 (249-258)
TLMDMRLSQV

SEQ ID NO: 13325 - protein, 10 aa, Artificial Sequence
  Transgelin-2 (128-137)
TLMNLGGLAV

SEQ ID NO: 13326 - protein, 9 aa, Artificial Sequence
  Cleft lip and palate transmembrane protein 1 (101-109)
TLMNLHVYI

SEQ ID NO: 13327 - protein, 9 aa, Artificial Sequence
  Nuclear receptor-binding protein (524-532)
TLNSAAVTV

SEQ ID NO: 13328 - protein, 9 aa, Artificial Sequence
  Acylglycerol kinase, mitochondrial (127-135)
TLQEVVTGV

SEQ ID NO: 13329 - protein, 9 aa, Artificial Sequence
  Baculoviral IAP repeat-containing protein 6 (1801-1809)
TLSDVLDRV

SEQ ID NO: 13330 - protein, 9 aa, Artificial Sequence
  Lysine-specific demethylase 5C (849-857)
TLTELRAFL

SEQ ID NO: 13331 - protein, 9 aa, Artificial Sequence
  Cytochrome b-c1 complex subunit 9 (5-13)
TLTSKLYSL

SEQ ID NO: 13332 - protein, 9 aa, Artificial Sequence
  Putative helicase MOV-10 (131-139)
TLVEAIKQV

SEQ ID NO: 13333 - protein, 9 aa, Artificial Sequence
  Transmembrane protein 9B (3-11)
TLWGGLLRL

SEQ ID NO: 13334 - protein, 9 aa, Artificial Sequence
  Trafficking protein particle complex subunit 9 (207-215)
TLYDSRLFV

SEQ ID NO: 13335 - protein, 10 aa, Artificial Sequence
  Transmembrane protein 214 (42-51)
TLYERGFENI

SEQ ID NO: 13336 - protein, 9 aa, Artificial Sequence
  Exportin-6 (594-602)
TLYGSQIKL

SEQ ID NO: 13337 - protein, 11 aa, Artificial Sequence
  Insulin-like growth factor 2 mRNA-binding protein 1 (319-329)
TLYNPERTITV

SEQ ID NO: 13338 - protein, 10 aa, Artificial Sequence
  AP-1 complex subunit beta-1 (827-836)
TLYPLHILFV

SEQ ID NO: 13339 - protein, 9 aa, Artificial Sequence
  Syntaxin-binding protein 3 (176-184)
TMADQIVTV

SEQ ID NO: 13340 - protein, 9 aa, Artificial Sequence
  Actin-like protein 6A (279-287)
TMLGVSHVV

SEQ ID NO: 13341 - protein, 9 aa, Artificial Sequence
  Tartrate-resistant acid phosphatase type 5 (23-31)
TPALRFVAV

SEQ ID NO: 13342 - protein, 10 aa, Artificial Sequence
  Eukaryotic translation initiation factor 2A (542-551)
TPRNTVSQSI

SEQ ID NO: 13343 - protein, 9 aa, Artificial Sequence
  Intron-binding protein aquarius (396-404)
TTFDKEFLL

SEQ ID NO: 13344 - protein, 11 aa, Artificial Sequence
  Elongation factor 2 (486-496)
TTFEHAHNMRV

SEQ ID NO: 13345 - protein, 9 aa, Artificial Sequence
  Nuclear factor of activated T-cells, cytoplasmic 1 (325-333)
TTLEQPPSV

SEQ ID NO: 13346 - protein, 9 aa, Artificial Sequence
  Chromatin complexes subunit BAP18 (72-80)
TVAQIKATV

SEQ ID NO: 13347 - protein, 9 aa, Artificial Sequence
  Kelch-like protein 18 (361-369)
TVFEGRIYV

SEQ ID NO: 13348 - protein, 9 aa, Artificial Sequence
  Ubiquitin carboxyl-terminal hydrolase 10 (731-739)
TYRLFAVVY

SEQ ID NO: 13349 - protein, 9 aa, Artificial Sequence
  Dolichyl-diphosphooligosaccharide-proteinosyltransferase 48 kDa subunit (203-211)
VADPDNPLV

SEQ ID NO: 13350 - protein, 10 aa, Artificial Sequence
  Chromodomain-helicase-DNA-binding protein 4 (243-252)
VAPPPPPVEV

SEQ ID NO: 13351 - protein, 10 aa, Artificial Sequence
  Glycogen phosphorylase, liver form (207-216)
VEHTNTGTKW

SEQ ID NO: 13352 - protein, 11 aa, Artificial Sequence
  Prelamin-A/C (78-88)
VEIDNGKQREF

SEQ ID NO: 13353 - protein, 9 aa, Artificial Sequence
  GPI transamidase component PIG-T (292-300)
VHPPPTTTY

SEQ ID NO: 13354 - protein, 9 aa, Artificial Sequence
  Probable ATP-dependent RNA helicase DDX60-like (866-874)
VIFDEVHYL

SEQ ID NO: 13355 - protein, 9 aa, Artificial Sequence
  Platelet-activating factor acetylhydrolase IB subunit alpha (114-122)
VIFHPVFSV

SEQ ID NO: 13356 - protein, 9 aa, Artificial Sequence
  ORM1-like protein 2 (54-62)
VIHNLATYV

SEQ ID NO: 13357 - protein, 9 aa, Artificial Sequence
  Mediator of RNA polymerase II transcription subunit 23 (140-148)
VILEKILTI

SEQ ID NO: 13358 - protein, 9 aa, Artificial Sequence
  Protein Mis18-beta (88-96)
VLADSVHLA

SEQ ID NO: 13359 - protein, 11 aa, Artificial Sequence
  Guanine nucleotide-binding protein G(i) subunit alpha-1 (233-243)
VLAEDEEMNRM

SEQ ID NO: 13360 - protein, 9 aa, Artificial Sequence
  Bromodomain adjacent to zinc finger domain protein 2A (972-980)
VLAFLVHEL

SEQ ID NO: 13361 - protein, 11 aa, Artificial Sequence
  Disheveled-associated activator of morphogenesis 2 (194-204)
VLAQPEAISTI

SEQ ID NO: 13362 - protein, 9 aa, Artificial Sequence
  DNA repair protein RAD50 (1068-1076)
VLASLIIRL

SEQ ID NO: 13363 - protein, 10 aa, Artificial Sequence
  Cytoplasmic dynein 1 heavy chain 1 (2318-2327)
VLDDNKLLTL

SEQ ID NO: 13364 - protein, 10 aa, Artificial Sequence
  Cytoplasmic FMR1-interacting protein 2 (170-179)
VLDELKNMKC

SEQ ID NO: 13365 - protein, 9 aa, Artificial Sequence
  Serrate RNA effector molecule homolog (161-169)
VLDKLLLYL

SEQ ID NO: 13366 - protein, 9 aa, Artificial Sequence
  Protein transport protein Sec61 subunit alpha isoform 1 (354-362)
VLEDPVHAV

SEQ ID NO: 13367 - protein, 10 aa, Artificial Sequence
  HLA class I histocompatibility antigen, A-2 alpha chain (291-300)
VLFGAVITGA

SEQ ID NO: 13368 - protein, 10 aa, Artificial Sequence
  Fatty acid synthase (743-752)
VLFQEALWHV

SEQ ID NO: 13369 - protein, 9 aa, Artificial Sequence
  Protein VAC14 homolog (32-40)
VLGEFLKEI

SEQ ID NO: 13370 - protein, 9 aa, Artificial Sequence
  Mediator of RNA polymerase II transcription subunit 23 (1163-1171)
VLHDRIVSV

SEQ ID NO: 13371 - protein, 11 aa, Artificial Sequence
  GPN-loop GTPase 1 (103-113)
VLIDTPGQIEV

SEQ ID NO: 13372 - protein, 9 aa, Artificial Sequence
  Adenosylhomocysteinase (62-70)
VLIETLVTL

SEQ ID NO: 13373 - protein, 11 aa, Artificial Sequence
  Splicing factor 3B subunit 3 (959-969)
VLIGVGKLLRV

SEQ ID NO: 13374 - protein, 10 aa, Artificial Sequence
  Membrane-bound transcription factor site-2 protease (164-173)
VLISGVVHEI

SEQ ID NO: 13375 - protein, 9 aa, Artificial Sequence
  Cytoplasmic FMR1-interacting protein 2 (505-513)
VLISVLQAI

SEQ ID NO: 13376 - protein, 9 aa, Artificial Sequence
  Putative helicase MOV-10 (216-224)
VLITTLITA

SEQ ID NO: 13377 - protein, 11 aa, Artificial Sequence
  Ubiquitin-like protein 4A (77-87)
VLLEEGEAQRL

SEQ ID NO: 13378 - protein, 11 aa, Artificial Sequence
  Cleavage stimulation factor subunit 1 (368-378)
VLLPDERTISL

SEQ ID NO: 13379 - protein, 9 aa, Artificial Sequence
  Glycerol-3-phosphate acyltransferase 3 (155-163)
VLLPLRVTL

SEQ ID NO: 13380 - protein, 9 aa, Artificial Sequence
  Eukaryotic translation initiation factor 4 gamma 3 (1360-1368)
VLLSEILHL

SEQ ID NO: 13381 - protein, 9 aa, Artificial Sequence
  Vesicle-trafficking protein SEC22b (2-10)
VLLTMIARV

SEQ ID NO: 13382 - protein, 9 aa, Artificial Sequence
  Probable ATP-dependent RNA helicase DDX41 (543-551)
VLMDLKALL

SEQ ID NO: 13383 - protein, 10 aa, Artificial Sequence
  Probable ATP-dependent RNA helicase DDX41 (543-552)
VLMDLKALLL

SEQ ID NO: 13384 - protein, 10 aa, Artificial Sequence
  Sterol regulatory element-binding protein 1 (412-421)
VLMEGVKTEV

SEQ ID NO: 13385 - protein, 9 aa, Artificial Sequence
  Cytoskeleton-associated protein 5 (1259-1267)
VLMKALEYL

SEQ ID NO: 13386 - protein, 9 aa, Artificial Sequence
  Eukaryotic translation initiation factor 4 gamma 1 (187-195)
VLMNQPPQI

SEQ ID NO: 13387 - protein, 10 aa, Artificial Sequence
  Ubiquitin-like protein 7 (159-168)
VLQDKDLFSV

SEQ ID NO: 13388 - protein, 9 aa, Artificial Sequence
  Zinc finger CCCH-type antiviral protein 1 (112-120)
VLSEENFKV

SEQ ID NO: 13389 - protein, 9 aa, Artificial Sequence
  Probable ubiquitin carboxyl-terminal hydrolase FAF-X (2317-2325)
VLSELLWQV

SEQ ID NO: 13390 - protein, 9 aa, Artificial Sequence
  Phosphatidylinositol N-acetylglucosaminyltransferase subunit A (165-173)
VLTNKLLTV

SEQ ID NO: 13391 - protein, 9 aa, Artificial Sequence
  UPF0505 protein C16orf62 (670-678)
VLVQLIHSV

SEQ ID NO: 13392 - protein, 10 aa, Artificial Sequence
  Coiled-coil domain-containing protein 84 (84-93)
VLYGGLLEHL

SEQ ID NO: 13393 - protein, 10 aa, Artificial Sequence
  Signal recognition particle subunit SRP68 (231-240)
VLYNQRVEEI

SEQ ID NO: 13394 - protein, 9 aa, Artificial Sequence
  BTB/POZ domain-containing protein 2 (212-220)
VMFKEPVEV

SEQ ID NO: 13395 - protein, 10 aa, Artificial Sequence
  Ligand-dependent nuclear receptor-interacting factor 1 (358-367)
VMFNGKVYLL

SEQ ID NO: 13396 - protein, 10 aa, Artificial Sequence
  Poly(rC)-binding protein 2 (165-174)
VMLESPPKGV

SEQ ID NO: 13397 - protein, 9 aa, Artificial Sequence
  Vesicle-associated membrane protein 4 (66-74)
VMQENITKV

SEQ ID NO: 13398 - protein, 10 aa, Artificial Sequence
  Transient receptor potential cation channel subfamily V member 2 (730-739)
VPRTLENPVL

SEQ ID NO: 13399 - protein, 9 aa, Artificial Sequence
  UPF0606 protein KIAA1549L (15-23)
VPSLHITTL

SEQ ID NO: 13400 - protein, 9 aa, Artificial Sequence
  Cholinesterase (308-316)
VPYGTPLSV

SEQ ID NO: 13401 - protein, 9 aa, Artificial Sequence
  Phosphatidylglycerophosphatase and protein-tyrosine phosphatase 1 (6-14)
VQDENVRGV

SEQ ID NO: 13402 - protein, 10 aa, Artificial Sequence
  Pre-mRNA-processing-splicing factor 8 (1168-1177)
VQWENSFVSV

SEQ ID NO: 13403 - protein, 8 aa, Artificial Sequence
  Nucleoprotein TPR (1846-1853)
VSDDTVEM

SEQ ID NO: 13404 - protein, 8 aa, Artificial Sequence
  Proliferating cell nuclear antigen (111-118)
VSDYEMKL

SEQ ID NO: 13405 - protein, 9 aa, Artificial Sequence
  SHC-transforming protein 1 (77-85)
VTREAISLV

SEQ ID NO: 13406 - protein, 9 aa, Artificial Sequence
  Uncharacterized protein C11orf24 (396-404)
VVDKTLLLV

SEQ ID NO: 13407 - protein, 9 aa, Artificial Sequence
  Protein SZT2 (1295-1303)
VVWGTVIRV

SEQ ID NO: 13408 - protein, 9 aa, Artificial Sequence
  N-alpha-acetyltransferase 20 (118-126)
VYRTVIEYY

SEQ ID NO: 13409 - protein, 9 aa, Artificial Sequence
  E3 ubiquitin-protein ligase UBR5 (446-454)
WVDETLSSV

SEQ ID NO: 13410 - protein, 9 aa, Artificial Sequence
  60S ribosomal protein L32 (95-103)
YCAEIAHNV

SEQ ID NO: 13411 - protein, 9 aa, Artificial Sequence
  EF-hand calcium-binding domain-containing protein 7 (548-556)
YENIIVHTY

SEQ ID NO: 13412 - protein, 9 aa, Artificial Sequence
  Catenin beta-1 (489-497)
YGLPVVVKL

SEQ ID NO: 13413 - protein, 10 aa, Artificial Sequence
  Signal recognition particle subunit SRP68 (333-342)
YILEGEPGKV

SEQ ID NO: 13414 - protein, 9 aa, Artificial Sequence
  Protein timeless homolog (772-780)
YILGKFFAL

SEQ ID NO: 13415 - protein, 9 aa, Artificial Sequence
  Glucose-fructose oxidoreductase domain-containing protein 2 (181-189)
YIVDLLTHL

SEQ ID NO: 13416 - protein, 9 aa, Artificial Sequence
  Kelch repeat and BTB domain-containing protein 4 (141-149)
YIYHGTVKL

SEQ ID NO: 13417 - protein, 9 aa, Artificial Sequence
  FACT complex subunit SSRP1 (232-240)
YKIPYTTVL

SEQ ID NO: 13418 - protein, 9 aa, Artificial Sequence
  Nucleolar protein 6 (206-214)
YLAHLAHHL

SEQ ID NO: 13419 - protein, 10 aa, Artificial Sequence
  NAD kinase (302-311)
YLDGHLITTV

SEQ ID NO: 13420 - protein, 10 aa, Artificial Sequence
  S-phase kinase-associated protein 1 (33-42)
YLDIKGLLDV

SEQ ID NO: 13421 - protein, 9 aa, Artificial Sequence
  Transcription cofactor vestigial-like protein 4 (13-21)
YLDKMNNNI

SEQ ID NO: 13422 - protein, 9 aa, Artificial Sequence
  Zinc finger protein 655 (93-101)
YLDPVQRDL

SEQ ID NO: 13423 - protein, 10 aa, Artificial Sequence
  Methyltransferase-like protein 9 (41-50)
YLDQGTQIFL

SEQ ID NO: 13424 - protein, 9 aa, Artificial Sequence
  Ubiquitin-conjugating enzyme E2 variant 3 (132-140)
YLDVVQSNV

SEQ ID NO: 13425 - protein, 9 aa, Artificial Sequence
  Nuclear factor erythroid 2-related factor 3 (299-307)
YLEDTDRNL

SEQ ID NO: 13426 - protein, 9 aa, Artificial Sequence
  MKI67 FHA domain-interacting nucleolar phosphoprotein (43-51)
YLFGERLLE

SEQ ID NO: 13427 - protein, 11 aa, Artificial Sequence
  Pyridoxal-dependent decarboxylase domain-containing protein 1 (347-357)
YLGLDGFVERI

SEQ ID NO: 13428 - protein, 10 aa, Artificial Sequence
  Unconventional myosin-Id (612-621)
YLGLLENVRV

SEQ ID NO: 13429 - protein, 9 aa, Artificial Sequence
  60S ribosomal protein L13a (137-145)
YLGRLAHEV

SEQ ID NO: 13430 - protein, 9 aa, Artificial Sequence
  Ubiquitin-like domain-containing CTD phosphatase 1 (165-173)
YLHEFLTSA

SEQ ID NO: 13431 - protein, 9 aa, Artificial Sequence
  Vam6/Vps39-like protein (368-376)
YLHTNVALV

SEQ ID NO: 13432 - protein, 9 aa, Artificial Sequence
  GTP-binding protein 2 (227-235)
YLHTTIFGL

SEQ ID NO: 13433 - protein, 10 aa, Artificial Sequence
  Isoleucine-tRNA ligase, cytoplasmic (626-635)
YLINSPVVRA

SEQ ID NO: 13434 - protein, 10 aa, Artificial Sequence
  Pre-mRNA-processing-splicing factor 8 (794-803)
YLKDGPYITA

SEQ ID NO: 13435 - protein, 10 aa, Artificial Sequence
  E3 ubiquitin-protein ligase MARCH6 (514-523)
YLLDLHSYLL

SEQ ID NO: 13436 - protein, 10 aa, Artificial Sequence
  Ninein (544-553)
YLLEEKIASL

SEQ ID NO: 13437 - protein, 9 aa, Artificial Sequence
  Unconventional myosin-Va (242-250)
YLLEKSRVV

SEQ ID NO: 13438 - protein, 10 aa, Artificial Sequence
  EH domain-containing protein 4 (80-89)
YLLEQDFPGM

SEQ ID NO: 13439 - protein, 9 aa, Artificial Sequence
  Protein fem-1 homolog A (168-176)
YLLEQGAQV

SEQ ID NO: 13440 - protein, 9 aa, Artificial Sequence
  PCI domain-containing protein 2 (252-260)
YLLPVKMLL

SEQ ID NO: 13441 - protein, 9 aa, Artificial Sequence
  Pecanex-like protein 3 (1380-1388)
YLNALVHLI

SEQ ID NO: 13442 - protein, 9 aa, Artificial Sequence
  Malignant T-cell-amplified sequence 1 (170-178)
YLNDGLWHM

SEQ ID NO: 13443 - protein, 9 aa, Artificial Sequence
  Elongation factor 2 (171-179)
YLNEIKDSV

SEQ ID NO: 13444 - protein, 11 aa, Artificial Sequence
  H/ACA ribonucleoprotein complex subunit 3 (6-16)
YLNEQGDRVYT

SEQ ID NO: 13445 - protein, 9 aa, Artificial Sequence
  Ferritin heavy chain (11-19)
YLNEQVKAI

SEQ ID NO: 13446 - protein, 10 aa, Artificial Sequence
  T-complex protein 1 subunit theta (278-287)
YLSEVGDTQV

SEQ ID NO: 13447 - protein, 9 aa, Artificial Sequence
  Probable C-mannosyltransferase DPY19L1 (356-364)
YLTSKIFGI

SEQ ID NO: 13448 - protein, 9 aa, Artificial Sequence
  Circadian clock protein PASD1 (168-176)
YLVGNVCIL

SEQ ID NO: 13449 - protein, 9 aa, Artificial Sequence
  Protocadherin beta-6 (446-454)
YLVTKVVAV

SEQ ID NO: 13450 - protein, 9 aa, Artificial Sequence
  Myotubularin-related protein 4 (250-258)
YLVTSIAKA

SEQ ID NO: 13451 - protein, 10 aa, Artificial Sequence
  F-actin-capping protein subunit beta (120-129)
YLWDLDHGFA

SEQ ID NO: 13452 - protein, 9 aa, Artificial Sequence
  Growth arrest and DNA damage-inducible protein GADD45 alpha (118-126)
YMDQWVPVI

SEQ ID NO: 13453 - protein, 9 aa, Artificial Sequence
  Signal transducing adapter molecule 2 (404-412)
YMGQSIHQV

SEQ ID NO: 13454 - protein, 11 aa, Artificial Sequence
  SWI/SNF-related matrix-associated actin-dependent regulator of chromatin subfamily B member 1 (26-36)
YMIGSEVGNYL

SEQ ID NO: 13455 - protein, 10 aa, Artificial Sequence
  Serine palmitoyltransferase small subunit A (24-33)
YMLEPWERTV

SEQ ID NO: 13456 - protein, 9 aa, Artificial Sequence
  Kinetochore protein Nuf2 (65-73)
YMMPVNSEV

SEQ ID NO: 13457 - protein, 9 aa, Artificial Sequence
  G patch domain-containing protein 11 (33-41)
YMSDSFINV

SEQ ID NO: 13458 - protein, 9 aa, Artificial Sequence
  Transcription factor SOX-8 (6-14)
YPHLHNAEL

SEQ ID NO: 13459 - protein, 9 aa, Artificial Sequence
  Immunoglobulin-binding protein 1 (259-267)
YPSLPTMTV

SEQ ID NO: 13460 - protein, 11 aa, Artificial Sequence
  RNA-binding motif protein 22 (253-263)
YQFGEIRTITV

SEQ ID NO: 13461 - protein, 9 aa, Artificial Sequence
  NADH dehydrogenase (ubiquinone) iron-sulfur protein 2, mitochondrial (245-253)
YQFSKNFSL

SEQ ID NO: 13462 - protein, 9 aa, Artificial Sequence
  GRB2-associated-binding protein 2 (324-332)
YQIPRTFTL

SEQ ID NO: 13463 - protein, 9 aa, Artificial Sequence
  Copper-transporting ATPase 1 (1410-1418)
YRKPTYESY

SEQ ID NO: 13464 - protein, 11 aa, Artificial Sequence
  Tuberin (602-612)
YTLPIASSIRL

SEQ ID NO: 13465 - protein, 9 aa, Artificial Sequence
  Heterogeneous nuclear ribonucleoprotein U-like protein 1 (797-805)
YTPPPPPTA

SEQ ID NO: 13466 - protein, 9 aa, Artificial Sequence
  PAS domain-containing serine/threonine-protein kinase (890-898)
YTWEEVFRV

SEQ ID NO: 13467 - protein, 16 aa, Artificial Sequence
  Selenoprotein H (51-66)
AAALSQALRLEAPELP

SEQ ID NO: 13468 - protein, 15 aa, Artificial Sequence
  40S ribosomal protein S26 (47-61)
AAAVRDISEASVFDA

SEQ ID NO: 13469 - protein, 17 aa, Artificial Sequence
  Profilin-1 (33-49)
AAVPGKTFVNITPAEVG

SEQ ID NO: 13470 - protein, 13 aa, Artificial Sequence
  Calmodulin (58-70)
ADGNGTIDFPEFL

SEQ ID NO: 13471 - protein, 13 aa, Artificial Sequence
  Coiled-coil and C2 domain-containing protein 2A (1275-1287)
AECALKFPNRQCL

SEQ ID NO: 13472 - protein, 10 aa, Artificial Sequence
  Helicase ARIP4 (881-890)
AEKKAAKKSY

SEQ ID NO: 13473 - protein, 12 aa, Artificial Sequence
  NHP2-like protein 1 (60-71)
AEPLEIILHLPL

SEQ ID NO: 13474 - protein, 14 aa, Artificial Sequence
  Uncharacterized protein C20orf144 (70-83)
AGLGSPAAPRLRGA

SEQ ID NO: 13475 - protein, 13 aa, Artificial Sequence
  ATP synthase mitochondrial F1 complex assembly factor 1 (20-32)
AGLYRGLCAVRSR

SEQ ID NO: 13476 - protein, 20 aa, Artificial Sequence
  Gamma-soluble NSF attachment protein (267-286)
AKLGLSLVVPGGGIKKKSPA

SEQ ID NO: 13477 - protein, 18 aa, Artificial Sequence
  Deoxyuridine 5'-triphosphate nucleotidohydrolase, mitochondrial (124-141)
ALDDTERGSGGFGSTGKN

SEQ ID NO: 13478 - protein, 10 aa, Artificial Sequence
  Lysine-specific demethylase 6A (1264-1273)
ALIAAGKEII

SEQ ID NO: 13479 - protein, 10 aa, Artificial Sequence
  Protein S100-A6 (81-90)
ALIYNEALKG

SEQ ID NO: 13480 - protein, 14 aa, Artificial Sequence
  Collagen alpha-2(VIII) chain (568-581)
ALYKNNVPATYTYD

SEQ ID NO: 13481 - protein, 13 aa, Artificial Sequence
  Peroxiredoxin-5, mitochondrial (54-66)
APIKVGDAIPAVE

SEQ ID NO: 13482 - protein, 11 aa, Artificial Sequence
  Neuroblast differentiation-associated protein AHNAK (105-115)
APKISMPDIDL

SEQ ID NO: 13483 - protein, 11 aa, Artificial Sequence
  Ephrin type-B receptor 1 (422-432)
APSTVPIMHQV

SEQ ID NO: 13484 - protein, 17 aa, Artificial Sequence
  Fer-1-like protein 5 (176-192)
ARQLMGNNIKPVVKVSI

SEQ ID NO: 13485 - protein, 13 aa, Artificial Sequence
  Molybdenum cofactor sulfurase (561-573)
ARTQPTPSEKAAG

SEQ ID NO: 13486 - protein, 16 aa, Artificial Sequence
  Protein LAP2 (1003-1018)
ASFPPQLLPRSESTEN

SEQ ID NO: 13487 - protein, 15 aa, Artificial Sequence
  Cysteine-rich protein 2 (59-73)
ATLFGPKGVNIGGAG

SEQ ID NO: 13488 - protein, 16 aa, Artificial Sequence
  Sodium channel and clathrin linker 1 (424-439)
AVEEELEKIYREGRGN

SEQ ID NO: 13489 - protein, 12 aa, Artificial Sequence
  Interferon-induced protein with tetratricopeptide repeats 2 (285-296)
CQIGCCYRAKVF

SEQ ID NO: 13490 - protein, 25 aa, Artificial Sequence
  Fas-binding factor 1 (99-123)
DADILGLKKSNSAPSKKAAKDPGKG

SEQ ID NO: 13491 - protein, 17 aa, Artificial Sequence
  IQ motif and SEC7 domain-containing protein 2 (977-993)
DFIKNLRGVDNGEDIPR

SEQ ID NO: 13492 - protein, 13 aa, Artificial Sequence
  Peptidyl-prolyl cis-trans isomerase A (9-21)
DIAVDGEPLGRVS

SEQ ID NO: 13493 - protein, 16 aa, Artificial Sequence
  Peptidyl-prolyl cis-trans isomerase A (9-24)
DIAVDGEPLGRVSFEL

SEQ ID NO: 13494 - protein, 15 aa, Artificial Sequence
  Beta-secretase 1 (93-107)
DTGSSNFAVGAAPHP

SEQ ID NO: 13495 - protein, 14 aa, Artificial Sequence
  Elongation factor 1-alpha 1 (252-265)
DVYKIGGIGTVPVG

SEQ ID NO: 13496 - protein, 14 aa, Artificial Sequence
  GDNF family receptor alpha-1 (117-130)
EDSPYEPVNSRLSD

SEQ ID NO: 13497 - protein, 10 aa, Artificial Sequence
  H/ACA ribonucleoprotein complex subunit 2 (144-153)
EEVQSLPLPL

SEQ ID NO: 13498 - protein, 14 aa, Artificial Sequence
  Rho guanine nucleotide exchange factor 17 (425-438)
EGLLRSQARTRAKG

SEQ ID NO: 13499 - protein, 14 aa, Artificial Sequence
  Uncharacterized protein C2orf15 (95-108)
EGTGTGSLSGKALG

SEQ ID NO: 13500 - protein, 12 aa, Artificial Sequence
  Nesprin-3 (221-232)
EHEEYQAGVDEF

SEQ ID NO: 13501 - protein, 15 aa, Artificial Sequence
  Ankyrin repeat domain-containing protein 35 (351-365)
EPRASGKQGSSLRPG

SEQ ID NO: 13502 - protein, 12 aa, Artificial Sequence
  Probable ATP-dependent RNA helicase DDX53 (502-513)
EQSDQERAVEDF

SEQ ID NO: 13503 - protein, 18 aa, Artificial Sequence
  DNA-binding protein RFX6 (414-431)
ERVDLNSIGSQALLTISG

SEQ ID NO: 13504 - protein, 13 aa, Artificial Sequence
  Annexin A2 (242-254)
ESIRKEVKGDLEN

SEQ ID NO: 13505 - protein, 14 aa, Artificial Sequence
  Annexin A2 (242-255)
ESIRKEVKGDLENA

SEQ ID NO: 13506 - protein, 11 aa, Artificial Sequence
  Elongation factor 1-alpha 1 (280-290)
FAPVNVTTEVK

SEQ ID NO: 13507 - protein, 11 aa, Artificial Sequence
  Plasminogen activator inhibitor 1 RNA-binding protein (21-31)
FDDESDPFEVL

SEQ ID NO: 13508 - protein, 14 aa, Artificial Sequence
  Peptidyl-prolyl cis-trans isomerase A (8-21)
FDIAVDGEPLGRVS

SEQ ID NO: 13509 - protein, 16 aa, Artificial Sequence
  Peptidyl-prolyl cis-trans isomerase A (8-23)
FDIAVDGEPLGRVSFE

SEQ ID NO: 13510 - protein, 9 aa, Artificial Sequence
  Alpha-2-macroglobulin receptor-associated protein (252-260)
FEEPRVIDL

SEQ ID NO: 13511 - protein, 15 aa, Artificial Sequence
  BTB/POZ domain-containing protein KCTD7 (96-110)
FIDRDGTHFGDVLNF

SEQ ID NO: 13512 - protein, 11 aa, Artificial Sequence
  Small nuclear ribonucleoprotein Sm D1 (74-84)
FILPDSLPLDT

SEQ ID NO: 13513 - protein, 9 aa, Artificial Sequence
  Proteasome activator complex subunit 2 (35-43)
FLPQKIIYL

SEQ ID NO: 13514 - protein, 12 aa, Artificial Sequence
  Triosephosphate isomerase (230-241)
FLVGGASLKPEF

SEQ ID NO: 13515 - protein, 12 aa, Artificial Sequence
  Protein FAM208B (156-167)
FRSPLSTGVKDL

SEQ ID NO: 13516 - protein, 24 aa, Artificial Sequence
  Elongation factor 1-alpha 1 (190-213)
FVPISGWNGDNMLEPSANMPWFKG

SEQ ID NO: 13517 - protein, 14 aa, Artificial Sequence
  Fanconi anemia group M protein (201-214)
GACPAAEIKCLVID

SEQ ID NO: 13518 - protein, 8 aa, Artificial Sequence
  Collagen alpha-4(IV) chain (170-177)
GEKGNSVF

SEQ ID NO: 13519 - protein, 21 aa, Artificial Sequence
  Heterogeneous nuclear ribonucleoproteins A2/B1 (333-353)
GGNYGPGGSGGSGGYGGRSRY

SEQ ID NO: 13520 - protein, 13 aa, Artificial Sequence
  Structural maintenance of chromosomes protein 4 (528-540)
GIYGRLGDLGAID

SEQ ID NO: 13521 - protein, 18 aa, Artificial Sequence
  60S ribosomal protein L5 (207-224)
GKETSPLQTPVVPENRFP

SEQ ID NO: 13522 - protein, 15 aa, Artificial Sequence
  Charged multivesicular body protein 7 (48-62)
GLATVLQDLLRRGEL

SEQ ID NO: 13523 - protein, 13 aa, Artificial Sequence
  Complement C4-A (1353-1365)
GLEEELQFSLGSK

SEQ ID NO: 13524 - protein, 17 aa, Artificial Sequence
  Complement C4-A (1353-1369)
GLEEELQFSLGSKINVK

SEQ ID NO: 13525 - protein, 23 aa, Artificial Sequence
  Collagen alpha-1(XIX) chain (351-373)
GLKGDKGETGLPGFPGSVGPKGQ

SEQ ID NO: 13526 - protein, 20 aa, Artificial Sequence
  Neuronal tyrosine-phosphorylated phosphoinositide-3-kinase adapter 2 (33-52)
GLVIQNASDIARENDRLRNE

SEQ ID NO: 13527 - protein, 20 aa, Artificial Sequence
  Kinesin-like protein KIF27 (84-103)
GQTGSGKTYTIGGGHIASVV

SEQ ID NO: 13528 - protein, 13 aa, Artificial Sequence
  Helicase SKI2W (705-717)
GRRGLDPTGTVIL

SEQ ID NO: 13529 - protein, 10 aa, Artificial Sequence
  E3 ubiquitin-protein ligase HUWE1 (757-766)
GTEERIPIPL

SEQ ID NO: 13530 - protein, 13 aa, Artificial Sequence
  Ankyrin repeat domain-containing protein 11 (421-433)
GTGEKLRLSAHTI

SEQ ID NO: 13531 - protein, 13 aa, Artificial Sequence
  US7745391-778469 (29-41)
GVALAPRPLGTSF

SEQ ID NO: 13532 - protein, 17 aa, Artificial Sequence
  Meprin A subunit beta (617-633)
GVCTVRDGKAECRCQSG

SEQ ID NO: 13533 - protein, 29 aa, Artificial Sequence
  F-box/LRR-repeat protein 4 (227-255)
GVKDKPVLSLKTSLIDMNDIEDDAYAEKD

SEQ ID NO: 13534 - protein, 14 aa, Artificial Sequence
  PHD finger protein 14 (609-622)
HFGCLDPPLKKSPK

SEQ ID NO: 13535 - protein, 15 aa, Artificial Sequence
  Arylsulfatase E (503-517)
HQRTLSPVPLQLDRL

SEQ ID NO: 13536 - protein, 17 aa, Artificial Sequence
  NACHT, LRR and PYD domains-containing protein 9 (146-162)
HTVVLEGPDGIGKTTLL

SEQ ID NO: 13537 - protein, 11 aa, Artificial Sequence
  60S ribosomal protein L8 (31-41)
IAAEGIHTGQF

SEQ ID NO: 13538 - protein, 16 aa, Artificial Sequence
  Kelch-like protein 2 (479-494)
IAEMSTRRSGAGVGVL

SEQ ID NO: 13539 - protein, 12 aa, Artificial Sequence
  Protein RER1 (80-91)
IAFLSPKVDPSL

SEQ ID NO: 13540 - protein, 13 aa, Artificial Sequence
  Peptidyl-prolyl cis-trans isomerase A (10-22)
IAVDGEPLGRVSF

SEQ ID NO: 13541 - protein, 14 aa, Artificial Sequence
  Dedicator of cytokinesis protein 4 (1742-1755)
IGDGALPRSDPNLS

SEQ ID NO: 13542 - protein, 10 aa, Artificial Sequence
  L-lactate dehydrogenase A-like 6B (183-192)
IIVSNPVDIL

SEQ ID NO: 13543 - protein, 20 aa, Artificial Sequence
  Carboxy-terminal domain RNA polymerase II polypeptide A small phosphatase 2 (215-234)
ILDNSPASYVFHTENAVPVQ

SEQ ID NO: 13544 - protein, 13 aa, Artificial Sequence
  Heat shock cognate 71 kDa protein (379-391)
ILSGDKSENVQDL

SEQ ID NO: 13545 - protein, 21 aa, Artificial Sequence
  Poly(rC)-binding protein 2 (38-58)
INISEGNCPERIITLAGPTNA

SEQ ID NO: 13546 - protein, 12 aa, Artificial Sequence
  Diacylglycerol O-acyltransferase 2 (253-264)
IPKLEHPTQQDI

SEQ ID NO: 13547 - protein, 15 aa, Artificial Sequence
  Elongation factor 1-alpha 1 (115-129)
IVAAGVGEFEAGISK

SEQ ID NO: 13548 - protein, 17 aa, Artificial Sequence
  Macrophage migration inhibitory factor (3-19)
IVNTNVPRASVPDGFLS

SEQ ID NO: 13549 - protein, 10 aa, Artificial Sequence
  L-lactate dehydrogenase A chain (135-144)
IVSNPVDILT

SEQ ID NO: 13550 - protein, 16 aa, Artificial Sequence
  Fructose-bisphosphate aldolase A (153-168)
KIGEHTPSALAIMENA

SEQ ID NO: 13551 - protein, 11 aa, Artificial Sequence
  PWWP domain-containing protein 2B (191-201)
KIPSRVHGSLE

SEQ ID NO: 13552 - protein, 17 aa, Artificial Sequence
  DNA mismatch repair protein Mlh3 (135-151)
KLLSSTLIPPLEITVTE

SEQ ID NO: 13553 - protein, 12 aa, Artificial Sequence
  Cathepsin K (314-325)
KNNACGIANLAS

SEQ ID NO: 13554 - protein, 17 aa, Artificial Sequence
  Integrator complex subunit 12 (329-345)
KPVGLTGLATSSKGGIG

SEQ ID NO: 13555 - protein, 13 aa, Artificial Sequence
  Synaptojanin-1 (1453-1465)
KSRASSSLDGFKD

SEQ ID NO: 13556 - protein, 13 aa, Artificial Sequence
  Thymidylate synthase (284-296)
KVEKIDDFKAEDF

SEQ ID NO: 13557 - protein, 10 aa, Artificial Sequence
  Zinc finger MYND domain-containing protein 15 (138-147)
KVEPEEDREL

SEQ ID NO: 13558 - protein, 12 aa, Artificial Sequence
  Glyceraldehyde-3-phosphate dehydrogenase (219-230)
KVIPELNGKLTG

SEQ ID NO: 13559 - protein, 13 aa, Artificial Sequence
  Alpha-enolase (343-355)
KVNQIGSVTESLQ

SEQ ID NO: 13560 - protein, 15 aa, Artificial Sequence
  Histone H2A type 2-A (100-114)
KVTIAQGGVLPNIQA

SEQ ID NO: 13561 - protein, 9 aa, Artificial Sequence
  D-dopachrome decarboxylase (89-97)
LALGQDRIL

SEQ ID NO: 13562 - protein, 11 aa, Artificial Sequence
  Acidic fibroblast growth factor intracellular-binding protein (169-179)
LARDYAAIVFF

SEQ ID NO: 13563 - protein, 18 aa, Artificial Sequence
  FAST kinase domain-containing protein 1 (497-514)
LDLLRKELKSLKGNTFPE

SEQ ID NO: 13564 - protein, 14 aa, Artificial Sequence
  F-box only protein 41 (284-297)
LESLLKAAGGNLLI

SEQ ID NO: 13565 - protein, 10 aa, Artificial Sequence
  Eukaryotic initiation factor 4A-III (110-119)
LILAPTRELA

SEQ ID NO: 13566 - protein, 13 aa, Artificial Sequence
  Alpha-enolase (342-354)
LKVNQIGSVTESL

SEQ ID NO: 13567 - protein, 11 aa, Artificial Sequence
  Threonine synthase-like 1 (295-305)
LLERCIHPADI

SEQ ID NO: 13568 - protein, 10 aa, Artificial Sequence
  Beta-1,4-galactosyltransferase 7 (20-29)
LLSGGLPRKC

SEQ ID NO: 13569 - protein, 10 aa, Artificial Sequence
  Protein S100-A11 (40-49)
LSFMNTELAA

SEQ ID NO: 13570 - protein, 15 aa, Artificial Sequence
  4F2 cell-surface antigen heavy chain (496-510)
LSTQPGREEGSPLEL

SEQ ID NO: 13571 - protein, 12 aa, Artificial Sequence
  L-lactate dehydrogenase A chain (254-265)
LSVADLAESIMK

SEQ ID NO: 13572 - protein, 9 aa, Artificial Sequence
  Complement C4-A (1202-1210)
LTKAPVDLL

SEQ ID NO: 13573 - protein, 12 aa, Artificial Sequence
  Usherin (3700-3711)
LYWSLPEKPNGL

SEQ ID NO: 13574 - protein, 11 aa, Artificial Sequence
  Phosphopantothenoylcysteine decarboxylase (1-11)
MEPKASCPAAA

SEQ ID NO: 13575 - protein, 14 aa, Artificial Sequence
  DEAD/H box polypeptide 11 like 12 (1-14)
MGLICRDPATKVKP

SEQ ID NO: 13576 - protein, 13 aa, Artificial Sequence
  Elongation factor 1-alpha 1 (201-213)
MLEPSANMPWFKG

SEQ ID NO: 13577 - protein, 14 aa, Artificial Sequence
  Transgelin-2 (130-143)
MNLGGLAVARDDGL

SEQ ID NO: 13578 - protein, 10 aa, Artificial Sequence
  Nucleoside diphosphate kinase B (76-85)
MVWEGLNVVK

SEQ ID NO: 13579 - protein, 11 aa, Artificial Sequence
  Endoplasmic reticulum aminopeptidase 2 (861-869)
NAISRIPKGQV

SEQ ID NO: 13580 - protein, 20 aa, Artificial Sequence
  Wiskott-Aldrich syndrome protein (262-281)
NLDPDLRSLFSRAGISEAQL

SEQ ID NO: 13581 - protein, 9 aa, Artificial Sequence
  Cartilage intermediate layer protein 1 (779-787)
NLEPRTGFL

SEQ ID NO: 13582 - protein, 9 aa, Artificial Sequence
  Probable phosphoglycerate mutase 4 (209-217)
NLPTGIPIV

SEQ ID NO: 13583 - protein, 14 aa, Artificial Sequence
  Nuclear receptor subfamily 1 group D member 1 (343-356)
NNTLAAQRHNEALN

SEQ ID NO: 13584 - protein, 18 aa, Artificial Sequence
  Tumor protein D52 (212-229)
NSAANASATTTEPLPEKT

SEQ ID NO: 13585 - protein, 20 aa, Artificial Sequence
  Tumor protein D52 (212-231)
NSAANASATTTEPLPEKTQE

SEQ ID NO: 13586 - protein, 23 aa, Artificial Sequence
  Replication initiator 1 (10-32)
PAAEVRPGQGRGATAGPRGAAPP

SEQ ID NO: 13587 - protein, 15 aa, Artificial Sequence
  Histidine protein methyltransferase 1 homolog (142-156)
PGENIVSKSFSSHSD

SEQ ID NO: 13588 - protein, 19 aa, Artificial Sequence
  Glutaredoxin-2, mitochondrial (32-50)
PGRTRSAARRMESNTSSSL

SEQ ID NO: 13589 - protein, 19 aa, Artificial Sequence
  Insulin receptor substrate 2 (989-1007)
PKPGAPSGHPVGSLDGLLS

SEQ ID NO: 13590 - protein, 11 aa, Artificial Sequence
  Polycystin-1 (4192-4202)
QLDGLSVSLGR

SEQ ID NO: 13591 - protein, 11 aa, Artificial Sequence
  Keratin, type II cytoskeletal 8 (226-236)
QLYEEEIRELQ

SEQ ID NO: 13592 - protein, 31 aa, Artificial Sequence
  Cilia- and flagella-associated protein 52 (145-175)
RDAICGSPAAGLNVGNATNVIFSRCRDEMFM

SEQ ID NO: 13593 - protein, 15 aa, Artificial Sequence
  Histone H3.3 (84-98)
RFQSAAIGALQEASE

SEQ ID NO: 13594 - protein, 26 aa, Artificial Sequence
  keratin 8, isoform CRA (125-150)
RGGLGGGYGGASGMGGITAVMVNQNL

SEQ ID NO: 13595 - protein, 11 aa, Artificial Sequence
  Oxysterol-binding protein 2 (60-70)
RGTINLSTAHI

SEQ ID NO: 13596 - protein, 13 aa, Artificial Sequence
  F-actin-capping protein subunit alpha-2 (100-112)
RKEATDPRPCEVE

SEQ ID NO: 13597 - protein, 19 aa, Artificial Sequence
  kelch repeat and BTB domain-containing protein 6 (1-18)
RKVLREDDPSSVRLASPSS

SEQ ID NO: 13598 - protein, 14 aa, Artificial Sequence
  UV excision repair protein RAD23 homolog B (268-281)
RQIIQQNPSLLPAL

SEQ ID NO: 13599 - protein, 24 aa, Artificial Sequence
  Protein boule-like (35-58)
SAPRYGTVIPNRIFVGGIDFKTNE

SEQ ID NO: 13600 - protein, 18 aa, Artificial Sequence
  Beta-1,3-galactosyltransferase 6 (23-40)
SAQPLRDARCALAPGDPR

SEQ ID NO: 13601 - protein, 13 aa, Artificial Sequence
  Structure-specific endonuclease subunit SLX4 (603-615)
SASQREHQALQDL

SEQ ID NO: 13602 - protein, 15 aa, Artificial Sequence
  Elongation factor 1-alpha 1 (396-410)
SGDAAIVDMVPGKPM

SEQ ID NO: 13603 - protein, 13 aa, Artificial Sequence
  Fructose-bisphosphate aldolase A (272-284)
SGGQSEEEASINL

SEQ ID NO: 13604 - protein, 14 aa, Artificial Sequence
  Sodium-coupled monocarboxylate transporter 2 (343-356)
SGTLSTVASSINAL

SEQ ID NO: 13605 - protein, 13 aa, Artificial Sequence
  Poly(rC)-binding protein 1 (223-235)
SIQGQHTISPLDL

SEQ ID NO: 13606 - protein, 17 aa, Artificial Sequence
  DNA ligase 3 (790-806)
SKSEAHTADGISIRFPR

SEQ ID NO: 13607 - protein, 12 aa, Artificial Sequence
  Keratin, type II cytoskeletal 8 (253-264)
SLDMDSIIAEVK

SEQ ID NO: 13608 - protein, 12 aa, Artificial Sequence
  Rabenosyn-5 (541-552)
SLHTRTRSLDFR

SEQ ID NO: 13609 - protein, 12 aa, Artificial Sequence
  Leucine-rich repeat-containing protein 28 (186-197)
SMAGNRLAFLPL

SEQ ID NO: 13610 - protein, 10 aa, Artificial Sequence
  NUAK family SNF1-like kinase 2 (446-455)
SNLKLPKGIL

SEQ ID NO: 13611 - protein, 12 aa, Artificial Sequence
  Keratin, type I cytoskeletal 18 (272-283)
SQQIEESTTVVT

SEQ ID NO: 13612 - protein, 22 aa, Artificial Sequence
  Striated muscle preferentially expressed protein kinase isoform X10 (928-946)
SQVLREGSKAGGGTLLCLPLAE

SEQ ID NO: 13613 - protein, 10 aa, Artificial Sequence
  Vimentin (72-81)
SSVPGVRLLQ

SEQ ID NO: 13614 - protein, 14 aa, Artificial Sequence
  4F2 cell-surface antigen heavy chain (497-510)
STQPGREEGSPLEL

SEQ ID NO: 13615 - protein, 17 aa, Artificial Sequence
  Laminin subunit alpha-4 (1023-1039)
STSVPCARDKLAFTQSR

SEQ ID NO: 13616 - protein, 13 aa, Artificial Sequence
  Otoferlin (965-977)
TELRVIIGKPLLS

SEQ ID NO: 13617 - protein, 14 aa, Artificial Sequence
  Procollagen-lysine,2-oxoglutarate 5-dioxygenase 1 (388-401)
TEPNSLRLLIQQNK

SEQ ID NO: 13618 - protein, 17 aa, Artificial Sequence
  Galectin-1 (71-87)
TEQREAVFPFQPGSVAE

SEQ ID NO: 13619 - protein, 19 aa, Artificial Sequence
  Ovochymase-1 (314-332)
TKALSSVQEVNGSQRGKGI

SEQ ID NO: 13620 - protein, 24 aa, Artificial Sequence
  Envoplakin (1400-1423)
TQKDPKLREEHSRLSGSLDEEVGR

SEQ ID NO: 13621 - protein, 12 aa, Artificial Sequence
  Neuron navigator 2 (450-461)
TTVGPASSSPKI

SEQ ID NO: 13622 - protein, 19 aa, Artificial Sequence
  Bifunctional heparan sulfate N-deacetylase/N-sulfotransferase 3 isoform X3 (310-335)
VAILVSKEGARMGLDTHTP

SEQ ID NO: 13623 - protein, 12 aa, Artificial Sequence
  VIP peptides (52-63)
VFTDNYTRLRKQ

SEQ ID NO: 13624 - protein, 9 aa, Artificial Sequence
  60S acidic ribosomal protein P2 (54-62)
VIAQGIGKL

SEQ ID NO: 13625 - protein, 18 aa, Artificial Sequence
  Elongation factor 1-alpha 1 (344-361)
VIILNHPGQISAGYAPVL

SEQ ID NO: 13626 - protein, 17 aa, Artificial Sequence
  Activin receptor type-2A (262-278)
VLEGAINFQRDAFLRID

SEQ ID NO: 13627 - protein, 19 aa, Artificial Sequence
  Serine/threonine-protein phosphatase with EF-hands 1 (308-326)
VLIPPTETNRDHDTDSKHN

SEQ ID NO: 13628 - protein, 11 aa, Artificial Sequence
  Galectin-1 (31-41)
VLNLGKDSNNL

SEQ ID NO: 13629 - protein, 13 aa, Artificial Sequence
  Profilin-1 (41-53)
VNITPAEVGVLVG

SEQ ID NO: 13630 - protein, 18 aa, Artificial Sequence
  Kin of IRRE-like protein 3 (402-419)
VPRVGAGEREVTLTVNGP

SEQ ID NO: 13631 - protein, 13 aa, Artificial Sequence
  Keratin, type II cytoskeletal 8 (66-78)
VTVNQSLLSPLVL

SEQ ID NO: 13632 - protein, 15 aa, Artificial Sequence
  Enhancer of rudimentary homolog (71-85)
VYRADTQTYQPYNKD

SEQ ID NO: 13633 - protein, 16 aa, Artificial Sequence
  Ankyrin repeat domain-containing protein 26 (168-183)
YDANIEAKNKDDLTPL

SEQ ID NO: 13634 - protein, 17 aa, Artificial Sequence
  78 kDa glucose-regulated protein (635-651)
YGSAGPPPTGEEDTAEK

SEQ ID NO: 13635 - protein, 19 aa, Artificial Sequence
  78 kDa glucose-regulated protein (635-653)
YGSAGPPPTGEEDTAEKDE

SEQ ID NO: 13636 - protein, 12 aa, Artificial Sequence
  Alpha-enolase (270-281)
YISPDQLADLYK

SEQ ID NO: 13637 - protein, 12 aa, Artificial Sequence
  Microsomal glutathione S-transferase 1 (121-132)
YLTPLPQPNRAL

SEQ ID NO: 13638 - protein, 14 aa, Artificial Sequence
  Beta-actin-like protein 2 (8-21)
YNELRVAPDEHPIL

SEQ ID NO: 13639 - protein, 21 aa, Artificial Sequence
  Gamma-enolase (25-45)
YTAKGLFRAAVPSGASTGIYE

SEQ ID NO: 13640 - protein, 14 aa, Artificial Sequence
  Polypyrimidine tract-binding protein 1 (114-127)
YTSVTPVLRGQPIY

SEQ ID NO: 13641 - protein, 9 aa, Artificial Sequence
  HLA class I histocompatibility antigen, B-13 alpha chain (26-34)
YVDDTQFVR

SEQ ID NO: 13642 - protein, 13 aa, Artificial Sequence
  Matrix-remodeling-associated protein 5 (34-46)
YVPSEVHCTFRSL

SEQ ID NO: 13643 - protein, 9 aa, Artificial Sequence
  Flotillin-2 (156-164)
DVYDKVDYL

SEQ ID NO: 13644 - protein, 9 aa, Artificial Sequence
  Gamma-adducin (305-313)
EAFHYIFNV

SEQ ID NO: 13645 - protein, 9 aa, Artificial Sequence
  Nucleoporin GLE1 (443-451)
EIFDKIHSL

SEQ ID NO: 13646 - protein, 9 aa, Artificial Sequence
  GRIP1-associated protein 1 (707-715)
EVAELFQRL

SEQ ID NO: 13647 - protein, 9 aa, Artificial Sequence
  HMG domain-containing protein 3 (954-962)
EVFALIHEL

SEQ ID NO: 13648 - protein, 10 aa, Artificial Sequence
  Beta-hexosaminidase subunit beta (330-339)
EVFPDQFIHL

SEQ ID NO: 13649 - protein, 9 aa, Artificial Sequence
  Selenide, water dikinase 2 (336-344)
EVSFVIHNL

SEQ ID NO: 13650 - protein, 9 aa, Artificial Sequence
  ATPase family AAA domain-containing protein 1 (15-23)
EVVGLIFRL

SEQ ID NO: 13651 - protein, 9 aa, Artificial Sequence
  MOB kinase activator 3A (64-72)
HVVDFFNRV

SEQ ID NO: 13652 - protein, 9 aa, Artificial Sequence
  Transmembraneoprotein NMB (539-547)
KGLSVFLNR

SEQ ID NO: 13653 - protein, 11 aa, Artificial Sequence
  Cytochrome b-245 light chain (78-88)
KLFGPFTRNYY

SEQ ID NO: 13654 - protein, 9 aa, Artificial Sequence
  Syntenin-1 (270-278)
MPAFIFEHI

SEQ ID NO: 13655 - protein, 10 aa, Artificial Sequence
  Transcription factor 7-like 2 (366-375)
REEQAKYYEL

SEQ ID NO: 13656 - protein, 9 aa, Artificial Sequence
  Tumor protein p63-regulated gene 1-like protein (59-67)
RVKEYFVFR

SEQ ID NO: 13657 - protein, 9 aa, Artificial Sequence
  Clathrin heavy chain 1 (1342-1350)
RVNIPKVLR

SEQ ID NO: 13658 - protein, 10 aa, Artificial Sequence
  COP9 signalosome complex subunit 6 (311-320)
VLYDRQGIGR

SEQ ID NO: 13659 - protein, 18 aa, Artificial Sequence
  GTP-binding nuclear protein Ran (203-220)
APPEVVMDPALAAQYEHD

SEQ ID NO: 13660 - protein, 9 aa, Artificial Sequence
  Ubiquitin carboxyl-terminal hydrolase 48 (534-542)
AADIFYSRY

SEQ ID NO: 13661 - protein, 9 aa, Artificial Sequence
  Transmembrane protein 141 (30-38)
AFMKGVFTF

SEQ ID NO: 13662 - protein, 10 aa, Artificial Sequence
  DNA replication licensing factor MCM4 (846-855)
ALADDDFLTV

SEQ ID NO: 13663 - protein, 9 aa, Artificial Sequence
  Protein FAM188B (498-506)
ALADIVWRA

SEQ ID NO: 13664 - protein, 9 aa, Artificial Sequence
  Protein TANC1 (1389-1397)
ALADLQEAV

SEQ ID NO: 13665 - protein, 11 aa, Artificial Sequence
  Protein TANC1 (1389-1399)
ALADLQEAVKL

SEQ ID NO: 13666 - protein, 9 aa, Artificial Sequence
  5-oxoprolinase (523-531)
ALADVVHEA

SEQ ID NO: 13667 - protein, 9 aa, Artificial Sequence
  Nodal modulator 3 (459-467)
ALAGVSFEI

SEQ ID NO: 13668 - protein, 10 aa, Artificial Sequence
  Midasin (1405-1414)
ALANQKLYSV

SEQ ID NO: 13669 - protein, 9 aa, Artificial Sequence
  WD repeat-containing protein 36 (542-550)
ALDDFSISV

SEQ ID NO: 13670 - protein, 10 aa, Artificial Sequence
  EP300-interacting inhibitor of differentiation 1 (85-94)
ALDGGFQMHY

SEQ ID NO: 13671 - protein, 9 aa, Artificial Sequence
  Elongation factor 2 (350-358)
ALDNFLDKL

SEQ ID NO: 13672 - protein, 9 aa, Artificial Sequence
  Inverted formin-2 (131-139)
ALDTSNVMV

SEQ ID NO: 13673 - protein, 11 aa, Artificial Sequence
  Keratinocyte-associated protein 2 (108-118)
ALFASGLIHRV

SEQ ID NO: 13674 - protein, 12 aa, Artificial Sequence
  Exportin-2 (684-695)
ALFPHLLQPVLW

SEQ ID NO: 13675 - protein, 8 aa, Artificial Sequence
  Activating signal cointegrator 1 complex subunit 3 (627-634)
ALGTVTNV

SEQ ID NO: 13676 - protein, 9 aa, Artificial Sequence
  Replication factor C subunit 5 (276-284)
ALHDILTEI

SEQ ID NO: 13677 - protein, 10 aa, Artificial Sequence
  Tryptophan-tRNA ligase, cytoplasmic (433-442)
ALIEVLQPLI

SEQ ID NO: 13678 - protein, 10 aa, Artificial Sequence
  Tight junction protein ZO-1 (692-701)
ALLDVTPNAV

SEQ ID NO: 13679 - protein, 9 aa, Artificial Sequence
  Polypeptide N-acetylgalactosaminyltransferase 2 (185-193)
ALLGKIEKV

SEQ ID NO: 13680 - protein, 9 aa, Artificial Sequence
  Bifunctional glutamate/proline-tRNA ligase (218-226)
ALLNQHYQV

SEQ ID NO: 13681 - protein, 9 aa, Artificial Sequence
  LEM domain-containing protein 2 (70-78)
ALLTAVTNV

SEQ ID NO: 13682 - protein, 10 aa, Artificial Sequence
  Nuclear pore complex protein Nup205 (494-503)
ALLTGIISKA

SEQ ID NO: 13683 - protein, 10 aa, Artificial Sequence
  LYST-interacting protein LIP6 (84-93)
ALMDGKVYDI

SEQ ID NO: 13684 - protein, 11 aa, Artificial Sequence
  Leishmanolysin-like peptidase (353-363)
ALMEDTGRQML

SEQ ID NO: 13685 - protein, 9 aa, Artificial Sequence
  Kinesin-like protein KIF7 (91-99)
ALNEDIVRV

SEQ ID NO: 13686 - protein, 9 aa, Artificial Sequence
  40S ribosomal protein S12 (17-25)
ALQEVLKTA

SEQ ID NO: 13687 - protein, 9 aa, Artificial Sequence
  Anthrax toxin receptor 1 (207-215)
ALQGIIHSI

SEQ ID NO: 13688 - protein, 10 aa, Artificial Sequence
  Probable ATP-dependent RNA helicase DDX5 (128-137)
ALSGLDMVGV

SEQ ID NO: 13689 - protein, 9 aa, Artificial Sequence
  Actin-related protein 2/3 complex subunit 1A (24-32)
ALSPNNHEV

SEQ ID NO: 13690 - protein, 9 aa, Artificial Sequence
  DNA-dependent protein kinase catalytic subunit (3134-3142)
ALTEIQEFI

SEQ ID NO: 13691 - protein, 9 aa, Artificial Sequence
  Annexin A1 (99-107)
ALTGHLEEV

SEQ ID NO: 13692 - protein, 10 aa, Artificial Sequence
  Cyclin-dependent kinase 2 (95-104)
ALTGIPLPLI

SEQ ID NO: 13693 - protein, 10 aa, Artificial Sequence
  Staphylococcal nuclease domain-containing protein 1 (428-437)
ALVSKGLATV

SEQ ID NO: 13694 - protein, 9 aa, Artificial Sequence
  Nicotinate-nucleotide pyrophosphorylase (carboxylating) (45-53)
ALWAKSPGV

SEQ ID NO: 13695 - protein, 11 aa, Artificial Sequence
  Guanine nucleotide-binding protein G(I)/G(S)/G(T) subunit beta-1 (74-84)
ALWDIETGQQT

SEQ ID NO: 13696 - protein, 9 aa, Artificial Sequence
  Centrosome-associated protein CEP250 (656-664)
ALWEKNTHL

SEQ ID NO: 13697 - protein, 12 aa, Artificial Sequence
  Nuclear pore complex protein Nup160 (372-383)
ALWHDAENQTVV

SEQ ID NO: 13698 - protein, 12 aa, Artificial Sequence
  Tyrosine-protein kinase JAK1 (79-90)
ALYDENTKLWYA

SEQ ID NO: 13699 - protein, 11 aa, Artificial Sequence
  Caskin-2 (147-157)
ALYGKTEVVRL

SEQ ID NO: 13700 - protein, 9 aa, Artificial Sequence
  Probable dolichyl pyrophosphate Glc1Man9GlcNAc2 alpha-1,3-glucosyltransferase (287-295)
ALYNALDKV

SEQ ID NO: 13701 - protein, 9 aa, Artificial Sequence
  Nuclear pore complex protein Nup155 (1038-1046)
ALYNWLIQV

SEQ ID NO: 13702 - protein, 13 aa, Artificial Sequence
  Lysine-tRNA ligase (583-595)
AMFLTDSNNIKEV

SEQ ID NO: 13703 - protein, 9 aa, Artificial Sequence
  Protein GPR107 (189-197)
AMGEKSFSV

SEQ ID NO: 13704 - protein, 9 aa, Artificial Sequence
  Probable cation-transporting ATPase 13A3 (829-837)
AMNGKSFSV

SEQ ID NO: 13705 - protein, 9 aa, Artificial Sequence
  Protein Wnt-5a (20-28)
AMSSKFFLV

SEQ ID NO: 13706 - protein, 8 aa, Artificial Sequence
  Syndecan-4 (2-9)
APARLFAL

SEQ ID NO: 13707 - protein, 9 aa, Artificial Sequence
  Dehydrogenase/reductase SDR family member 4 (110-118)
APGLIKTSF

SEQ ID NO: 13708 - protein, 9 aa, Artificial Sequence
  Filamin-A (1687-1695)
APQPGKYVI

SEQ ID NO: 13709 - protein, 9 aa, Artificial Sequence
  U1 small nuclear ribonucleoprotein 70 kDa (14-22)
APRDPIPYL

SEQ ID NO: 13710 - protein, 9 aa, Artificial Sequence
  Vacuolar protein sorting-associated protein 16 homolog (41-49)
APYGGPIAL

SEQ ID NO: 13711 - protein, 9 aa, Artificial Sequence
  Fatty acid desaturase 1 (12-20)
AQGPTPRYF

SEQ ID NO: 13712 - protein, 10 aa, Artificial Sequence
  Elongation factor 1-gamma (19-28)
AQYSGAQVRV

SEQ ID NO: 13713 - protein, 10 aa, Artificial Sequence
  Serine/threonine-protein kinase SMG1 (35-44)
ASADPDNLKY

SEQ ID NO: 13714 - protein, 10 aa, Artificial Sequence
  RalBP1-associated Eps domain-containing protein 1 (609-618)
ASDPASSLRV

SEQ ID NO: 13715 - protein, 10 aa, Artificial Sequence
  Tryptophan-tRNA ligase, cytoplasmic (352-361)
ASDPNSSIFL

SEQ ID NO: 13716 - protein, 13 aa, Artificial Sequence
  Extended synaptotagmin-2 (868-880)
ASEELAKGWTQWY

SEQ ID NO: 13717 - protein, 10 aa, Artificial Sequence
  Alpha-enolase (78-87)
ASEFFRSGKY

SEQ ID NO: 13718 - protein, 12 aa, Artificial Sequence
  Unconventional myosin-Ib (243-254)
ASELFKDKKALY

SEQ ID NO: 13719 - protein, 12 aa, Artificial Sequence
  Protein-glutamate O-methyltransferase (421-432)
ASEPSWWTTGKY

SEQ ID NO: 13720 - protein, 8 aa, Artificial Sequence
  Keratinocyte-associated protein 2 (111-118)
ASGLIHRV

SEQ ID NO: 13721 - protein, 10 aa, Artificial Sequence
  Cadherin-5 (339-348)
ATDPTIDLRY

SEQ ID NO: 13722 - protein, 10 aa, Artificial Sequence
  Mitogen-activated protein kinase kinase kinase MLT (111-120)
ATDVAKGMHY

SEQ ID NO: 13723 - protein, 11 aa, Artificial Sequence
  Mitogen-activated protein kinase kinase kinase MLT (111-121)
ATDVAKGMHYL

SEQ ID NO: 13724 - protein, 10 aa, Artificial Sequence
  Coatomer subunit beta' (480-489)
ATEESFFILK

SEQ ID NO: 13725 - protein, 12 aa, Artificial Sequence
  Rho GTPase-activating protein 5 (908-919)
ATEITAKFTALY

SEQ ID NO: 13726 - protein, 9 aa, Artificial Sequence
  Transcription initiation protein SPT3 homolog (109-117)
ATELQSMMY

SEQ ID NO: 13727 - protein, 9 aa, Artificial Sequence
  Clathrin heavy chain 1 (1626-1634)
ATETQPIVY

SEQ ID NO: 13728 - protein, 9 aa, Artificial Sequence
  HEAT repeat-containing protein 5A (1311-1319)
AVKLPGGQL

SEQ ID NO: 13729 - protein, 11 aa, Artificial Sequence
  L-lactate dehydrogenase B chain (200-210)
AVWSGVNVAGV

SEQ ID NO: 13730 - protein, 10 aa, Artificial Sequence
  Myotrophin (75-84)
AVYEGHVSCV

SEQ ID NO: 13731 - protein, 10 aa, Artificial Sequence
  Ubiquitin carboxyl-terminal hydrolase 11 (318-327)
AYADLVKQAW

SEQ ID NO: 13732 - protein, 9 aa, Artificial Sequence
  Phosphoinositide 3-kinase regulatory subunit 4 (481-489)
AYAENIALL

SEQ ID NO: 13733 - protein, 9 aa, Artificial Sequence
  Solute carrier family 26 member 6 (67-75)
AYALLLQHL

SEQ ID NO: 13734 - protein, 9 aa, Artificial Sequence
  CD109 antigen (1146-1154)
AYALLSHFL

SEQ ID NO: 13735 - protein, 10 aa, Artificial Sequence
  Stress-induced-phosphoprotein 1 (349-358)
AYARIGNSYF

SEQ ID NO: 13736 - protein, 9 aa, Artificial Sequence
  Nuclear receptor coactivator 7 (730-738)
AYATHPFKF

SEQ ID NO: 13737 - protein, 9 aa, Artificial Sequence
  WD repeat-containing protein 36 (426-434)
AYFLKPKEL

SEQ ID NO: 13738 - protein, 9 aa, Artificial Sequence
  Probable ATP-dependent RNA helicase DDX60 (93-101)
AYFNFPELL

SEQ ID NO: 13739 - protein, 9 aa, Artificial Sequence
  Liprin-alpha-4 (952-960)
AYGDMNHEW

SEQ ID NO: 13740 - protein, 10 aa, Artificial Sequence
  S-adenosylmethionine synthase isoform type-2 (376-385)
AYGHFGRDSF

SEQ ID NO: 13741 - protein, 9 aa, Artificial Sequence
  Mesoderm induction early response protein 1 (319-327)
AYGKDFHLI

SEQ ID NO: 13742 - protein, 9 aa, Artificial Sequence
  WD repeat-containing protein 36 (84-92)
AYGNVFSAF

SEQ ID NO: 13743 - protein, 9 aa, Artificial Sequence
  Kynurenine-oxoglutarate transaminase 3 (134-142)
AYGSLFNTI

SEQ ID NO: 13744 - protein, 9 aa, Artificial Sequence
  Cleavage stimulation factor subunit 3 (440-448)
AYIDYLSHL

SEQ ID NO: 13745 - protein, 9 aa, Artificial Sequence
  Leucine-zipper-like transcriptional regulator 1 (75-83)
AYKDAIYVF

SEQ ID NO: 13746 - protein, 9 aa, Artificial Sequence
  Small subunit processome component 20 homolog (1114-1122)
AYLPKILQI

SEQ ID NO: 13747 - protein, 9 aa, Artificial Sequence
  Ubiquitin-like-conjugating enzyme ATG3 (65-73)
AYLPTGKQF

SEQ ID NO: 13748 - protein, 11 aa, Artificial Sequence
  Elongation factor 2 (286-296)
AYLPVNESFGF

SEQ ID NO: 13749 - protein, 10 aa, Artificial Sequence
  Protein shisa-5 (128-137)
AYMDAPKAAL

SEQ ID NO: 13750 - protein, 10 aa, Artificial Sequence
  La-related protein 4B (250-259)
AYNDNWFITF

SEQ ID NO: 13751 - protein, 10 aa, Artificial Sequence
  Phosphatidylinositol-binding clathrin assembly protein (210-219)
AYNEGIINLL

SEQ ID NO: 13752 - protein, 10 aa, Artificial Sequence
  Beta-hexosaminidase subunit alpha (194-203)
AYNKLNVFHW

SEQ ID NO: 13753 - protein, 9 aa, Artificial Sequence
  Cirhin (34-42)
AYNNQSNRL

SEQ ID NO: 13754 - protein, 9 aa, Artificial Sequence
  Cell adhesion molecule-related/down-regulated by oncogenes (193-201)
AYNPVTHQL

SEQ ID NO: 13755 - protein, 10 aa, Artificial Sequence
  Ubiquitin-associated protein 2-like (267-276)
AYPPAPFMHI

SEQ ID NO: 13756 - protein, 11 aa, Artificial Sequence
  Cathepsin D (202-212)
AYPRISVNNVL

SEQ ID NO: 13757 - protein, 9 aa, Artificial Sequence
  Ras GTPase-activating-like protein IQGAP1 (794-802)
AYQDRLAYL

SEQ ID NO: 13758 - protein, 9 aa, Artificial Sequence
  Ras GTPase-activating-like protein IQGAP3 (955-963)
AYQHLFYLL

SEQ ID NO: 13759 - protein, 9 aa, Artificial Sequence
  40S ribosomal protein S11 (9-17)
AYQKQPTIF

SEQ ID NO: 13760 - protein, 9 aa, Artificial Sequence
  UDP-glucose:glycoprotein glucosyltransferase 2 (114-122)
AYSPAIQMF

SEQ ID NO: 13761 - protein, 9 aa, Artificial Sequence
  Breast cancer anti-estrogen resistance protein 3 (211-219)
AYSRVQYQF

SEQ ID NO: 13762 - protein, 11 aa, Artificial Sequence
  Eukaryotic translation initiation factor 4 gamma 1 (168-178)
AYYPAQGVQQF

SEQ ID NO: 13763 - protein, 9 aa, Artificial Sequence
  Heterogeneous nuclear ribonucleoprotein L (387-395)
CLYGNVEKV

SEQ ID NO: 13764 - protein, 9 aa, Artificial Sequence
  Structural maintenance of chromosomes protein 4 (1136-1144)
DAALDFKNV

SEQ ID NO: 13765 - protein, 9 aa, Artificial Sequence
  Phosphoacetylglucosamine mutase (288-296)
DADGHFHLI

SEQ ID NO: 13766 - protein, 9 aa, Artificial Sequence
  Nuclear cap-binding protein subunit 2 (93-101)
DAENAMRYI

SEQ ID NO: 13767 - protein, 10 aa, Artificial Sequence
  Ras-related protein Rab-14 (163-172)
DAFLEAAKKI

SEQ ID NO: 13768 - protein, 9 aa, Artificial Sequence
  Rho-associated protein kinase 1 (187-195)
DAIHSMGFI

SEQ ID NO: 13769 - protein, 9 aa, Artificial Sequence
  Elongation factor 2 (348-356)
DALLQMITI

SEQ ID NO: 13770 - protein, 9 aa, Artificial Sequence
  SRR1-like protein (237-245)
DALSKMVII

SEQ ID NO: 13771 - protein, 9 aa, Artificial Sequence
  Carnitine O-palmitoyltransferase 1, liver isoform (477-485)
DAPIVAHLW

SEQ ID NO: 13772 - protein, 8 aa, Artificial Sequence
  ATP-binding cassette sub-family E member 1 (326-333)
DASLVFKV

SEQ ID NO: 13773 - protein, 10 aa, Artificial Sequence
  Glutamate receptor ionotropic, kainate 2 (325-334)
DAVHVVSVAV

SEQ ID NO: 13774 - protein, 9 aa, Artificial Sequence
  General transcription factor II-I repeat domain-containing protein 2B (818-826)
DGLNYIPKI

SEQ ID NO: 13775 - protein, 10 aa, Artificial Sequence
  HLA class I histocompatibility antigen, A-1 alpha chain (89-98)
DGSHTIQIMY

SEQ ID NO: 13776 - protein, 9 aa, Artificial Sequence
  Serine/threonine-protein kinase tousled-like 2 (313-321)
DGYAFQNLI

SEQ ID NO: 13777 - protein, 9 aa, Artificial Sequence
  Heterogeneous nuclear ribonucleoprotein L (411-419)
DGYAVDRAI

SEQ ID NO: 13778 - protein, 9 aa, Artificial Sequence
  T-complex protein 1 subunit epsilon (135-143)
DGYEQAARV

SEQ ID NO: 13779 - protein, 9 aa, Artificial Sequence
  Ribosomal protein S6 kinase alpha-1 (416-424)
DGYVVKETI

SEQ ID NO: 13780 - protein, 8 aa, Artificial Sequence
  DNA-directed RNA polymerase III subunit RPC3 (186-193)
DMYLVPKL

SEQ ID NO: 13781 - protein, 9 aa, Artificial Sequence
  Cyclic AMP-responsive element-binding protein 3-like protein 2 (54-62)
DPFLSEKSV

SEQ ID NO: 13782 - protein, 11 aa, Artificial Sequence
  Tubulin beta chain (39-49)
DSDLQLDRISV

SEQ ID NO: 13783 - protein, 11 aa, Artificial Sequence
  Zinc finger MYND domain-containing protein 11 (140-150)
DSEQADIARML

SEQ ID NO: 13784 - protein, 8 aa, Artificial Sequence
  Negative elongation factor C/D (323-330)
DTDISLIR

SEQ ID NO: 13785 - protein, 9 aa, Artificial Sequence
  Kinectin (454-462)
DYARLVNEL

SEQ ID NO: 13786 - protein, 9 aa, Artificial Sequence
  Enhancer of polycomb homolog 1 (423-431)
DYDSVFHHL

SEQ ID NO: 13787 - protein, 9 aa, Artificial Sequence
  Histone deacetylase 1 (71-79)
DYIKFLRSI

SEQ ID NO: 13788 - protein, 9 aa, Artificial Sequence
  Protein KIAA0100 (885-893)
DYPRYLFEI

SEQ ID NO: 13789 - protein, 9 aa, Artificial Sequence
  T-complex protein 1 subunit beta (509-517)
EAAEVILRV

SEQ ID NO: 13790 - protein, 9 aa, Artificial Sequence
  DNA-dependent protein kinase catalytic subunit (1728-1736)
EFPPGTPRF

SEQ ID NO: 13791 - protein, 11 aa, Artificial Sequence
  Nuclear protein 1 (26-36)
ESDLYSLAHSY

SEQ ID NO: 13792 - protein, 10 aa, Artificial Sequence
  General transcription factor II-I (242-251)
ESEDPDYYQY

SEQ ID NO: 13793 - protein, 13 aa, Artificial Sequence
  E3 ubiquitin-protein ligase HUWE1 (969-981)
ESEDYHFYQGLVY

SEQ ID NO: 13794 - protein, 9 aa, Artificial Sequence
  ATP-dependent RNA helicase DDX24 (571-579)
ETDEKDFYL

SEQ ID NO: 13795 - protein, 11 aa, Artificial Sequence
  Serrate RNA effector molecule homolog (86-96)
ETEAVKRYNDY

SEQ ID NO: 13796 - protein, 10 aa, Artificial Sequence
  Probable ATP-dependent RNA helicase DDX56 (239-248)
ETEEDKFLLL

SEQ ID NO: 13797 - protein, 10 aa, Artificial Sequence
  Complement C4-A (1516-1525)
ETEGPHVLLY

SEQ ID NO: 13798 - protein, 9 aa, Artificial Sequence
  Copine-1 (269-277)
ETEYSFLDY

SEQ ID NO: 13799 - protein, 9 aa, Artificial Sequence
  Melanoma-associated antigen 11 (252-260)
EVDPTSHSY

SEQ ID NO: 13800 - protein, 9 aa, Artificial Sequence
  General transcription factor 3C polypeptide 2 (329-337)
EWIPLAWKW

SEQ ID NO: 13801 - protein, 11 aa, Artificial Sequence
  Influenza virus NS1A-binding protein (632-642)
EWSPYTKIFQF

SEQ ID NO: 13802 - protein, 9 aa, Artificial Sequence
  Zinc finger protein 318 (408-416)
EYAKIHDLL

SEQ ID NO: 13803 - protein, 9 aa, Artificial Sequence
  CLIP-associating protein 1 (358-366)
EYDNFFQHL

SEQ ID NO: 13804 - protein, 9 aa, Artificial Sequence
  Pericentrin (3305-3313)
EYIHHLEVI

SEQ ID NO: 13805 - protein, 9 aa, Artificial Sequence
  Transcriptional regulator homolog RPD3 (72-80)
EYIKFLRSI

SEQ ID NO: 13806 - protein, 10 aa, Artificial Sequence
  Rab GTPase-activating protein 1 (632-641)
EYIPDLYNHF

SEQ ID NO: 13807 - protein, 9 aa, Artificial Sequence
  Gem-associated protein 4 (892-900)
EYIQFVPLL

SEQ ID NO: 13808 - protein, 9 aa, Artificial Sequence
  Inhibitor of growth protein 5 (48-56)
EYISTVKTL

SEQ ID NO: 13809 - protein, 9 aa, Artificial Sequence
  Inositol polyphosphate multikinase (290-298)
EYNNNFHVL

SEQ ID NO: 13810 - protein, 9 aa, Artificial Sequence
  Sorting nexin-18 (463-471)
EYQKVGQSF

SEQ ID NO: 13811 - protein, 9 aa, Artificial Sequence
  Poly (ADP-ribose) polymerase 12 (509-517)
EYQKVWNLF

SEQ ID NO: 13812 - protein, 9 aa, Artificial Sequence
  Poly (ADP-ribose) polymerase 4 (584-592)
EYRPEFSNF

SEQ ID NO: 13813 - protein, 9 aa, Artificial Sequence
  Ubiquitin-conjugating enzyme E2 K (161-169)
EYTKKIENL

SEQ ID NO: 13814 - protein, 9 aa, Artificial Sequence
  Leucine-rich repeats and immunoglobulin-like domains protein 2 (560-568)
EYTSILHLF

SEQ ID NO: 13815 - protein, 10 aa, Artificial Sequence
  HLA class I histocompatibility antigen, Cw-7 alpha chain (140-149)
FAYDGKDYIA

SEQ ID NO: 13816 - protein, 8 aa, Artificial Sequence
  60S ribosomal protein L3 (362-369)
FIDTTSKF

SEQ ID NO: 13817 - protein, 8 aa, Artificial Sequence
  Cysteine-rich protein 2-binding protein (155-162)
FIEKHWTF

SEQ ID NO: 13818 - protein, 9 aa, Artificial Sequence
  DNA replication licensing factor MCM5 (427-435)
FIMEGGAMV

SEQ ID NO: 13819 - protein, 9 aa, Artificial Sequence
  60S acidic ribosomal protein P0 (108-116)
FLADPSAFV

SEQ ID NO: 13820 - protein, 9 aa, Artificial Sequence
  Trifunctional enzyme subunit beta, mitochondrial (184-192)
FLAPELPAV

SEQ ID NO: 13821 - protein, 9 aa, Artificial Sequence
  Membrane-bound transcription factor site-2 protease (251-259)
FLDATLTSV

SEQ ID NO: 13822 - protein, 10 aa, Artificial Sequence
  Glucosylceramidase (172-181)
FLDAYAEHKL

SEQ ID NO: 13823 - protein, 9 aa, Artificial Sequence
  Neutral alpha-glucosidase AB (604-612)
FLDDGHTFN

SEQ ID NO: 13824 - protein, 10 aa, Artificial Sequence
  Cytoplasmic dynein 2 heavy chain 1 (42-51)
FLDDGNQMLL

SEQ ID NO: 13825 - protein, 9 aa, Artificial Sequence
  Thimet oligopeptidase (294-302)
FLDELAQKL

SEQ ID NO: 13826 - protein, 9 aa, Artificial Sequence
  Regulatory-associated protein of mTOR (240-248)
FLDLGPWAV

SEQ ID NO: 13827 - protein, 9 aa, Artificial Sequence
  Protein FAM83H (343-351)
FLDPDRHFL

SEQ ID NO: 13828 - protein, 10 aa, Artificial Sequence
  CAD protein (150-159)
FLDPNARPLV

SEQ ID NO: 13829 - protein, 9 aa, Artificial Sequence
  DDB1- and CUL4-associated factor 12 (303-311)
FLDPRQPSY

SEQ ID NO: 13830 - protein, 9 aa, Artificial Sequence
  Desmoplakin (1057-1065)
FLDQNLQKY

SEQ ID NO: 13831 - protein, 10 aa, Artificial Sequence
  Basic leucine zipper and W2 domain-containing protein 2 (51-60)
FLDSTGSRLD

SEQ ID NO: 13832 - protein, 9 aa, Artificial Sequence
  Exportin-1 (1034-1042)
FLEEREIAL

SEQ ID NO: 13833 - protein, 10 aa, Artificial Sequence
  Creatine kinase M-type (192-201)
FLFDKPVSPL

SEQ ID NO: 13834 - protein, 9 aa, Artificial Sequence
  Ras-related GTP-binding protein C (226-234)
FLFDVVSKI

SEQ ID NO: 13835 - protein, 11 aa, Artificial Sequence
  Nestin (43-53)
FLFPGTENQEL

SEQ ID NO: 13836 - protein, 11 aa, Artificial Sequence
  Unconventional myosin-Ib (362-372)
FLFSSDHLIEM

SEQ ID NO: 13837 - protein, 11 aa, Artificial Sequence
  Glycogen phosphorylase, liver form (525-535)
FLGDDVFLREL

SEQ ID NO: 13838 - protein, 9 aa, Artificial Sequence
  Lysosomal alpha-glucosidase (139-147)
FLGPEPKSV

SEQ ID NO: 13839 - protein, 9 aa, Artificial Sequence
  Sterol regulatory element-binding protein 1 (1036-1044)
FLHEATARL

SEQ ID NO: 13840 - protein, 9 aa, Artificial Sequence
  DNA-dependent protein kinase catalytic subunit (319-327)
FLKQVSNMV

SEQ ID NO: 13841 - protein, 9 aa, Artificial Sequence
  ADP-ribosylation factor-binding protein GGA1 (90-98)
FLNELIKVV

SEQ ID NO: 13842 - protein, 9 aa, Artificial Sequence
  CDK5 regulatory subunit-associated protein 2 (1316-1324)
FLNGKSVGV

SEQ ID NO: 13843 - protein, 9 aa, Artificial Sequence
  Nestin (377-385)
FLQARTPTL

SEQ ID NO: 13844 - protein, 9 aa, Artificial Sequence
  Plectin (2481-2489)
FLSEKDSLL

SEQ ID NO: 13845 - protein, 9 aa, Artificial Sequence
  Hemoglobin subunit alpha (5-13)
FLSFPTTKT

SEQ ID NO: 13846 - protein, 9 aa, Artificial Sequence
  DDRGK domain-containing protein 1 (215-223)
FLTEFINYI

SEQ ID NO: 13847 - protein, 9 aa, Artificial Sequence
  Elongation factor 1-gamma (69-77)
FLVGERVTL

SEQ ID NO: 13848 - protein, 12 aa, Artificial Sequence
  Laminin subunit alpha-1 (2178-2189)
FLWDLGSGSTRL

SEQ ID NO: 13849 - protein, 9 aa, Artificial Sequence
  Upstream stimulatory factor 1 (42-50)
FPDPNVKYV

SEQ ID NO: 13850 - protein, 9 aa, Artificial Sequence
  Deubiquitinating protein VCIP135 (505-513)
FPHLPGKTF

SEQ ID NO: 13851 - protein, 9 aa, Artificial Sequence
  Putative helicase MOV-10 (232-240)
FPIDHFTHI

SEQ ID NO: 13852 - protein, 9 aa, Artificial Sequence
  NEDD4 family-interacting protein 1 (61-69)
FPKPPSYNV

SEQ ID NO: 13853 - protein, 9 aa, Artificial Sequence
  Vacuolar fusion protein CCZ1 homolog (254-262)
FPRHIEPEL

SEQ ID NO: 13854 - protein, 8 aa, Artificial Sequence
  Retinoblastoma-binding protein 5 (81-88)
FPSPILKV

SEQ ID NO: 13855 - protein, 9 aa, Artificial Sequence
  DNA polymerase alpha catalytic subunit (594-602)
FPYAFKEVI

SEQ ID NO: 13856 - protein, 8 aa, Artificial Sequence
  HEAT repeat-containing protein 1 (243-250)
FPYIQKGL

SEQ ID NO: 13857 - protein, 9 aa, Artificial Sequence
  Reticulocalbin-3 (52-60)
FQYDHEAFL

SEQ ID NO: 13858 - protein, 10 aa, Artificial Sequence
  Short transient receptor potential channel 4-associated protein (457-466)
FSDHHENKYL

SEQ ID NO: 13859 - protein, 9 aa, Artificial Sequence
  Phosphoinositide 3-kinase regulatory subunit 4 (20-28)
FSDIHDFEY

SEQ ID NO: 13860 - protein, 9 aa, Artificial Sequence
  Serine/threonine-protein kinase N2 (754-762)
FSEPRAVFY

SEQ ID NO: 13861 - protein, 11 aa, Artificial Sequence
  Low-density lipoprotein receptor-related protein 4 (36-46)
FTDPGMGNLTY

SEQ ID NO: 13862 - protein, 9 aa, Artificial Sequence
  PR domain zinc finger protein 10 (81-89)
FTDPGQVAY

SEQ ID NO: 13863 - protein, 9 aa, Artificial Sequence
  Unconventional myosin-Ib (229-237)
FTDQQKLIY

SEQ ID NO: 13864 - protein, 11 aa, Artificial Sequence
  Glutathione S-transferase Mu 3 (27-37)
FTDTSYEEKRY

SEQ ID NO: 13865 - protein, 9 aa, Artificial Sequence
  Ribosomal protein S6 kinase alpha-5 (149-157)
FTEHEVQIY

SEQ ID NO: 13866 - protein, 10 aa, Artificial Sequence
  Unconventional myosin-Ib (526-535)
FVDKNNDLLY

SEQ ID NO: 13867 - protein, 9 aa, Artificial Sequence
  Heat shock 70 kDa protein 4 (200-208)
FVDMGHSAY

SEQ ID NO: 13868 - protein, 9 aa, Artificial Sequence
  Talin-1 (1850-1858)
FVDYQTTMV

SEQ ID NO: 13869 - protein, 11 aa, Artificial Sequence
  Trafficking protein particle complex subunit 3 (115-125)
FVELPDNHSSL

SEQ ID NO: 13870 - protein, 9 aa, Artificial Sequence
  Serine/threonine-protein kinase Nek6 (272-280)
FYGDKMNLF

SEQ ID NO: 13871 - protein, 9 aa, Artificial Sequence
  Myotubularin-related protein 5 (454-462)
FYGDVQTHI

SEQ ID NO: 13872 - protein, 9 aa, Artificial Sequence
  Protein CLEC16A (161-169)
FYNEHTNDF

SEQ ID NO: 13873 - protein, 9 aa, Artificial Sequence
  Fanconi anemia group I protein (922-930)
FYQPKIQQF

SEQ ID NO: 13874 - protein, 10 aa, Artificial Sequence
  Heat shock 70 kDa protein 1-like (295-304)
FYTSITRARF

SEQ ID NO: 13875 - protein, 9 aa, Artificial Sequence
  Little elongation complex subunit 2 (213-221)
FYVGHIDAF

SEQ ID NO: 13876 - protein, 9 aa, Artificial Sequence
  E3 ubiquitin-protein ligase MARCH6 (231-239)
GLDGSLVFL

SEQ ID NO: 13877 - protein, 9 aa, Artificial Sequence
  Malate dehydrogenase, mitochondrial (144-152)
GLDPARVNV

SEQ ID NO: 13878 - protein, 9 aa, Artificial Sequence
  Asparagine synthetase (glutamine-hydrolyzing) (177-185)
GLDSSLVAA

SEQ ID NO: 13879 - protein, 11 aa, Artificial Sequence
  DNA damage-binding protein 1 (996-1006)
GLFHLGEFVNV

SEQ ID NO: 13880 - protein, 10 aa, Artificial Sequence
  Importin-9 (119-128)
GLHETQPPSV

SEQ ID NO: 13881 - protein, 9 aa, Artificial Sequence
  HEAT repeat-containing protein 5A (449-457)
GLLDSILSV

SEQ ID NO: 13882 - protein, 9 aa, Artificial Sequence
  HEAT repeat-containing protein 5B (445-453)
GLLEIVTSV

SEQ ID NO: 13883 - protein, 10 aa, Artificial Sequence
  Zinc transporter SLC39A7 (454-463)
GLLGGVIMMV

SEQ ID NO: 13884 - protein, 11 aa, Artificial Sequence
  Protein SON (535-545)
GLLGQPEATMV

SEQ ID NO: 13885 - protein, 9 aa, Artificial Sequence
  Nestin (273-281)
GLQSQIAQV

SEQ ID NO: 13886 - protein, 9 aa, Artificial Sequence
  Armadillo repeat containing 8, isoform CRA_g (325-333)
GLSESSVKV

SEQ ID NO: 13887 - protein, 9 aa, Artificial Sequence
  Eukaryotic translation initiation factor 3 subunit F (252-260)
GLSSDLQQV

SEQ ID NO: 13888 - protein, 9 aa, Artificial Sequence
  Bifunctional glutamate/proline-tRNA ligase (1274-1282)
GLTTRTIGV

SEQ ID NO: 13889 - protein, 9 aa, Artificial Sequence
  Glyceraldehyde-3-phosphate dehydrogenase (230-238)
GMAFRVPTA

SEQ ID NO: 13890 - protein, 9 aa, Artificial Sequence
  WD repeat-containing protein 19 (311-319)
GPDELRPML

SEQ ID NO: 13891 - protein, 9 aa, Artificial Sequence
  Uncharacterized protein KIAA0355 (842-850)
GSDPEFARY

SEQ ID NO: 13892 - protein, 9 aa, Artificial Sequence
  Extended synaptotagmin-2 (388-396)
GSDPYVRMY

SEQ ID NO: 13893 - protein, 12 aa, Artificial Sequence
  YY1-associated protein 1 (203-214)
GTEFLNPLISKY

SEQ ID NO: 13894 - protein, 11 aa, Artificial Sequence
  Clustered mitochondria protein homolog (777-787)
GTEHPNTIQEY

SEQ ID NO: 13895 - protein, 11 aa, Artificial Sequence
  Nucleolin (451-461)
GTEIDGRSISL

SEQ ID NO: 13896 - protein, 9 aa, Artificial Sequence
  DNA-dependent protein kinase catalytic subunit (1480-1488)
GTELLSLVY

SEQ ID NO: 13897 - protein, 9 aa, Artificial Sequence
  Pecanex-like protein 3 (789-797)
GVLENIFGV

SEQ ID NO: 13898 - protein, 11 aa, Artificial Sequence
  Ubiquitin-like protein 7 (158-168)
GVLQDKDLFSV

SEQ ID NO: 13899 - protein, 9 aa, Artificial Sequence
  Polypyrimidine tract-binding protein 2 (308-316)
GVYGDVQRV

SEQ ID NO: 13900 - protein, 11 aa, Artificial Sequence
  Caseinolytic peptidase B protein homolog (337-347)
GWYDEEHPLVF

SEQ ID NO: 13901 - protein, 9 aa, Artificial Sequence
  Signal recognition particle subunit SRP68 (586-594)
GYIKGIFGF

SEQ ID NO: 13902 - protein, 9 aa, Artificial Sequence
  Hypoxanthine-guanine phosphoribosyltransferase (173-181)
GYKPDFVGF

SEQ ID NO: 13903 - protein, 9 aa, Artificial Sequence
  GMP reductase 2 (151-159)
GYSEHFVEF

SEQ ID NO: 13904 - protein, 9 aa, Artificial Sequence
  Lysine-specific histone demethylase 1B (77-85)
GYTSRWYHL

SEQ ID NO: 13905 - protein, 10 aa, Artificial Sequence
  ATP-binding cassette sub-family E member 1 (315-324)
GYVPTENLRF

SEQ ID NO: 13906 - protein, 9 aa, Artificial Sequence
  Ankyrin repeat domain-containing protein 17 (2149-2157)
HAFWGGSVV

SEQ ID NO: 13907 - protein, 9 aa, Artificial Sequence
  CCR4-NOT transcription complex subunit 1 (1619-1627)
HAIPPTLAM

SEQ ID NO: 13908 - protein, 9 aa, Artificial Sequence
  Syntaxin-binding protein 1 (295-303)
HIAEVSQEV

SEQ ID NO: 13909 - protein, 9 aa, Artificial Sequence
  Dolichyl-diphosphooligosaccharide-proteinosyltransferase subunit 1 (45-53)
HLAKVTAEV

SEQ ID NO: 13910 - protein, 9 aa, Artificial Sequence
  ATP-binding cassette sub-family F member 1 (520-528)
HLDAQRLHY

SEQ ID NO: 13911 - protein, 9 aa, Artificial Sequence
  T-complex protein 1 subunit epsilon (147-155)
HLDKISDSV

SEQ ID NO: 13912 - protein, 10 aa, Artificial Sequence
  Pre-mRNA-processing-splicing factor 8 (1875-1884)
HLLDFPNIVI

SEQ ID NO: 13913 - protein, 9 aa, Artificial Sequence
  Polypyrimidine tract-binding protein 3 (383-391)
HLSNIPPSV

SEQ ID NO: 13914 - protein, 9 aa, Artificial Sequence
  Integrator complex subunit 4 (10-18)
HLTDTSHGV

SEQ ID NO: 13915 - protein, 9 aa, Artificial Sequence
  Clathrin heavy chain 1 (1356-1364)
HLWAELVFL

SEQ ID NO: 13916 - protein, 12 aa, Artificial Sequence
  LanC-like protein 1 (74-85)
HLYDVFGDPAYL

SEQ ID NO: 13917 - protein, 9 aa, Artificial Sequence
  U3 small nucleolar RNA-associated protein 6 homolog (267-275)
HTDDPLTWD

SEQ ID NO: 13918 - protein, 9 aa, Artificial Sequence
  Ras GTPase-activating-like protein IQGAP3 (1072-1080)
HTDPVHLYK

SEQ ID NO: 13919 - protein, 10 aa, Artificial Sequence
  Receptor-type tyrosine-protein phosphatase F (1334-1343)
HTEVPARNLY

SEQ ID NO: 13920 - protein, 9 aa, Artificial Sequence
  Non-specific lipid-transfer protein (143-151)
HVDLLINKY

SEQ ID NO: 13921 - protein, 9 aa, Artificial Sequence
  Rhophilin-2 (351-359)
HYAALAHYF

SEQ ID NO: 13922 - protein, 9 aa, Artificial Sequence
  Heat shock protein 105 kDa (739-747)
HYAKIAADF

SEQ ID NO: 13923 - protein, 10 aa, Artificial Sequence
  Eukaryotic translation initiation factor 3 subunit I (312-321)
HYFDPQYFEF

SEQ ID NO: 13924 - protein, 10 aa, Artificial Sequence
  General transcription factor 3C polypeptide 2 (687-696)
HYIDAGYLGF

SEQ ID NO: 13925 - protein, 9 aa, Artificial Sequence
  Centrosomal protein of 192 kDa (2495-2503)
HYINMPVQF

SEQ ID NO: 13926 - protein, 9 aa, Artificial Sequence
  Tubulin gamma-1 chain (59-67)
HYIPRAVLL

SEQ ID NO: 13927 - protein, 9 aa, Artificial Sequence
  Structural maintenance of chromosomes protein 4 (1123-1131)
HYKPTPLYF

SEQ ID NO: 13928 - protein, 9 aa, Artificial Sequence
  Rho GTPase-activating protein 5 (207-215)
HYLREVQAF

SEQ ID NO: 13929 - protein, 10 aa, Artificial Sequence
  E3 ubiquitin-protein ligase Arkadia (644-653)
HYMPPPYASL

SEQ ID NO: 13930 - protein, 11 aa, Artificial Sequence
  Rho-related BTB domain-containing protein 3 (239-249)
HYNSDLNNLLF

SEQ ID NO: 13931 - protein, 9 aa, Artificial Sequence
  DNA mismatch repair protein Msh6 (458-466)
HYPPVQVLF

SEQ ID NO: 13932 - protein, 9 aa, Artificial Sequence
  Dedicator of cytokinesis protein 5 (968-976)
HYSHYISTF

SEQ ID NO: 13933 - protein, 9 aa, Artificial Sequence
  Dynein heavy chain 14, axonemal (48-56)
IAEKETLEY

SEQ ID NO: 13934 - protein, 9 aa, Artificial Sequence
  Inositol 1,4,5-trisphosphate receptor type 1 (2578-2586)
IFGVIIDTF

SEQ ID NO: 13935 - protein, 9 aa, Artificial Sequence
  U5 small nuclear ribonucleoprotein 40 kDa protein (217-225)
IFQGNVHNF

SEQ ID NO: 13936 - protein, 9 aa, Artificial Sequence
  Progesterone-induced-blocking factor 1 (734-742)
IFTPKPTLF

SEQ ID NO: 13937 - protein, 9 aa, Artificial Sequence
  Phosphoserine aminotransferase (281-289)
IIDNSQGFY

SEQ ID NO: 13938 - protein, 10 aa, Artificial Sequence
  Vesicle-associated membrane protein-associated protein A (60-69)
IIDPGSTVTV

SEQ ID NO: 13939 - protein, 9 aa, Artificial Sequence
  T-complex protein 1 subunit gamma (100-108)
ILAGEMLSV

SEQ ID NO: 13940 - protein, 12 aa, Artificial Sequence
  Adenosylhomocysteinase 2 (196-207)
ILDDGGDLTHWV

SEQ ID NO: 13941 - protein, 9 aa, Artificial Sequence
  Disabled homolog 2 (198-206)
ILDDQTNKL

SEQ ID NO: 13942 - protein, 9 aa, Artificial Sequence
  Switch-associated protein 70 (208-216)
ILDVLKQGY

SEQ ID NO: 13943 - protein, 9 aa, Artificial Sequence
  Protein SCAF8 (864-872)
ILGGQPPNV

SEQ ID NO: 13944 - protein, 9 aa, Artificial Sequence
  Prolow-density lipoprotein receptor-related protein 1 (596-604)
ILKDGIHNV

SEQ ID NO: 13945 - protein, 9 aa, Artificial Sequence
  Nucleoprotein TPR (616-624)
ILLSQTTGV

SEQ ID NO: 13946 - protein, 10 aa, Artificial Sequence
  Noelin (14-23)
ILMGTELTQV

SEQ ID NO: 13947 - protein, 10 aa, Artificial Sequence
  ATP-citrate synthase (1022-1031)
ILNVDGLIGV

SEQ ID NO: 13948 - protein, 10 aa, Artificial Sequence
  D-3-phosphoglycerate dehydrogenase (22-31)
ILQDGGLQVV

SEQ ID NO: 13949 - protein, 9 aa, Artificial Sequence
  Poly (ADP-ribose) polymerase 1 (477-485)
ILSPWGAEV

SEQ ID NO: 13950 - protein, 11 aa, Artificial Sequence
  Heat shock-related 70 kDa protein 2 (212-222)
ILTIEDGIFEV

SEQ ID NO: 13951 - protein, 11 aa, Artificial Sequence
  Proteasome subunit alpha type-2 (46-56)
ILYDERSVHKV

SEQ ID NO: 13952 - protein, 10 aa, Artificial Sequence
  Elongation factor 2 (203-212)
IMIDPVLGTV

SEQ ID NO: 13953 - protein, 9 aa, Artificial Sequence
  Gem-associated protein 4 (471-479)
IPESQIRQV

SEQ ID NO: 13954 - protein, 9 aa, Artificial Sequence
  Serine/threonine-protein kinase 24 (212-220)
IPKNNPPTL

SEQ ID NO: 13955 - protein, 9 aa, Artificial Sequence
  Cathepsin D (24-32)
IPLHKFTSI

SEQ ID NO: 13956 - protein, 8 aa, Artificial Sequence
  ATP-binding cassette sub-family F member 2 (391-398)
IPPPVIMV

SEQ ID NO: 13957 - protein, 9 aa, Artificial Sequence
  Serine protease HTRA1 (3-11)
IPRAALLPL

SEQ ID NO: 13958 - protein, 10 aa, Artificial Sequence
  Serine protease HTRA1 (3-12)
IPRAALLPLL

SEQ ID NO: 13959 - protein, 8 aa, Artificial Sequence
  Lysine-specific demethylase 5D (1030-1037)
IPVHLPNI

SEQ ID NO: 13960 - protein, 8 aa, Artificial Sequence
  Pre-mRNA-processing-splicing factor 8 (724-731)
IPWKVPGL

SEQ ID NO: 13961 - protein, 8 aa, Artificial Sequence
  Serine-tRNA ligase, cytoplasmic (357-364)
IPYHIVNI

SEQ ID NO: 13962 - protein, 8 aa, Artificial Sequence
  T-complex protein 1 subunit gamma (296-303)
ISDLAQHY

SEQ ID NO: 13963 - protein, 9 aa, Artificial Sequence
  39S ribosomal protein L12, mitochondrial (79-87)
ISDLNELLK

SEQ ID NO: 13964 - protein, 9 aa, Artificial Sequence
  Junction plakoglobin (651-659)
ISEDKNPDY

SEQ ID NO: 13965 - protein, 10 aa, Artificial Sequence
  ATP-citrate synthase (6-15)
ISEQTGKELL

SEQ ID NO: 13966 - protein, 10 aa, Artificial Sequence
  Peptidyl-prolyl cis-trans isomerase FKBP9 (274-283)
ISQSGDFLRY

SEQ ID NO: 13967 - protein, 8 aa, Artificial Sequence
  Staphylococcal nuclease domain-containing protein 1 (665-672)
ITDDLHFY

SEQ ID NO: 13968 - protein, 9 aa, Artificial Sequence
  E3 ubiquitin-protein ligase TRIM21 (423-431)
ITDHGSLIY

SEQ ID NO: 13969 - protein, 11 aa, Artificial Sequence
  5-oxoprolinase (1145-1155)
ITDPEILESRY

SEQ ID NO: 13970 - protein, 10 aa, Artificial Sequence
  Wee1-like protein kinase (72-81)
ITESNMKSRY

SEQ ID NO: 13971 - protein, 9 aa, Artificial Sequence
  Interleukin enhancer-binding factor 2 (89-97)
IVAPGTFEV

SEQ ID NO: 13972 - protein, 9 aa, Artificial Sequence
  Pre-mRNA-processing-splicing factor 8 (1000-1008)
IVDHNIADY

SEQ ID NO: 13973 - protein, 9 aa, Artificial Sequence
  EKC/KEOPS complex subunit TPRKB (48-56)
IVDPFQILV

SEQ ID NO: 13974 - protein, 10 aa, Artificial Sequence
  Hydroxyacylglutathione hydrolase, mitochondrial (27-36)
IVDPVQPQKV

SEQ ID NO: 13975 - protein, 13 aa, Artificial Sequence
  POTE ankyrin domain family member F (851-863)
IVMDSGDGVTHTV

SEQ ID NO: 13976 - protein, 10 aa, Artificial Sequence
  Beta-secretase 2 (263-272)
IWYTPIKEEW

SEQ ID NO: 13977 - protein, 9 aa, Artificial Sequence
  Solute carrier family 12 member 4 (260-268)
IYAGGIKSI

SEQ ID NO: 13978 - protein, 11 aa, Artificial Sequence
  1-phosphatidylinositol 4,5-bisphosphate phosphodiesterase gamma-2 (1124-1134)
IYDPNLAFLRF

SEQ ID NO: 13979 - protein, 10 aa, Artificial Sequence
  Cullin-4B (579-588)
IYGKDVFEAF

SEQ ID NO: 13980 - protein, 9 aa, Artificial Sequence
  ATP-dependent zinc metalloprotease YME1L1 (305-313)
IYGLLKNPF

SEQ ID NO: 13981 - protein, 9 aa, Artificial Sequence
  Protein transport protein Sec31A (147-155)
IYIWDLNNF

SEQ ID NO: 13982 - protein, 9 aa, Artificial Sequence
  USP6 N-terminal-like protein (97-105)
IYKGIPLQL

SEQ ID NO: 13983 - protein, 9 aa, Artificial Sequence
  Plectin (1069-1077)
IYLEKLKTI

SEQ ID NO: 13984 - protein, 9 aa, Artificial Sequence
  Tumor susceptibility gene 101 protein (109-117)
IYLPYLHEW

SEQ ID NO: 13985 - protein, 9 aa, Artificial Sequence
  Ubiquitin-conjugating enzyme E2 variant 3 (109-117)
IYLPYLQNW

SEQ ID NO: 13986 - protein, 9 aa, Artificial Sequence
  Collagen alpha-1(XV) chain (1157-1165)
IYLRDSTEF

SEQ ID NO: 13987 - protein, 9 aa, Artificial Sequence
  Disks large homolog 1 (868-876)
IYNQVKQII

SEQ ID NO: 13988 - protein, 11 aa, Artificial Sequence
  Nuclear fragile X mental retardation-interacting protein 2 (473-483)
IYPSNMQTMLL

SEQ ID NO: 13989 - protein, 10 aa, Artificial Sequence
  Pre-mRNA-processing-splicing factor 8 (1694-1703)
IYPSPTGVLI

SEQ ID NO: 13990 - protein, 10 aa, Artificial Sequence
  5'-3' exoribonuclease 1 (610-619)
IYPSPWPEKF

SEQ ID NO: 13991 - protein, 9 aa, Artificial Sequence
  Protein unc-119 homolog B (91-99)
IYSIDFTRF

SEQ ID NO: 13992 - protein, 8 aa, Artificial Sequence
  Serine-protein kinase ATM (121-128)
IYTLIHYI

SEQ ID NO: 13993 - protein, 9 aa, Artificial Sequence
  Exocyst complex component 6B (648-656)
IYTNLNQKI

SEQ ID NO: 13994 - protein, 9 aa, Artificial Sequence
  Aminoacylase-1 (390-398)
IYTRLLPAL

SEQ ID NO: 13995 - protein, 9 aa, Artificial Sequence
  Kelch domain-containing protein 7B (353-361)
IYVTGGHLF

SEQ ID NO: 13996 - protein, 10 aa, Artificial Sequence
  RNA polymerase I-specific transcription initiation factor RRN3 (572-581)
KFIDPIYQVW

SEQ ID NO: 13997 - protein, 10 aa, Artificial Sequence
  Ubiquitin carboxyl-terminal hydrolase 8 (551-560)
KFLDPITGTF

SEQ ID NO: 13998 - protein, 9 aa, Artificial Sequence
  pre-rRNA processing protein FTSJ3 (64-72)
KFMPVSSLI

SEQ ID NO: 13999 - protein, 9 aa, Artificial Sequence
  M-phase inducer phosphatase 2 (349-357)
KFSNIVDKF

SEQ ID NO: 14000 - protein, 9 aa, Artificial Sequence
  Mitotic checkpoint protein BUB3 (21-29)
KFSPNTSQF

SEQ ID NO: 14001 - protein, 9 aa, Artificial Sequence
  Protein SCAF11 (1039-1047)
KLAESKVSV

SEQ ID NO: 14002 - protein, 9 aa, Artificial Sequence
  Neuroblast differentiation-associated protein AHNAK (2352-2360)
KLDADMPEV

SEQ ID NO: 14003 - protein, 9 aa, Artificial Sequence
  Ryanodine receptor 1 (3709-3717)
KLDEDYLYM

SEQ ID NO: 14004 - protein, 10 aa, Artificial Sequence
  Nucleobindin-1 (98-107)
KLDELKRQEV

SEQ ID NO: 14005 - protein, 9 aa, Artificial Sequence
  Spectrin alpha chain, non-erythrocytic 1 (201-209)
KLDENSAFL

SEQ ID NO: 14006 - protein, 9 aa, Artificial Sequence
  Striatin-3 (767-775)
KLDESIYDV

SEQ ID NO: 14007 - protein, 9 aa, Artificial Sequence
  DNA topoisomerase 2-alpha (278-286)
KLDETGNSL

SEQ ID NO: 14008 - protein, 9 aa, Artificial Sequence
  Eukaryotic initiation factor 4A-III (152-160)
KLDYGQHVV

SEQ ID NO: 14009 - protein, 9 aa, Artificial Sequence
  HEAT repeat-containing protein 2 (624-632)
KLFSILSTV

SEQ ID NO: 14010 - protein, 9 aa, Artificial Sequence
  Helicase-like transcription factor (170-178)
KLGPAPKTL

SEQ ID NO: 14011 - protein, 9 aa, Artificial Sequence
  Serine/threonine-protein kinase ULK4 (46-54)
KLIPLIFEV

SEQ ID NO: 14012 - protein, 11 aa, Artificial Sequence
  GTP-binding protein Rheb (102-112)
KLLDMVGKVQI

SEQ ID NO: 14013 - protein, 9 aa, Artificial Sequence
  Probable E3 ubiquitin-protein ligase HERC3 (474-482)
KLLEKLYKV

SEQ ID NO: 14014 - protein, 10 aa, Artificial Sequence
  Dedicator of cytokinesis protein 1 (386-395)
KLLPGDIHQI

SEQ ID NO: 14015 - protein, 9 aa, Artificial Sequence
  Adenosylhomocysteinase 2 (47-55)
KLNEVIRQV

SEQ ID NO: 14016 - protein, 9 aa, Artificial Sequence
  V-type proton ATPase catalytic subunit A (220-228)
KLPANHPLL

SEQ ID NO: 14017 - protein, 9 aa, Artificial Sequence
  Proline-rich protein 11 (128-136)
KLQEALKTI

SEQ ID NO: 14018 - protein, 9 aa, Artificial Sequence
  Serine/threonine-protein kinase MRCK alpha (461-469)
KLQESTQTV

SEQ ID NO: 14019 - protein, 10 aa, Artificial Sequence
  Integrin alpha-V (338-347)
KLQEVGQVSV

SEQ ID NO: 14020 - protein, 11 aa, Artificial Sequence
  78 kDa glucose-regulated protein (2-12)
KLSLVAAMLLL

SEQ ID NO: 14021 - protein, 9 aa, Artificial Sequence
  Serum albumin (257-265)
KLVTDLTKV

SEQ ID NO: 14022 - protein, 9 aa, Artificial Sequence
  Zinc finger and BTB domain-containing protein 38 (661-669)
KMDLDNNFY

SEQ ID NO: 14023 - protein, 9 aa, Artificial Sequence
  Sister chromatid cohesion protein PDS5 homolog B (1060-1068)
KMNEKLYTV

SEQ ID NO: 14024 - protein, 9 aa, Artificial Sequence
  Nucleophosmin (250-258)
KMQASIEKA

SEQ ID NO: 14025 - protein, 12 aa, Artificial Sequence
  Breast cancer anti-estrogen resistance protein 1 (335-346)
KPFDPARTPLVL

SEQ ID NO: 14026 - protein, 9 aa, Artificial Sequence
  Poly (ADP-ribose) polymerase 1 (388-396)
KPLSNMKIL

SEQ ID NO: 14027 - protein, 9 aa, Artificial Sequence
  Vitamin K-dependent protein S (29-37)
KQQASQVLV

SEQ ID NO: 14028 - protein, 9 aa, Artificial Sequence
  POZ-, AT hook-, and zinc finger-containing protein 1 (157-165)
KQSNVQILV

SEQ ID NO: 14029 - protein, 9 aa, Artificial Sequence
  Probable global transcription activator SNF2L1 (37-45)
KQTELFAHF

SEQ ID NO: 14030 - protein, 9 aa, Artificial Sequence
  Probable ATP-dependent RNA helicase DDX5 (451-459)
KQVSDLISV

SEQ ID NO: 14031 - protein, 12 aa, Artificial Sequence
  Myosin-10 (296-307)
KSDLLLEGFNNY

SEQ ID NO: 14032 - protein, 9 aa, Artificial Sequence
  Importin-11 (549-557)
KSDLRPMLY

SEQ ID NO: 14033 - protein, 10 aa, Artificial Sequence
  Hepatocyte growth factor receptor (32-41)
KSEMNVNMKY

SEQ ID NO: 14034 - protein, 9 aa, Artificial Sequence
  Leucine-rich repeat-containing protein 42 (68-76)
KTDHFIFTY

SEQ ID NO: 14035 - protein, 11 aa, Artificial Sequence
  AMP deaminase 2 (106-116)
KTDSDSDLQLY

SEQ ID NO: 14036 - protein, 9 aa, Artificial Sequence
  pre-rRNA processing protein FTSJ3 (466-474)
KTEIMSPLY

SEQ ID NO: 14037 - protein, 9 aa, Artificial Sequence
  Fanconi anemia group I protein (402-410)
KTIETSPSL

SEQ ID NO: 14038 - protein, 13 aa, Artificial Sequence
  Tubulin alpha-1C chain (5-17)
KTIGGGDDSFNTF

SEQ ID NO: 14039 - protein, 12 aa, Artificial Sequence
  Calnexin (227-238)
KTYFTDKKTHLY

SEQ ID NO: 14040 - protein, 9 aa, Artificial Sequence
  General transcription factor 3C polypeptide 1 (135-143)
KVDAGKLHY

SEQ ID NO: 14041 - protein, 11 aa, Artificial Sequence
  Protein phosphatase Slingshot homolog 3 (281-291)
KVLDVSDLESV

SEQ ID NO: 14042 - protein, 9 aa, Artificial Sequence
  HEAT repeat-containing protein 5A (1475-1483)
KVLETLVTV

SEQ ID NO: 14043 - protein, 10 aa, Artificial Sequence
  DNA-directed RNA polymerase II subunit RPB3 (175-184)
KWNPTAGVAF

SEQ ID NO: 14044 - protein, 9 aa, Artificial Sequence
  UDP-glucose:glycoprotein glucosyltransferase 2 (42-50)
KWPETPLLL

SEQ ID NO: 14045 - protein, 9 aa, Artificial Sequence
  Serine/threonine-protein kinase PLK3 (427-435)
KWVDYSNKF

SEQ ID NO: 14046 - protein, 9 aa, Artificial Sequence
  Integrin alpha-V (188-196)
KYDPNVYSI

SEQ ID NO: 14047 - protein, 9 aa, Artificial Sequence
  Kinesin-like protein KIF7 (588-596)
KYFDKVVTL

SEQ ID NO: 14048 - protein, 9 aa, Artificial Sequence
  Putative deoxyribonuclease TATDN1 (130-138)
KYFEKQFEL

SEQ ID NO: 14049 - protein, 11 aa, Artificial Sequence
  BTB/POZ domain-containing protein 3 (484-494)
KYFSDGSSNTF

SEQ ID NO: 14050 - protein, 9 aa, Artificial Sequence
  Ras GTPase-activating-like protein IQGAP1 (191-199)
KYGIQMPAF

SEQ ID NO: 14051 - protein, 9 aa, Artificial Sequence
  General transcription factor IIF subunit 1 (83-91)
KYGIVLKEF

SEQ ID NO: 14052 - protein, 8 aa, Artificial Sequence
  Protein SOGA1 (415-422)
KYGIVQEF

SEQ ID NO: 14053 - protein, 9 aa, Artificial Sequence
  Tyrosine-protein phosphatase non-receptor type 13 (1101-1109)
KYGLGFQII

SEQ ID NO: 14054 - protein, 9 aa, Artificial Sequence
  Serine/threonine-protein kinase Kist (248-256)
KYGPVVSLL

SEQ ID NO: 14055 - protein, 8 aa, Artificial Sequence
  Serine/threonine-protein phosphatase 4 catalytic subunit (133-140)
KYGSVTVW

SEQ ID NO: 14056 - protein, 9 aa, Artificial Sequence
  Magnesium transporter protein 1 (356-364)
KYHGYPYSF

SEQ ID NO: 14057 - protein, 9 aa, Artificial Sequence
  Protein cramped-like (21-29)
KYIDFDHVF

SEQ ID NO: 14058 - protein, 9 aa, Artificial Sequence
  Ataxin-2-like protein (371-379)
KYIPLPQRV

SEQ ID NO: 14059 - protein, 10 aa, Artificial Sequence
  Programmed cell death protein 6 (90-99)
KYITDWQNVF

SEQ ID NO: 14060 - protein, 9 aa, Artificial Sequence
  Elongation of very long chain fatty acids protein 5 (200-208)
KYITQGQLL

SEQ ID NO: 14061 - protein, 9 aa, Artificial Sequence
  Muscleblind-like protein 3 (18-26)
KYLHPPPHL

SEQ ID NO: 14062 - protein, 9 aa, Artificial Sequence
  Muscleblind-like protein 2 (67-75)
KYLHPPTHL

SEQ ID NO: 14063 - protein, 9 aa, Artificial Sequence
  Nesprin-2 (895-903)
KYLKAVEEL

SEQ ID NO: 14064 - protein, 9 aa, Artificial Sequence
  Presenilin-1 (239-247)
KYLPEWTAW

SEQ ID NO: 14065 - protein, 10 aa, Artificial Sequence
  ATP-dependent RNA helicase DDX24 (720-729)
KYMDVVKERI

SEQ ID NO: 14066 - protein, 10 aa, Artificial Sequence
  Protein polybromo-1 (653-662)
KYMTPMQQKL

SEQ ID NO: 14067 - protein, 9 aa, Artificial Sequence
  Zinc finger protein 3 (173-181)
KYNDFGNSF

SEQ ID NO: 14068 - protein, 10 aa, Artificial Sequence
  Putative endoplasmin-like protein (136-145)
KYNDTFWKEF

SEQ ID NO: 14069 - protein, 9 aa, Artificial Sequence
  Sphingolipid delta(4)-desaturase DES1 (5-13)
KYPEIKSLM

SEQ ID NO: 14070 - protein, 9 aa, Artificial Sequence
  Neurolysin, mitochondrial (244-252)
KYPHYFPVM

SEQ ID NO: 14071 - protein, 9 aa, Artificial Sequence
  Protein farnesyltransferase/geranylgeranyltransferase type-1 subunit alpha (288-296)
KYPNLLNQL

SEQ ID NO: 14072 - protein, 9 aa, Artificial Sequence
  Protein ERGIC-53 (288-296)
KYQEEFEHF

SEQ ID NO: 14073 - protein, 9 aa, Artificial Sequence
  T-box transcription factor TBX3 (227-235)
KYQPRFHIV

SEQ ID NO: 14074 - protein, 9 aa, Artificial Sequence
  Isoleucine-tRNA ligase, cytoplasmic (288-296)
KYRPLFDYF

SEQ ID NO: 14075 - protein, 9 aa, Artificial Sequence
  Bardet-Biedl syndrome 10 protein (585-593)
KYSFPHTYI

SEQ ID NO: 14076 - protein, 9 aa, Artificial Sequence
  Ubiquitin-conjugating enzyme E2 variant 3 (36-44)
KYSMDTYVF

SEQ ID NO: 14077 - protein, 9 aa, Artificial Sequence
  Inositol-trisphosphate 3-kinase C (318-326)
KYSPFVVSF

SEQ ID NO: 14078 - protein, 9 aa, Artificial Sequence
  Serine/threonine-protein phosphatase 5 (314-322)
KYTAQMYEL

SEQ ID NO: 14079 - protein, 9 aa, Artificial Sequence
  FACT complex subunit SPT16 (92-100)
KYTEGVQSL

SEQ ID NO: 14080 - protein, 10 aa, Artificial Sequence
  Glycogen debranching enzyme (495-504)
KYTEITATYF

SEQ ID NO: 14081 - protein, 9 aa, Artificial Sequence
  Phospholipase DDHD2 (124-132)
KYVPYSESF

SEQ ID NO: 14082 - protein, 9 aa, Artificial Sequence
  Serine/threonine-protein kinase RIO1 (222-230)
KYVSGEFRF

SEQ ID NO: 14083 - protein, 10 aa, Artificial Sequence
  Splicing factor U2AF 65 kDa subunit (90-99)
KYWDVPPPGF

SEQ ID NO: 14084 - protein, 9 aa, Artificial Sequence
  Catenin alpha-1 (777-785)
LAYLQRIAL

SEQ ID NO: 14085 - protein, 8 aa, Artificial Sequence
  Heterogeneous nuclear ribonucleoprotein F (259-266)
LFGRDLSY

SEQ ID NO: 14086 - protein, 9 aa, Artificial Sequence
  Tubulin beta-6 chain (312-320)
LFKRISEQF

SEQ ID NO: 14087 - protein, 8 aa, Artificial Sequence
  Plectin (4148-4155)
LIDHQTYL

SEQ ID NO: 14088 - protein, 12 aa, Artificial Sequence
  Heat shock 70 kDa protein 1-like (198-209)
LIFDLGGGTFDV

SEQ ID NO: 14089 - protein, 9 aa, Artificial Sequence
  ATP synthase subunit beta, mitochondrial (215-223)
LIMELINNV

SEQ ID NO: 14090 - protein, 9 aa, Artificial Sequence
  DNA damage-binding protein 1 (880-888)
LLASINSTV

SEQ ID NO: 14091 - protein, 10 aa, Artificial Sequence
  Zinc finger protein 530 (30-39)
LLDEMQRLLY

SEQ ID NO: 14092 - protein, 9 aa, Artificial Sequence
  Phospholysine phosphohistidine inorganic pyrophosphate phosphatase (15-23)
LLDISGVLY

SEQ ID NO: 14093 - protein, 9 aa, Artificial Sequence
  Vacuolar fusion protein CCZ1 homolog (130-138)
LLDKVYSSV

SEQ ID NO: 14094 - protein, 9 aa, Artificial Sequence
  SPRY domain-containing SOCS box protein 1 (138-146)
LLDMPPVSY

SEQ ID NO: 14095 - protein, 9 aa, Artificial Sequence
  Beta-hexosaminidase subunit alpha (173-181)
LLDTSRHYL

SEQ ID NO: 14096 - protein, 9 aa, Artificial Sequence
  Fragile X mental retardation protein 1 (20-28)
LLDYHLNYL

SEQ ID NO: 14097 - protein, 9 aa, Artificial Sequence
  Supervillin (34-42)
LLEEDTPRY

SEQ ID NO: 14098 - protein, 9 aa, Artificial Sequence
  LEM domain-containing protein 2 (269-277)
LLELLHELY

SEQ ID NO: 14099 - protein, 11 aa, Artificial Sequence
  UDP-N-acetylglucosamine/UDP-glucose/GDP-mannose transporter (133-143)
LLETIILGKQY

SEQ ID NO: 14100 - protein, 11 aa, Artificial Sequence
  Complement decay-accelerating factor (9-19)
LLGELPRLLLL

SEQ ID NO: 14101 - protein, 8 aa, Artificial Sequence
  Kelch-like protein 24 (405-412)
LLGKVYVV

SEQ ID NO: 14102 - protein, 9 aa, Artificial Sequence
  Myosin-9 (292-300)
LLLEPYNKY

SEQ ID NO: 14103 - protein, 11 aa, Artificial Sequence
  Plectin (3700-3710)
LLSAEVARLLL

SEQ ID NO: 14104 - protein, 9 aa, Artificial Sequence
  Integrin alpha-3 (830-838)
LLYPTEITV

SEQ ID NO: 14105 - protein, 9 aa, Artificial Sequence
  Putative heat shock protein HSP 90-beta 2 (24-32)
LMSLIINTF

SEQ ID NO: 14106 - protein, 9 aa, Artificial Sequence
  LIM and calponin homology domains-containing protein 1 (480-488)
LNDPNPMKY

SEQ ID NO: 14107 - protein, 9 aa, Artificial Sequence
  Leucine-rich repeat-containing protein 59 (77-85)
LPADFGRLV

SEQ ID NO: 14108 - protein, 9 aa, Artificial Sequence
  DNA-directed RNA polymerase II subunit RPB2 (74-82)
LPAGINSIV

SEQ ID NO: 14109 - protein, 9 aa, Artificial Sequence
  Lysosomal Pro-X carboxypeptidase (301-309)
LPAWPIKVV

SEQ ID NO: 14110 - protein, 9 aa, Artificial Sequence
  Leucine-tRNA ligase, cytoplasmic (424-432)
LPFEPVPVI

SEQ ID NO: 14111 - protein, 10 aa, Artificial Sequence
  RNA-binding protein 26 (329-338)
LPFPAQPPVV

SEQ ID NO: 14112 - protein, 10 aa, Artificial Sequence
  Putative RNA polymerase II subunit B1 CTD phosphatase RPAP2 (434-443)
LPFRGSGTAI

SEQ ID NO: 14113 - protein, 9 aa, Artificial Sequence
  Major facilitator superfamily domain-containing protein 12 (308-316)
LPKKFIATI

SEQ ID NO: 14114 - protein, 9 aa, Artificial Sequence
  Targeting protein for Xklp2 (528-536)
LPLPHFDTI

SEQ ID NO: 14115 - protein, 9 aa, Artificial Sequence
  Heat shock 70 kDa protein 13 (26-34)
LPLPTPKVI

SEQ ID NO: 14116 - protein, 9 aa, Artificial Sequence
  Alpha/beta hydrolase domain-containing protein 14B (203-211)
LPNHRVLIM

SEQ ID NO: 14117 - protein, 9 aa, Artificial Sequence
  Ubiquitin carboxyl-terminal hydrolase 11 (143-151)
LPNIQKVEV

SEQ ID NO: 14118 - protein, 8 aa, Artificial Sequence
  Protein transport protein Sec61 subunit alpha isoform 2 (217-224)
LPNLMNLI

SEQ ID NO: 14119 - protein, 8 aa, Artificial Sequence
  Unconventional myosin-X (129-136)
LPPHIFAI

SEQ ID NO: 14120 - protein, 9 aa, Artificial Sequence
  Mimitin, mitochondrial (121-129)
LPPPVQTQI

SEQ ID NO: 14121 - protein, 9 aa, Artificial Sequence
  Phosphoglycerate kinase 1 (181-189)
LPQKAGGFL

SEQ ID NO: 14122 - protein, 9 aa, Artificial Sequence
  Coatomer subunit beta' (762-770)
LPSQVSRVV

SEQ ID NO: 14123 - protein, 9 aa, Artificial Sequence
  Neutral amino acid transporter B(0) (246-254)
LPVDHISLI

SEQ ID NO: 14124 - protein, 9 aa, Artificial Sequence
  Protein TALPID3 (38-46)
LPVGTGTSL

SEQ ID NO: 14125 - protein, 9 aa, Artificial Sequence
  Centrosomal protein of 63 kDa (446-454)
LPVSPLGSI

SEQ ID NO: 14126 - protein, 8 aa, Artificial Sequence
  Clathrin heavy chain 1 (859-866)
LPWLEARI

SEQ ID NO: 14127 - protein, 8 aa, Artificial Sequence
  Protein transport protein Sec16A (155-162)
LPYLPHYI

SEQ ID NO: 14128 - protein, 9 aa, Artificial Sequence
  Very-long-chain (3R)-3-hydroxyacyl-CoA dehydratase 3 (314-322)
LPYPVKIKV

SEQ ID NO: 14129 - protein, 9 aa, Artificial Sequence
  HAUS augmin-like complex subunit 6 (131-139)
LSDLKHMRY

SEQ ID NO: 14130 - protein, 9 aa, Artificial Sequence
  General transcription factor 3C polypeptide 1 (333-341)
LSDSQMKSY

SEQ ID NO: 14131 - protein, 10 aa, Artificial Sequence
  Importin-7 (681-690)
LSDTKYLEMI

SEQ ID NO: 14132 - protein, 9 aa, Artificial Sequence
  Cytoplasmic dynein 1 heavy chain 1 (2161-2169)
LSDVFPGVQ

SEQ ID NO: 14133 - protein, 10 aa, Artificial Sequence
  Cytoplasmic dynein 1 heavy chain 1 (2161-2170)
LSDVFPGVQY

SEQ ID NO: 14134 - protein, 13 aa, Artificial Sequence
  Creatine kinase B-type (162-174)
LSSLDGDLAGRYY

SEQ ID NO: 14135 - protein, 9 aa, Artificial Sequence
  Pumilio homolog 2 (167-175)
LTAAQQQQY

SEQ ID NO: 14136 - protein, 9 aa, Artificial Sequence
  26S proteasome non-ATPase regulatory subunit 2 (391-399)
LTDDGNKWL

SEQ ID NO: 14137 - protein, 10 aa, Artificial Sequence
  Neural cell adhesion molecule L1 (975-984)
LTDLSPHLRY

SEQ ID NO: 14138 - protein, 10 aa, Artificial Sequence
  Pre-mRNA-processing-splicing factor 8 (246-255)
LTDLVDDNYF

SEQ ID NO: 14139 - protein, 9 aa, Artificial Sequence
  Exosome component 10 (356-364)
LTDPAIVKV

SEQ ID NO: 14140 - protein, 8 aa, Artificial Sequence
  Tubulin polyglutamylase complex subunit 2 (125-132)
LTDTFTAY

SEQ ID NO: 14141 - protein, 9 aa, Artificial Sequence
  Alpha-N-acetylglucosaminidase (121-129)
LTEATPNRY

SEQ ID NO: 14142 - protein, 9 aa, Artificial Sequence
  AF4/FMR2 family member 4 (1028-1036)
LTEHLKNSY

SEQ ID NO: 14143 - protein, 11 aa, Artificial Sequence
  Unconventional myosin-X (71-81)
LTELHGGSIMY

SEQ ID NO: 14144 - protein, 9 aa, Artificial Sequence
  Actin-like protein 6A (94-102)
LTELMFEHY

SEQ ID NO: 14145 - protein, 11 aa, Artificial Sequence
  Adenosylhomocysteinase 2 (192-202)
LTELTDDQAKY

SEQ ID NO: 14146 - protein, 9 aa, Artificial Sequence
  Semaphorin-4C (58-66)
LTEPTGLLY

SEQ ID NO: 14147 - protein, 9 aa, Artificial Sequence
  Oxysterol-binding protein-related protein 1 (580-588)
LTEYMEHTY

SEQ ID NO: 14148 - protein, 13 aa, Artificial Sequence
  Melanoma-associated antigen 1 (239-251)
LTQDLVQEKYLEY

SEQ ID NO: 14149 - protein, 11 aa, Artificial Sequence
  Caspase recruitment domain-containing protein 8 (43-53)
LVDNSIRELQY

SEQ ID NO: 14150 - protein, 9 aa, Artificial Sequence
  Non-canonical poly(A) RNA polymerase PAPD5 (82-90)
LYGRHFNYL

SEQ ID NO: 14151 - protein, 9 aa, Artificial Sequence
  Ras-related protein Rap-2c (70-78)
LYIKNGQGF

SEQ ID NO: 14152 - protein, 10 aa, Artificial Sequence
  Dedicator of cytokinesis protein 7 (456-465)
LYIYPQSLNF

SEQ ID NO: 14153 - protein, 9 aa, Artificial Sequence
  Mitochondrial carrier homolog 1 (63-71)
LYLPSFFTY

SEQ ID NO: 14154 - protein, 9 aa, Artificial Sequence
  Eukaryotic translation initiation factor 3 subunit C-like protein (609-617)
LYNRTMVQL

SEQ ID NO: 14155 - protein, 9 aa, Artificial Sequence
  Serine/threonine-protein phosphatase 5 (284-292)
LYPDHFHLL

SEQ ID NO: 14156 - protein, 9 aa, Artificial Sequence
  ATPase family AAA domain-containing protein 2B (421-429)
LYPEIFEKF

SEQ ID NO: 14157 - protein, 9 aa, Artificial Sequence
  Syntenin-1 (45-53)
LYPRLYPEL

SEQ ID NO: 14158 - protein, 9 aa, Artificial Sequence
  Nuclear factor erythroid 2-related factor 1 (392-400)
LYQEVFGRL

SEQ ID NO: 14159 - protein, 9 aa, Artificial Sequence
  Rapamycin-insensitive companion of mTOR (1676-1684)
LYSEVSHLL

SEQ ID NO: 14160 - protein, 8 aa, Artificial Sequence
  Nuclear protein 1 (29-36)
LYSLAHSY

SEQ ID NO: 14161 - protein, 9 aa, Artificial Sequence
  Protein CLEC16A (171-179)
LYTEAIKFF

SEQ ID NO: 14162 - protein, 9 aa, Artificial Sequence
  UDP-glucose:glycoprotein glucosyltransferase 1 (1417-1425)
LYVVDLKKF

SEQ ID NO: 14163 - protein, 9 aa, Artificial Sequence
  Sorting nexin-30 (408-416)
MADKNIQYY

SEQ ID NO: 14164 - protein, 8 aa, Artificial Sequence
  HLA class I histocompatibility antigen, Cw-2 alpha chain (4-11)
MAPRTLLL

SEQ ID NO: 14165 - protein, 8 aa, Artificial Sequence
  HLA class I histocompatibility antigen, A-23 alpha chain (4-11)
MAPRTLVL

SEQ ID NO: 14166 - protein, 10 aa, Artificial Sequence
  Uroporphyrinogen decarboxylase (66-75)
MLDDFGPHRY

SEQ ID NO: 14167 - protein, 9 aa, Artificial Sequence
  ATP-binding cassette sub-family F member 1 (474-482)
MLDEPTNHL

SEQ ID NO: 14168 - protein, 9 aa, Artificial Sequence
  V-type proton ATPase subunit S1 (306-314)
MLQDFQIQA

SEQ ID NO: 14169 - protein, 9 aa, Artificial Sequence
  Lysine-specific demethylase 5A (1454-1462)
MMVGDLLEV

SEQ ID NO: 14170 - protein, 9 aa, Artificial Sequence
  Inosine-5'-monophosphate dehydrogenase (348-356)
MMYSGELKF

SEQ ID NO: 14171 - protein, 9 aa, Artificial Sequence
  Nucleolar pre-ribosomal-associated protein 1 (691-699)
MPHLSMQQV

SEQ ID NO: 14172 - protein, 8 aa, Artificial Sequence
  Myoferlin (1357-1364)
MPPLVIKV

SEQ ID NO: 14173 - protein, 9 aa, Artificial Sequence
  Serine/threonine-protein kinase D3 (532-540)
MPVTPQASV

SEQ ID NO: 14174 - protein, 9 aa, Artificial Sequence
  Progressive ankylosis protein homolog (288-296)
MPYGWLTEI

SEQ ID NO: 14175 - protein, 10 aa, Artificial Sequence
  YTH domain-containing family protein 2 (206-215)
MSDSYLPSYY

SEQ ID NO: 14176 - protein, 9 aa, Artificial Sequence
  Bleomycin hydrolase (410-418)
MTDEWFSEY

SEQ ID NO: 14177 - protein, 9 aa, Artificial Sequence
  Eukaryotic initiation factor 4A-III (233-241)
MTDPIRILV

SEQ ID NO: 14178 - protein, 12 aa, Artificial Sequence
  Cytochrome c oxidase subunit 1 (484-495)
MVEEPSMNLEWL

SEQ ID NO: 14179 - protein, 11 aa, Artificial Sequence
  Son of sevenless homolog 2 (615-625)
MYADPNFVRTF

SEQ ID NO: 14180 - protein, 9 aa, Artificial Sequence
  Trafficking protein particle complex subunit 2 (93-101)
MYLKTVDKF

SEQ ID NO: 14181 - protein, 9 aa, Artificial Sequence
  Pyruvate carboxylase, mitochondrial (1012-1020)
MYPDVFAHF

SEQ ID NO: 14182 - protein, 9 aa, Artificial Sequence
  Constitutive coactivator of PPAR-gamma-like protein 1 (568-576)
MYPYIFHVL

SEQ ID NO: 14183 - protein, 9 aa, Artificial Sequence
  Msx2-interacting protein (2894-2902)
NASPVISSV

SEQ ID NO: 14184 - protein, 9 aa, Artificial Sequence
  Cytoplasmic dynein 1 heavy chain 1 (3346-3354)
NFIPTIVNF

SEQ ID NO: 14185 - protein, 10 aa, Artificial Sequence
  Ras GTPase-activating-like protein IQGAP3 (896-905)
NIMDIKIGLL

SEQ ID NO: 14186 - protein, 9 aa, Artificial Sequence
  Tuberin (178-186)
NLAAYVPLL

SEQ ID NO: 14187 - protein, 9 aa, Artificial Sequence
  Nestin (83-91)
NLAEELEGV

SEQ ID NO: 14188 - protein, 12 aa, Artificial Sequence
  Spliceosome RNA helicase DDX39B (201-212)
NLFGRGMDIERV

SEQ ID NO: 14189 - protein, 9 aa, Artificial Sequence
  Protein unc-45 homolog A (297-305)
NLLDLLTEV

SEQ ID NO: 14190 - protein, 10 aa, Artificial Sequence
  Ras GTPase-activating-like protein IQGAP2 (826-835)
NLMDIKIGLL

SEQ ID NO: 14191 - protein, 14 aa, Artificial Sequence
  Peroxisome proliferator-activated receptor gamma coactivator 1-alpha (767-780)
NSDDFDPASTKSKY

SEQ ID NO: 14192 - protein, 11 aa, Artificial Sequence
  NADH-ubiquinone oxidoreductase chain 5 (109-119)
NSDPNINQFFK

SEQ ID NO: 14193 - protein, 9 aa, Artificial Sequence
  Cadherin EGF LAG seven-pass G-type receptor 2 (2584-2592)
NSDTLLFHY

SEQ ID NO: 14194 - protein, 9 aa, Artificial Sequence
  Unconventional myosin-X (1519-1527)
NSDVVEQIY

SEQ ID NO: 14195 - protein, 9 aa, Artificial Sequence
  Dedicator of cytokinesis protein 9 (118-126)
NSDWHLVNY

SEQ ID NO: 14196 - protein, 9 aa, Artificial Sequence
  Serine/threonine-protein kinase RIO3 (378-386)
NSEEMKEAY

SEQ ID NO: 14197 - protein, 9 aa, Artificial Sequence
  Nuclear factor erythroid 2-related factor 2 (178-186)
NTDFGDEFY

SEQ ID NO: 14198 - protein, 9 aa, Artificial Sequence
  26S proteasome non-ATPase regulatory subunit 12 (218-226)
NTEKLKLKY

SEQ ID NO: 14199 - protein, 9 aa, Artificial Sequence
  Transgelin-2 (106-114)
NTTDIFQTV

SEQ ID NO: 14200 - protein, 11 aa, Artificial Sequence
  Anaphase-promoting complex subunit 7 (236-246)
NVDLLGSLADL

SEQ ID NO: 14201 - protein, 9 aa, Artificial Sequence
  C-Jun-amino-terminal kinase-interacting protein 4 (137-145)
NYADQISRL

SEQ ID NO: 14202 - protein, 10 aa, Artificial Sequence
  Heterogeneous nuclear ribonucleoprotein U-like protein 1 (472-481)
NYAGRWDVLI

SEQ ID NO: 14203 - protein, 9 aa, Artificial Sequence
  Basic leucine zipper and W2 domain-containing protein 2 (110-118)
NYAQVFNKL

SEQ ID NO: 14204 - protein, 9 aa, Artificial Sequence
  Baculoviral IAP repeat-containing protein 6 (803-811)
NYATRIVTL

SEQ ID NO: 14205 - protein, 9 aa, Artificial Sequence
  Cleavage stimulation factor subunit 3 (71-79)
NYDKVEKLF

SEQ ID NO: 14206 - protein, 9 aa, Artificial Sequence
  E3 ubiquitin-protein ligase SHPRH (409-417)
NYFIPSHYF

SEQ ID NO: 14207 - protein, 10 aa, Artificial Sequence
  Translocon-associated protein subunit alpha (108-117)
NYKDLNGNVF

SEQ ID NO: 14208 - protein, 9 aa, Artificial Sequence
  Ubiquitin fusion degradation protein 1 homolog (197-205)
NYNEKIYEL

SEQ ID NO: 14209 - protein, 9 aa, Artificial Sequence
  Neurofibromin (31-39)
NYPDEFTKL

SEQ ID NO: 14210 - protein, 9 aa, Artificial Sequence
  Zinc finger MYM-type protein 4 (344-352)
NYQNVVHKL

SEQ ID NO: 14211 - protein, 9 aa, Artificial Sequence
  Alpha-mannosidase 2x (441-449)
NYQRLFDFF

SEQ ID NO: 14212 - protein, 9 aa, Artificial Sequence
  Neuron navigator 2 (1368-1376)
NYSIIPYLL

SEQ ID NO: 14213 - protein, 9 aa, Artificial Sequence
  E1A-binding protein p400 (343-351)
PFAKPLPTF

SEQ ID NO: 14214 - protein, 10 aa, Artificial Sequence
  Cyclic AMP-responsive element-binding protein 3-like protein 2 (17-26)
PSYGGQQQSY

SEQ ID NO: 14215 - protein, 9 aa, Artificial Sequence
  Coatomer subunit alpha (1152-1160)
PTDAYQLNY

SEQ ID NO: 14216 - protein, 10 aa, Artificial Sequence
  Endoplasmin (497-506)
PTDITSLDQY

SEQ ID NO: 14217 - protein, 9 aa, Artificial Sequence
  Neurofibromin (147-155)
PTDLETRSY

SEQ ID NO: 14218 - protein, 9 aa, Artificial Sequence
  H/ACA ribonucleoprotein complex subunit 1 (96-104)
PYFNAPVYL

SEQ ID NO: 14219 - protein, 9 aa, Artificial Sequence
  E3 ubiquitin-protein ligase UBR4 (190-198)
PYIIHTVLY

SEQ ID NO: 14220 - protein, 9 aa, Artificial Sequence
  Procollagen-lysine,2-oxoglutarate 5-dioxygenase 1 (449-457)
PYISNIYLI

SEQ ID NO: 14221 - protein, 9 aa, Artificial Sequence
  Zinc finger protein 503 (342-350)
PYKPGQTVF

SEQ ID NO: 14222 - protein, 9 aa, Artificial Sequence
  Synergin gamma (94-102)
PYLGQAPFL

SEQ ID NO: 14223 - protein, 9 aa, Artificial Sequence
  Tubulin polyglutamylase TTLL4 (755-763)
PYLISGSKF

SEQ ID NO: 14224 - protein, 11 aa, Artificial Sequence
  Protein-L-isoaspartate(D-aspartate) O-methyltransferase (45-55)
PYMDSPQSIGF

SEQ ID NO: 14225 - protein, 10 aa, Artificial Sequence
  Oxysterol-binding protein-related protein 10 (414-423)
PYNPIIGETF

SEQ ID NO: 14226 - protein, 10 aa, Artificial Sequence
  Oxysterol-binding protein-related protein 8 (441-450)
PYNPILGETF

SEQ ID NO: 14227 - protein, 9 aa, Artificial Sequence
  DNA-dependent protein kinase catalytic subunit (2252-2260)
PYRLIFEKF

SEQ ID NO: 14228 - protein, 9 aa, Artificial Sequence
  Ubiquitin-associated protein 2-like (857-865)
PYSGDLTKF

SEQ ID NO: 14229 - protein, 9 aa, Artificial Sequence
  Origin recognition complex subunit 5 (303-311)
PYYSKFILI

SEQ ID NO: 14230 - protein, 9 aa, Artificial Sequence
  Spectrin alpha chain, non-erythrocytic 1 (417-425)
QLLGSAHEV

SEQ ID NO: 14231 - protein, 9 aa, Artificial Sequence
  LIM and calponin homology domains-containing protein 1 (431-439)
QMFEGVARV

SEQ ID NO: 14232 - protein, 9 aa, Artificial Sequence
  Protein transport protein Sec61 subunit alpha isoform 2 (272-280)
QSALVSNLY

SEQ ID NO: 14233 - protein, 12 aa, Artificial Sequence
  HLA class I histocompatibility antigen, A-1 alpha chain (86-97)
QSEDGSHTIQIM

SEQ ID NO: 14234 - protein, 9 aa, Artificial Sequence
  Peroxisome proliferator-activated receptor gamma coactivator 1-alpha (61-69)
QSEIISNQY

SEQ ID NO: 14235 - protein, 12 aa, Artificial Sequence
  Probable ubiquitin carboxyl-terminal hydrolase FAF-X (1852-1863)
QSESETAGSTKY

SEQ ID NO: 14236 - protein, 9 aa, Artificial Sequence
  Obscurin-like protein 1 (662-670)
QVEPGALRY

SEQ ID NO: 14237 - protein, 11 aa, Artificial Sequence
  Regulator of nonsense transcripts 1 (738-748)
QWPQPDKPMFF

SEQ ID NO: 14238 - protein, 9 aa, Artificial Sequence
  Bardet-Biedl syndrome 4 protein (147-155)
QYASAFHFL

SEQ ID NO: 14239 - protein, 9 aa, Artificial Sequence
  Dynein light chain roadblock-type 1 (48-56)
QYASLMHSF

SEQ ID NO: 14240 - protein, 9 aa, Artificial Sequence
  Serine/threonine-protein kinase PLK4 (655-663)
QYASRFVQL

SEQ ID NO: 14241 - protein, 10 aa, Artificial Sequence
  Neuron navigator 2 (639-648)
QYDPYTDSRF

SEQ ID NO: 14242 - protein, 9 aa, Artificial Sequence
  Disks large homolog 5 (1316-1324)
QYNPHVHQL

SEQ ID NO: 14243 - protein, 9 aa, Artificial Sequence
  YY1-associated protein 1 (219-227)
QYNPKFQTL

SEQ ID NO: 14244 - protein, 9 aa, Artificial Sequence
  H/ACA ribonucleoprotein complex non-core subunit NAF1 (421-429)
QYPFPLPVF

SEQ ID NO: 14245 - protein, 9 aa, Artificial Sequence
  ATP-dependent RNA helicase DDX24 (585-593)
QYPGRSLVF

SEQ ID NO: 14246 - protein, 11 aa, Artificial Sequence
  Signal transducer and activator of transcription 1-alpha/beta (67-77)
QYSRFSLENNF

SEQ ID NO: 14247 - protein, 9 aa, Artificial Sequence
  Regulatory-associated protein of mTOR (699-707)
QYTPHSHQF

SEQ ID NO: 14248 - protein, 9 aa, Artificial Sequence
  60S ribosomal protein L7 (200-208)
RFKEANNFL

SEQ ID NO: 14249 - protein, 9 aa, Artificial Sequence
  Cullin-3 (709-717)
RFLPSPVVI

SEQ ID NO: 14250 - protein, 9 aa, Artificial Sequence
  40S ribosomal protein S30 (115-123)
RFVNVVPTF

SEQ ID NO: 14251 - protein, 9 aa, Artificial Sequence
  Putative PIP5K1A and PSMD4-like protein (555-563)
RILSKLHTV

SEQ ID NO: 14252 - protein, 9 aa, Artificial Sequence
  Schlafen family member 5 (693-701)
RIMEKIRNV

SEQ ID NO: 14253 - protein, 9 aa, Artificial Sequence
  Condensin complex subunit 1 (412-420)
RLADKSVLV

SEQ ID NO: 14254 - protein, 9 aa, Artificial Sequence
  DNA replication licensing factor MCM4 (739-747)
RLAEAHAKV

SEQ ID NO: 14255 - protein, 10 aa, Artificial Sequence
  Histone-lysine N-methyltransferase ASH1L (2786-2795)
RLDKSAHLFY

SEQ ID NO: 14256 - protein, 10 aa, Artificial Sequence
  Prolyl 3-hydroxylase 1 (554-563)
RLDTPLYFSY

SEQ ID NO: 14257 - protein, 9 aa, Artificial Sequence
  Elongation factor 2 (239-247)
RLMEPIYLV

SEQ ID NO: 14258 - protein, 10 aa, Artificial Sequence
  Solute carrier family 22 member 18 (149-158)
RPAALGRLGL

SEQ ID NO: 14259 - protein, 10 aa, Artificial Sequence
  BCL-6 corepressor (1395-1404)
RPMPPEARRL

SEQ ID NO: 14260 - protein, 11 aa, Artificial Sequence
  Protein FAM46B (291-301)
RPRPSTDVRAL

SEQ ID NO: 14261 - protein, 9 aa, Artificial Sequence
  Nuclear factor 1 X-type (113-121)
RQADKVWRL

SEQ ID NO: 14262 - protein, 9 aa, Artificial Sequence
  Multiple PDZ domain protein (911-919)
RQDENTPSV

SEQ ID NO: 14263 - protein, 10 aa, Artificial Sequence
  REST corepressor 1 (336-345)
RQLDMELVSV

SEQ ID NO: 14264 - protein, 9 aa, Artificial Sequence
  Bifunctional coenzyme A synthase (204-212)
RQVEKAWAL

SEQ ID NO: 14265 - protein, 12 aa, Artificial Sequence
  Serine/threonine-protein kinase SIK3 (368-379)
RSDAYDHYSAIY

SEQ ID NO: 14266 - protein, 9 aa, Artificial Sequence
  Truncated EKLF (17-25)
RSDELTRHY

SEQ ID NO: 14267 - protein, 10 aa, Artificial Sequence
  Unconventional myosin-X (35-44)
RTDYGQVFTY

SEQ ID NO: 14268 - protein, 9 aa, Artificial Sequence
  Ribonuclease P protein subunit p21 (66-74)
RTIAKRLVL

SEQ ID NO: 14269 - protein, 9 aa, Artificial Sequence
  Serine/threonine-protein kinase MRCK beta (1490-1498)
RTMEWVQTI

SEQ ID NO: 14270 - protein, 9 aa, Artificial Sequence
  Liprin-beta-1 (738-746)
RVDGRMLHY

SEQ ID NO: 14271 - protein, 11 aa, Artificial Sequence
  DNA damage-binding protein 1 (263-273)
RVDPNGSRYLL

SEQ ID NO: 14272 - protein, 11 aa, Artificial Sequence
  Src substrate cortactin (131-141)
RVDQSAVGFEY

SEQ ID NO: 14273 - protein, 10 aa, Artificial Sequence
  HLA class I histocompatibility antigen, alpha chain E (284-293)
RWKPASQPTI

SEQ ID NO: 14274 - protein, 11 aa, Artificial Sequence
  Serine/threonine-protein phosphatase 2A 55 kDa regulatory subunit B alpha isoform (100-110)
RWLPQKNAAQF

SEQ ID NO: 14275 - protein, 9 aa, Artificial Sequence
  snRNA-activating protein complex subunit 1 (64-72)
RYFLPPYTF

SEQ ID NO: 14276 - protein, 9 aa, Artificial Sequence
  Heterogeneous nuclear ribonucleoprotein H (275-283)
RYGDGGSTF

SEQ ID NO: 14277 - protein, 9 aa, Artificial Sequence
  Rab proteins geranylgeranyltransferase component A 1 (79-87)
RYGNTPFLF

SEQ ID NO: 14278 - protein, 10 aa, Artificial Sequence
  Pre-mRNA-processing-splicing factor 8 (1090-1099)
RYIDRIHIFF

SEQ ID NO: 14279 - protein, 9 aa, Artificial Sequence
  Cystine/glutamate transporter (148-156)
RYILEPFFI

SEQ ID NO: 14280 - protein, 9 aa, Artificial Sequence
  ER degradation-enhancing alpha-mannosidase-like protein 3 (281-289)
RYISQPPLL

SEQ ID NO: 14281 - protein, 9 aa, Artificial Sequence
  Homeodomain-interacting protein kinase 2 (411-419)
RYISQTQGL

SEQ ID NO: 14282 - protein, 9 aa, Artificial Sequence
  DNA-directed RNA polymerase III subunit RPC3 (90-98)
RYIYTTKTL

SEQ ID NO: 14283 - protein, 9 aa, Artificial Sequence
  Probable global transcription activator SNF2L1 (867-875)
RYKAPFHQL

SEQ ID NO: 14284 - protein, 9 aa, Artificial Sequence
  Ras GTPase-activating-like protein IQGAP1 (102-110)
RYKATGLHF

SEQ ID NO: 14285 - protein, 10 aa, Artificial Sequence
  RNA pseudouridylate synthase domain-containing protein 2 (461-470)
RYKGPGFEYF

SEQ ID NO: 14286 - protein, 9 aa, Artificial Sequence
  Cytoplasmic dynein 1 heavy chain 1 (979-987)
RYKLYQEMF

SEQ ID NO: 14287 - protein, 10 aa, Artificial Sequence
  DENN domain-containing protein 1B (346-355)
RYKPGEPITF

SEQ ID NO: 14288 - protein, 9 aa, Artificial Sequence
  Trimethylguanosine synthase (469-477)
RYLEKNVKL

SEQ ID NO: 14289 - protein, 9 aa, Artificial Sequence
  Catechol O-methyltransferase (196-204)
RYLPDTLLL

SEQ ID NO: 14290 - protein, 12 aa, Artificial Sequence
  Zinc finger protein 281 (390-401)
RYLPTASSNSAF

SEQ ID NO: 14291 - protein, 10 aa, Artificial Sequence
  Histone-binding protein RBBP7 (130-139)
RYMPQNPHII

SEQ ID NO: 14292 - protein, 9 aa, Artificial Sequence
  E3 ubiquitin-protein ligase DZIP3 (194-202)
RYNGGLLEF

SEQ ID NO: 14293 - protein, 9 aa, Artificial Sequence
  Influenza virus NS1A-binding protein (531-539)
RYNPENNTW

SEQ ID NO: 14294 - protein, 9 aa, Artificial Sequence
  Kelch-like protein 11 (425-433)
RYNPNLNTW

SEQ ID NO: 14295 - protein, 9 aa, Artificial Sequence
  Solute carrier family 35 member B1 (235-243)
RYPAIIYNI

SEQ ID NO: 14296 - protein, 10 aa, Artificial Sequence
  Myotubularin-related protein 5 (78-87)
RYPPDIRATF

SEQ ID NO: 14297 - protein, 10 aa, Artificial Sequence
  Myotubularin-related protein 13 (1004-1013)
RYPQSIFSTF

SEQ ID NO: 14298 - protein, 9 aa, Artificial Sequence
  Golgin subfamily B member 1 (2035-2043)
RYQEKISAL

SEQ ID NO: 14299 - protein, 9 aa, Artificial Sequence
  Zinc phosphodiesterase ELAC protein 2 (313-321)
RYQQWMERF

SEQ ID NO: 14300 - protein, 9 aa, Artificial Sequence
  Supervillin (423-431)
RYQTQPVTL

SEQ ID NO: 14301 - protein, 12 aa, Artificial Sequence
  Magnesium transporter protein 1 (137-148)
RYSSAFTNRIFF

SEQ ID NO: 14302 - protein, 11 aa, Artificial Sequence
  Retinoic acid receptor alpha (412-422)
RYTPEQDTMTF

SEQ ID NO: 14303 - protein, 9 aa, Artificial Sequence
  Beta-hexosaminidase subunit alpha (36-44)
RYVLYPNNF

SEQ ID NO: 14304 - protein, 11 aa, Artificial Sequence
  Beta-hexosaminidase subunit alpha (36-46)
RYVLYPNNFQF

SEQ ID NO: 14305 - protein, 9 aa, Artificial Sequence
  39S ribosomal protein L43, mitochondrial (21-29)
RYVQQLQRL

SEQ ID NO: 14306 - protein, 9 aa, Artificial Sequence
  Syntaxin-binding protein 1 (149-157)
SADSFQSFY

SEQ ID NO: 14307 - protein, 9 aa, Artificial Sequence
  Histone-binding protein RBBP4 (220-228)
SFNPYSEFI

SEQ ID NO: 14308 - protein, 9 aa, Artificial Sequence
  Hemoglobin subunit alpha (7-15)
SFPTTKTYF

SEQ ID NO: 14309 - protein, 9 aa, Artificial Sequence
  Dolichyl-diphosphooligosaccharide-proteinosyltransferase subunit 2 (185-193)
SFTPVGDVF

SEQ ID NO: 14310 - protein, 12 aa, Artificial Sequence
  Heat shock-related 70 kDa protein 2 (211-222)
SILTIEDGIFEV

SEQ ID NO: 14311 - protein, 9 aa, Artificial Sequence
  Transcription factor BTF3 (88-96)
SLAANTFTI

SEQ ID NO: 14312 - protein, 9 aa, Artificial Sequence
  Superkiller viralicidic activity 2-like 2 (92-100)
SLADLMPRV

SEQ ID NO: 14313 - protein, 10 aa, Artificial Sequence
  Aminopeptidase B (318-327)
SLADVIIHEI

SEQ ID NO: 14314 - protein, 9 aa, Artificial Sequence
  Epoxide hydrolase 1 (350-358)
SLDDLLTNV

SEQ ID NO: 14315 - protein, 9 aa, Artificial Sequence
  Band 4.1-like protein 2 (550-558)
SLDGAPIGV

SEQ ID NO: 14316 - protein, 9 aa, Artificial Sequence
  RNA-binding motif protein, X-linked-like-2 (67-75)
SLDGKAIKV

SEQ ID NO: 14317 - protein, 9 aa, Artificial Sequence
  Telomere-associated protein RIF1 (1157-1165)
SLDKTSPEM

SEQ ID NO: 14318 - protein, 9 aa, Artificial Sequence
  Cytoskeleton-associated protein 4 (535-543)
SLDNLKASV

SEQ ID NO: 14319 - protein, 8 aa, Artificial Sequence
  Signal recognition particle 54 kDa protein (200-207)
SLFEEMLQ

SEQ ID NO: 14320 - protein, 9 aa, Artificial Sequence
  WD repeat and FYVE domain-containing protein 3 (1518-1526)
SLFEHFIEL

SEQ ID NO: 14321 - protein, 10 aa, Artificial Sequence
  Programmed cell death 6-interacting protein (103-112)
SLFGGSVKLA

SEQ ID NO: 14322 - protein, 12 aa, Artificial Sequence
  Junction plakoglobin (670-681)
SLFKHDPAAWEA

SEQ ID NO: 14323 - protein, 13 aa, Artificial Sequence
  Unconventional myosin-Ib (552-564)
SLFPEGNPAKINL

SEQ ID NO: 14324 - protein, 9 aa, Artificial Sequence
  Disintegrin and metalloproteinase domain-containing protein 10 (80-88)
SLFSDEFKV

SEQ ID NO: 14325 - protein, 10 aa, Artificial Sequence
  Renin receptor (103-112)
SLFSEETPVV

SEQ ID NO: 14326 - protein, 9 aa, Artificial Sequence
  Tyrosine-protein phosphatase non-receptor type 9 (479-487)
SLIDFLRVV

SEQ ID NO: 14327 - protein, 9 aa, Artificial Sequence
  Probable E3 ubiquitin-protein ligase HECTD4 (234-242)
SLKTFVHTV

SEQ ID NO: 14328 - protein, 10 aa, Artificial Sequence
  Acyl-coenzyme A thioesterase 1 isoform X1 (59-68)
SLLAGKGFAV

SEQ ID NO: 14329 - protein, 9 aa, Artificial Sequence
  Cell cycle checkpoint control protein RAD9A (254-262)
SLLDGHFVL

SEQ ID NO: 14330 - protein, 9 aa, Artificial Sequence
  Unconventional myosin-Ib (9-17)
SLLDNMIGV

SEQ ID NO: 14331 - protein, 9 aa, Artificial Sequence
  Protein virilizer homolog (1470-1478)
SLLDSVVGL

SEQ ID NO: 14332 - protein, 9 aa, Artificial Sequence
  Programmed cell death 6-interacting protein (554-562)
SLLSNLDEV

SEQ ID NO: 14333 - protein, 11 aa, Artificial Sequence
  E3 ubiquitin-protein ligase UBR1 (683-693)
SLMDPNKFLLL

SEQ ID NO: 14334 - protein, 11 aa, Artificial Sequence
  Insulin receptor substrate 2 (1109-1119)
SLMEQVSGVEA

SEQ ID NO: 14335 - protein, 9 aa, Artificial Sequence
  UHRF1-binding protein 1-like (1293-1301)
SLMNIQHFL

SEQ ID NO: 14336 - protein, 10 aa, Artificial Sequence
  DNA-dependent protein kinase catalytic subunit (3481-3490)
SLMTKEISSV

SEQ ID NO: 14337 - protein, 9 aa, Artificial Sequence
  Serpin H1 (304-312)
SLPKGVVEV

SEQ ID NO: 14338 - protein, 8 aa, Artificial Sequence
  Vimentin (226-233)
SLQEEIAF

SEQ ID NO: 14339 - protein, 10 aa, Artificial Sequence
  Enhancer of mRNA-decapping protein 4 (777-786)
SLQESILAQV

SEQ ID NO: 14340 - protein, 9 aa, Artificial Sequence
  Plasma membrane calcium-transporting ATPase 4 (1197-1205)
SLQSLETSV

SEQ ID NO: 14341 - protein, 9 aa, Artificial Sequence
  Ubiquitin-associated protein 2-like (493-501)
SLTSKIPAL

SEQ ID NO: 14342 - protein, 11 aa, Artificial Sequence
  Ras-related C3 botulinum toxin substrate 1 (39-49)
SLVSPASFENV

SEQ ID NO: 14343 - protein, 9 aa, Artificial Sequence
  Renin receptor (241-249)
SLYGGNAVV

SEQ ID NO: 14344 - protein, 11 aa, Artificial Sequence
  Renin receptor (241-251)
SLYGGNAVVEL

SEQ ID NO: 14345 - protein, 13 aa, Artificial Sequence
  Renin receptor (241-253)
SLYGGNAVVELVT

SEQ ID NO: 14346 - protein, 9 aa, Artificial Sequence
  Nucleolar pre-ribosomal-associated protein 1 (1994-2002)
SLYIKDIWL

SEQ ID NO: 14347 - protein, 10 aa, Artificial Sequence
  Endoplasmin (71-80)
SLYKNKEIFL

SEQ ID NO: 14348 - protein, 9 aa, Artificial Sequence
  Probable ATP-dependent RNA helicase DDX59 (525-533)
SMDEYVHQI

SEQ ID NO: 14349 - protein, 12 aa, Artificial Sequence
  Zinc finger protein 841 (58-69)
SMLEQGKEPWTV

SEQ ID NO: 14350 - protein, 9 aa, Artificial Sequence
  E3 ubiquitin-protein ligase UBR2 (703-711)
SMMDPNHFL

SEQ ID NO: 14351 - protein, 9 aa, Artificial Sequence
  Neuroblast differentiation-associated protein AHNAK (323-331)
SMSEVDLNV

SEQ ID NO: 14352 - protein, 9 aa, Artificial Sequence
  Unhealthy ribosome biogenesis protein 2 homolog (629-637)
SMSGPLIGV

SEQ ID NO: 14353 - protein, 11 aa, Artificial Sequence
  Desmoplakin (1673-1683)
SMVEDITGLRL

SEQ ID NO: 14354 - protein, 13 aa, Artificial Sequence
  Aminoacyl tRNA synthase complex-interacting multifunctional protein 1 (90-102)
SMVSENVIQSTAV

SEQ ID NO: 14355 - protein, 9 aa, Artificial Sequence
  Poly (ADP-ribose) polymerase 4 (1186-1194)
SPFPDIPKV

SEQ ID NO: 14356 - protein, 9 aa, Artificial Sequence
  Neuroblast differentiation-associated protein AHNAK (1150-1158)
SPKGKFSLF

SEQ ID NO: 14357 - protein, 10 aa, Artificial Sequence
  Cohesin subunit SA-1 (459-468)
SPNGNLIRML

SEQ ID NO: 14358 - protein, 9 aa, Artificial Sequence
  Neural Wiskott-Aldrich syndrome protein (82-90)
SPRGYFHTF

SEQ ID NO: 14359 - protein, 9 aa, Artificial Sequence
  Collagen alpha-1(VII) chain (586-594)
SPRVPSIEL

SEQ ID NO: 14360 - protein, 9 aa, Artificial Sequence
  Microtubule-associated protein 4 (280-288)
SPTKLDVTL

SEQ ID NO: 14361 - protein, 9 aa, Artificial Sequence
  Kelch repeat and BTB domain-containing protein 2 (594-602)
SPWKPPTYL

SEQ ID NO: 14362 - protein, 9 aa, Artificial Sequence
  Molybdenum cofactor sulfurase (515-523)
SQADVIPAV

SEQ ID NO: 14363 - protein, 9 aa, Artificial Sequence
  Protein FAM63A (74-82)
SSAPPGPTL

SEQ ID NO: 14364 - protein, 9 aa, Artificial Sequence
  Coatomer subunit gamma-2 (186-194)
SSDNIMVQY

SEQ ID NO: 14365 - protein, 10 aa, Artificial Sequence
  Oxysterol-binding protein-related protein 8 (244-253)
SSDSTHVTFY

SEQ ID NO: 14366 - protein, 11 aa, Artificial Sequence
  RNA-binding protein with multiple splicing 2 (84-94)
SSDTTQQGWKY

SEQ ID NO: 14367 - protein, 9 aa, Artificial Sequence
  Discoidin domain-containing receptor 2 (676-684)
SSDVRTVSY

SEQ ID NO: 14368 - protein, 14 aa, Artificial Sequence
  RNA-binding protein EWS (265-278)
SSFRQDHPSSMGVY

SEQ ID NO: 14369 - protein, 9 aa, Artificial Sequence
  Bromodomain and WD repeat-containing protein 1 (343-351)
STDHVIRMY

SEQ ID NO: 14370 - protein, 10 aa, Artificial Sequence
  Integrin alpha-5 (179-188)
STDNFTRILE

SEQ ID NO: 14371 - protein, 9 aa, Artificial Sequence
  Actin filament-associated protein 1 (443-451)
STDPEALHY

SEQ ID NO: 14372 - protein, 11 aa, Artificial Sequence
  Eukaryotic translation initiation factor 2A (26-36)
STDVDKTGASY

SEQ ID NO: 14373 - protein, 10 aa, Artificial Sequence
  NADH dehydrogenase (ubiquinone) iron-sulfur protein 8, mitochondrial (174-183)
STETHEELLY

SEQ ID NO: 14374 - protein, 13 aa, Artificial Sequence
  Src substrate cortactin (285-297)
STFEDVTQVSSAY

SEQ ID NO: 14375 - protein, 10 aa, Artificial Sequence
  Protein Smaug homolog 1 (46-55)
SVDYGQTHYY

SEQ ID NO: 14376 - protein, 9 aa, Artificial Sequence
  Eukaryotic peptide chain release factor subunit 1 (70-78)
SVLGAITSV

SEQ ID NO: 14377 - protein, 10 aa, Artificial Sequence
  Elongation factor 2 (500-509)
SVSPVVRVAV

SEQ ID NO: 14378 - protein, 9 aa, Artificial Sequence
  Serum paraoxonase/arylesterase 2 (334-342)
SVYDGKLLI

SEQ ID NO: 14379 - protein, 11 aa, Artificial Sequence
  Renin receptor (47-57)
SWPGLAVGNLF

SEQ ID NO: 14380 - protein, 9 aa, Artificial Sequence
  Short transient receptor potential channel 4-associated protein (540-548)
SYADQMFLL

SEQ ID NO: 14381 - protein, 9 aa, Artificial Sequence
  Ankyrin repeat and BTB/POZ domain-containing protein 2 (419-427)
SYAETPLQL

SEQ ID NO: 14382 - protein, 9 aa, Artificial Sequence
  Zinc-binding alcohol dehydrogenase domain-containing protein 2 (16-24)
SYARHFLDF

SEQ ID NO: 14383 - protein, 10 aa, Artificial Sequence
  Spatacsin (908-917)
SYASLQQNKW

SEQ ID NO: 14384 - protein, 10 aa, Artificial Sequence
  Tubulin polyglutamylase TTLL4 (773-782)
SYDPLRIYLF

SEQ ID NO: 14385 - protein, 9 aa, Artificial Sequence
  Kinectin (1090-1098)
SYGEWLHGF

SEQ ID NO: 14386 - protein, 9 aa, Artificial Sequence
  Serine/threonine-protein kinase 3 (65-73)
SYGSVFKAI

SEQ ID NO: 14387 - protein, 9 aa, Artificial Sequence
  Ubiquitin-like modifier-activating enzyme 1 (921-929)
SYKNGFLNL

SEQ ID NO: 14388 - protein, 9 aa, Artificial Sequence
  Unconventional myosin-Va (78-86)
SYLHEPAVL

SEQ ID NO: 14389 - protein, 9 aa, Artificial Sequence
  Actin-related protein 10 (66-74)
SYLKEFIHI

SEQ ID NO: 14390 - protein, 9 aa, Artificial Sequence
  Kelch-like protein 15 (402-410)
SYNGKLYVF

SEQ ID NO: 14391 - protein, 11 aa, Artificial Sequence
  Coatomer subunit alpha (369-379)
SYNPAENAVLL

SEQ ID NO: 14392 - protein, 9 aa, Artificial Sequence
  Protein artemis (321-329)
SYSEIKDFL

SEQ ID NO: 14393 - protein, 9 aa, Artificial Sequence
  Zinc finger protein 24 (343-351)
SYSQSSNLF

SEQ ID NO: 14394 - protein, 9 aa, Artificial Sequence
  Melanoma-associated antigen 3 (282-290)
SYVKVLHHM

SEQ ID NO: 14395 - protein, 9 aa, Artificial Sequence
  Basement membrane-specific heparan sulfate proteoglycan core protein (176-184)
SYVTSPQGF

SEQ ID NO: 14396 - protein, 9 aa, Artificial Sequence
  Cell differentiation protein RCD1 homolog (6-14)
TAAPVPTTL

SEQ ID NO: 14397 - protein, 9 aa, Artificial Sequence
  Protein PRRC2C (2488-2496)
TAIHNFPTV

SEQ ID NO: 14398 - protein, 9 aa, Artificial Sequence
  Lipoma-preferred partner (284-292)
TAMDQVFHV

SEQ ID NO: 14399 - protein, 9 aa, Artificial Sequence
  Integrator complex subunit 1 (301-309)
TATMHILVV

SEQ ID NO: 14400 - protein, 9 aa, Artificial Sequence
  Histone-lysine N-methyltransferase 2C (316-324)
TFQDFSHIF

SEQ ID NO: 14401 - protein, 9 aa, Artificial Sequence
  Probable ATP-dependent RNA helicase DDX27 (430-438)
TFTDHVMLF

SEQ ID NO: 14402 - protein, 9 aa, Artificial Sequence
  Zinc finger protein RFP (458-466)
TFTFSHATF

SEQ ID NO: 14403 - protein, 9 aa, Artificial Sequence
  WD repeat-containing protein 61 (32-40)
THVGKVNIF

SEQ ID NO: 14404 - protein, 9 aa, Artificial Sequence
  Very-long-chain enoyl-CoA reductase (28-36)
TIAEIKNLF

SEQ ID NO: 14405 - protein, 9 aa, Artificial Sequence
  Heat shock-related 70 kDa protein 2 (214-222)
TIEDGIFEV

SEQ ID NO: 14406 - protein, 9 aa, Artificial Sequence
  40S ribosomal protein S4, X isoform (127-135)
TIRYPDPLI

SEQ ID NO: 14407 - protein, 9 aa, Artificial Sequence
  Protein FAM73A (584-592)
TLAEDLMQL

SEQ ID NO: 14408 - protein, 11 aa, Artificial Sequence
  Calmodulin-regulated spectrin-associated protein 1 (102-112)
TLAELQPPVQL

SEQ ID NO: 14409 - protein, 9 aa, Artificial Sequence
  Importin-4 (587-595)
TLAETIQGL

SEQ ID NO: 14410 - protein, 9 aa, Artificial Sequence
  E3 ubiquitin-protein ligase UBR4 (345-353)
TLDAAISKV

SEQ ID NO: 14411 - protein, 9 aa, Artificial Sequence
  Molybdenum cofactor sulfurase (474-482)
TLDDVQAFL

SEQ ID NO: 14412 - protein, 9 aa, Artificial Sequence
  Solute carrier family 23 member 2 (493-501)
TLFGMITAV

SEQ ID NO: 14413 - protein, 11 aa, Artificial Sequence
  Putative elongation factor 1-alpha-like 3 (142-152)
TLGVKQLIVGV

SEQ ID NO: 14414 - protein, 9 aa, Artificial Sequence
  Dynactin subunit 1 (646-654)
TLHRYEHAL

SEQ ID NO: 14415 - protein, 10 aa, Artificial Sequence
  60S acidic ribosomal protein P0 (50-59)
TLHSRFLEGV

SEQ ID NO: 14416 - protein, 9 aa, Artificial Sequence
  Peptidyl-prolyl cis-trans isomerase FKBP9 (457-465)
TLLDSTWNL

SEQ ID NO: 14417 - protein, 10 aa, Artificial Sequence
  Midasin (3030-3039)
TLLEVGQIAV

SEQ ID NO: 14418 - protein, 10 aa, Artificial Sequence
  Puromycin-sensitive aminopeptidase (786-795)
TLLPDLIQKV

SEQ ID NO: 14419 - protein, 11 aa, Artificial Sequence
  116 kDa U5 small nuclear ribonucleoprotein component (103-113)
TLMEQTLPVTV

SEQ ID NO: 14420 - protein, 9 aa, Artificial Sequence
  SH3 domain-binding glutamic acid-rich-like protein 3 (218-226)
TLQEFLKLA

SEQ ID NO: 14421 - protein, 9 aa, Artificial Sequence
  Zinc finger BED domain-containing protein 5 (529-537)
TLSDFLTEI

SEQ ID NO: 14422 - protein, 9 aa, Artificial Sequence
  Elongation protein 4 homolog (S. cerevisiae), isoform CRA_b (319-327)
TLSDVVVGL

SEQ ID NO: 14423 - protein, 9 aa, Artificial Sequence
  Protein MON2 homolog (629-637)
TLSNKSYSV

SEQ ID NO: 14424 - protein, 13 aa, Artificial Sequence
  Malate dehydrogenase, mitochondrial (54-66)
TLYDIAHTPGVAA

SEQ ID NO: 14425 - protein, 9 aa, Artificial Sequence
  Cyclic AMP-dependent transcription factor ATF-6 beta (30-38)
TLYSGLDEV

SEQ ID NO: 14426 - protein, 10 aa, Artificial Sequence
  NAD(P)H dehydrogenase (quinone) 1 (124-133)
TPADARIQIL

SEQ ID NO: 14427 - protein, 9 aa, Artificial Sequence
  Dual specificity protein phosphatase 4 (356-364)
TPATPTSQF

SEQ ID NO: 14428 - protein, 9 aa, Artificial Sequence
  Cytoplasmic dynein 1 heavy chain 1 (264-272)
TPRIQGLTV

SEQ ID NO: 14429 - protein, 9 aa, Artificial Sequence
  Exostosin-2 (555-563)
TSDELQFGY

SEQ ID NO: 14430 - protein, 10 aa, Artificial Sequence
  Anoctamin-1 (662-671)
TSDFIPRLVY

SEQ ID NO: 14431 - protein, 11 aa, Artificial Sequence
  Actin-binding LIM protein 3 (350-360)
TSEDISQTSKY

SEQ ID NO: 14432 - protein, 11 aa, Artificial Sequence
  Serine/threonine-protein kinase MRCK alpha (699-709)
TSELDKLTTLY

SEQ ID NO: 14433 - protein, 10 aa, Artificial Sequence
  Catenin beta-1 (297-306)
TTDCLQILAY

SEQ ID NO: 14434 - protein, 10 aa, Artificial Sequence
  Junction plakoglobin (287-296)
TTDCLQLLAY

SEQ ID NO: 14435 - protein, 9 aa, Artificial Sequence
  ATP-dependent 6-phosphofructokinase, muscle type (251-259)
TTDFIFNLY

SEQ ID NO: 14436 - protein, 9 aa, Artificial Sequence
  Serine/threonine-protein kinase N2 (73-81)
TTDKKSLAY

SEQ ID NO: 14437 - protein, 9 aa, Artificial Sequence
  Heterogeneous nuclear ribonucleoprotein F (256-264)
TTDLFGRDL

SEQ ID NO: 14438 - protein, 10 aa, Artificial Sequence
  Heterogeneous nuclear ribonucleoprotein F (256-265)
TTDLFGRDLS

SEQ ID NO: 14439 - protein, 10 aa, Artificial Sequence
  Cofilin-1 (63-72)
TVDDPYATFV

SEQ ID NO: 14440 - protein, 9 aa, Artificial Sequence
  Heat shock cognate 71 kDa protein (138-146)
TVTNAVVTV

SEQ ID NO: 14441 - protein, 9 aa, Artificial Sequence
  Kelch-like protein 9 (442-450)
TVYGGLMYI

SEQ ID NO: 14442 - protein, 9 aa, Artificial Sequence
  Kelch-like protein 13 (468-476)
TVYGGVMYI

SEQ ID NO: 14443 - protein, 10 aa, Artificial Sequence
  60S ribosomal protein L13 (24-33)
TWFNQPARKI

SEQ ID NO: 14444 - protein, 11 aa, Artificial Sequence
  WD repeat-containing protein 35 (163-173)
TWSADSKVLLF

SEQ ID NO: 14445 - protein, 12 aa, Artificial Sequence
  26S protease regulatory subunit 4 (183-194)
TYADIGGLDNQI

SEQ ID NO: 14446 - protein, 9 aa, Artificial Sequence
  DNA replication licensing factor MCM3 (90-98)
TYAKQYEEF

SEQ ID NO: 14447 - protein, 9 aa, Artificial Sequence
  AT-rich interactive domain-containing protein 2 (938-946)
TYAPAIHQI

SEQ ID NO: 14448 - protein, 9 aa, Artificial Sequence
  Ataxin-2-like protein (167-175)
TYEGIFKTL

SEQ ID NO: 14449 - protein, 9 aa, Artificial Sequence
  Dedicator of cytokinesis protein 7 (588-596)
TYFDKNYNL

SEQ ID NO: 14450 - protein, 9 aa, Artificial Sequence
  Tubulin beta-6 chain (156-164)
TYGDLNHLV

SEQ ID NO: 14451 - protein, 9 aa, Artificial Sequence
  Cytoplasmic aconitate hydratase (542-550)
TYIKSPPFF

SEQ ID NO: 14452 - protein, 9 aa, Artificial Sequence
  Fanconi anemia group M protein (303-311)
TYIQILESF

SEQ ID NO: 14453 - protein, 9 aa, Artificial Sequence
  Protein FAM178B (655-663)
TYIRWQELL

SEQ ID NO: 14454 - protein, 9 aa, Artificial Sequence
  DNA-dependent protein kinase catalytic subunit (523-531)
TYKDYVDLF

SEQ ID NO: 14455 - protein, 9 aa, Artificial Sequence
  ETS translocation variant 3 (134-142)
TYKFNFNKL

SEQ ID NO: 14456 - protein, 11 aa, Artificial Sequence
  Leucine-rich repeat-containing protein 58 (257-267)
TYLPREILNLI

SEQ ID NO: 14457 - protein, 10 aa, Artificial Sequence
  Eukaryotic translation initiation factor 3 subunit I (47-56)
TYMGHTGAVW

SEQ ID NO: 14458 - protein, 9 aa, Artificial Sequence
  F-box only protein 38 (157-165)
TYMPHVHIL

SEQ ID NO: 14459 - protein, 10 aa, Artificial Sequence
  Protein polybromo-1 (261-270)
TYNEPGSQVF

SEQ ID NO: 14460 - protein, 10 aa, Artificial Sequence
  Cell division cycle and apoptosis regulator protein 1 (191-200)
TYNPNMPFKW

SEQ ID NO: 14461 - protein, 9 aa, Artificial Sequence
  Cell cycle control protein 50A (296-304)
TYNYPVHYF

SEQ ID NO: 14462 - protein, 9 aa, Artificial Sequence
  Aryl hydrocarbon receptor (47-55)
TYPAELNNI

SEQ ID NO: 14463 - protein, 9 aa, Artificial Sequence
  Elongation factor 1-gamma (5-13)
TYPENWRAF

SEQ ID NO: 14464 - protein, 9 aa, Artificial Sequence
  Pre-mRNA-processing-splicing factor 8 (224-232)
TYQRWQFTL

SEQ ID NO: 14465 - protein, 9 aa, Artificial Sequence
  Helicase SKI2W (746-754)
TYTMILNLL

SEQ ID NO: 14466 - protein, 9 aa, Artificial Sequence
  U5 small nuclear ribonucleoprotein 200 kDa helicase (604-612)
TYTQLVRLI

SEQ ID NO: 14467 - protein, 9 aa, Artificial Sequence
  Catenin beta-1 (330-338)
TYTYEKLLW

SEQ ID NO: 14468 - protein, 9 aa, Artificial Sequence
  Alanine-tRNA ligase, cytoplasmic (24-32)
TYVHSSATI

SEQ ID NO: 14469 - protein, 9 aa, Artificial Sequence
  E3 ubiquitin-protein ligase RNF213 (931-939)
TYVKEIEVW

SEQ ID NO: 14470 - protein, 9 aa, Artificial Sequence
  tRNA wybutosine-synthesizing protein 4 (507-515)
TYVPWPLML

SEQ ID NO: 14471 - protein, 9 aa, Artificial Sequence
  Cholinephosphotransferase 1 (178-186)
TYVSGMLRF

SEQ ID NO: 14472 - protein, 9 aa, Artificial Sequence
  Kinectin (1222-1230)
TYVTEVREL

SEQ ID NO: 14473 - protein, 9 aa, Artificial Sequence
  Renin receptor (97-105)
VANSIHSLF

SEQ ID NO: 14474 - protein, 9 aa, Artificial Sequence
  Elongation factor 1-alpha 1 (433-441)
VAVGVIKAV

SEQ ID NO: 14475 - protein, 9 aa, Artificial Sequence
  Glycogen synthase kinase-3 alpha (117-125)
VAYTDIKVI

SEQ ID NO: 14476 - protein, 9 aa, Artificial Sequence
  Influenza virus NS1A-binding protein (484-492)
VFDPVTKLW

SEQ ID NO: 14477 - protein, 13 aa, Artificial Sequence
  Cathepsin D (178-190)
VFGEATKQPGITF

SEQ ID NO: 14478 - protein, 10 aa, Artificial Sequence
  Pre-mRNA-processing factor 19 (271-280)
VFHPSQDLVF

SEQ ID NO: 14479 - protein, 9 aa, Artificial Sequence
  Heterogeneous nuclear ribonucleoprotein C-like 1 (18-26)
VFIGNLNTL

SEQ ID NO: 14480 - protein, 11 aa, Artificial Sequence
  Tectonic-3 (150-160)
VFMDSNGIRQF

SEQ ID NO: 14481 - protein, 10 aa, Artificial Sequence
  Serine/threonine-protein kinase N2 (753-762)
VFSEPRAVFY

SEQ ID NO: 14482 - protein, 9 aa, Artificial Sequence
  Paired amphipathic helix protein Sin3b (212-220)
VFTEVANLF

SEQ ID NO: 14483 - protein, 11 aa, Artificial Sequence
  Cytospin-A (478-488)
VIDEDVKSGRY

SEQ ID NO: 14484 - protein, 9 aa, Artificial Sequence
  Bifunctional glutamate/proline-tRNA ligase (506-514)
VIDPVAPRY

SEQ ID NO: 14485 - protein, 10 aa, Artificial Sequence
  Zinc finger protein 638 (208-217)
VIDYGHASKY

SEQ ID NO: 14486 - protein, 9 aa, Artificial Sequence
  DNA replication licensing factor MCM4 (151-159)
VIWGTDVNV

SEQ ID NO: 14487 - protein, 9 aa, Artificial Sequence
  Eukaryotic initiation factor 4A-II (181-189)
VLDEADEML

SEQ ID NO: 14488 - protein, 9 aa, Artificial Sequence
  Protein VPRBP (540-548)
VLDEAGSTV

SEQ ID NO: 14489 - protein, 9 aa, Artificial Sequence
  Protein ELYS (1430-1438)
VLDEGLTSV

SEQ ID NO: 14490 - protein, 11 aa, Artificial Sequence
  WD repeat-containing protein 48 (472-482)
VLDPNMDLRTV

SEQ ID NO: 14491 - protein, 11 aa, Artificial Sequence
  Acylamino-acid-releasing enzyme (226-236)
VLDVESGNISV

SEQ ID NO: 14492 - protein, 10 aa, Artificial Sequence
  Serine/threonine-protein kinase Sgk1 (270-279)
VLDYINGGEL

SEQ ID NO: 14493 - protein, 11 aa, Artificial Sequence
  Serine/threonine-protein kinase Sgk1 (270-280)
VLDYINGGELF

SEQ ID NO: 14494 - protein, 12 aa, Artificial Sequence
  Serine/threonine-protein kinase Sgk1 (270-281)
VLDYINGGELFY

SEQ ID NO: 14495 - protein, 9 aa, Artificial Sequence
  RNA-binding protein 34 (333-341)
VLFENTDSV

SEQ ID NO: 14496 - protein, 10 aa, Artificial Sequence
  Major prion protein (233-242)
VLFSSPPVIL

SEQ ID NO: 14497 - protein, 9 aa, Artificial Sequence
  Protein transport protein Sec16A (1388-1396)
VLIGSNHSL

SEQ ID NO: 14498 - protein, 9 aa, Artificial Sequence
  ATP-binding cassette sub-family D member 3 (541-549)
VLKEYLDNV

SEQ ID NO: 14499 - protein, 10 aa, Artificial Sequence
  Phosphotriesterase-related protein (148-157)
VLMNEILHGA

SEQ ID NO: 14500 - protein, 11 aa, Artificial Sequence
  Eukaryotic translation initiation factor 4 gamma 1 (187-197)
VLMNQPPQIAP

SEQ ID NO: 14501 - protein, 9 aa, Artificial Sequence
  GDP-L-fucose synthase (187-195)
VLPGLIHKV

SEQ ID NO: 14502 - protein, 9 aa, Artificial Sequence
  CCR4-NOT transcription complex subunit 4 (471-479)
VLPQRFPQF

SEQ ID NO: 14503 - protein, 9 aa, Artificial Sequence
  Mini-chromosome maintenance complex-binding protein (204-212)
VLPSVLNKF

SEQ ID NO: 14504 - protein, 10 aa, Artificial Sequence
  Fatty acid synthase (1496-1505)
VLQGDLVMNV

SEQ ID NO: 14505 - protein, 9 aa, Artificial Sequence
  Coatomer subunit alpha (130-138)
VLTGHNHYV

SEQ ID NO: 14506 - protein, 9 aa, Artificial Sequence
  Protein O-GlcNAcase (247-255)
VLWTGPKVV

SEQ ID NO: 14507 - protein, 11 aa, Artificial Sequence
  Integral membrane protein 2C (51-61)
VLYEDSLSSQV

SEQ ID NO: 14508 - protein, 9 aa, Artificial Sequence
  Deoxynucleotidyltransferase terminal-interacting protein 2 (359-367)
VMKSLTQTF

SEQ ID NO: 14509 - protein, 10 aa, Artificial Sequence
  Protein C-ets-2 (78-87)
VMSQALKATF

SEQ ID NO: 14510 - protein, 8 aa, Artificial Sequence
  ER membrane protein complex subunit 1 (192-199)
VPFSHVNI

SEQ ID NO: 14511 - protein, 9 aa, Artificial Sequence
  ER membrane protein complex subunit 1 (192-200)
VPFSHVNIV

SEQ ID NO: 14512 - protein, 8 aa, Artificial Sequence
  Interferon-induced 35 kDa protein (52-59)
VPFSVPKI

SEQ ID NO: 14513 - protein, 9 aa, Artificial Sequence
  Protein transport protein Sec16A (69-77)
VPHFPTPSI

SEQ ID NO: 14514 - protein, 10 aa, Artificial Sequence
  Filamin-A (436-445)
VPIPRSPYTV

SEQ ID NO: 14515 - protein, 9 aa, Artificial Sequence
  Tubulin alpha-1C chain (394-402)
VPKDVNAAI

SEQ ID NO: 14516 - protein, 9 aa, Artificial Sequence
  Helicase with zinc finger domain 2 (656-664)
VPVGFFSHI

SEQ ID NO: 14517 - protein, 9 aa, Artificial Sequence
  RNA-binding protein NOB1 (300-308)
VSDDGTLHM

SEQ ID NO: 14518 - protein, 11 aa, Artificial Sequence
  rRNA 2'-O-methyltransferase fibrillarin (174-184)
VSDIVGPDGLV

SEQ ID NO: 14519 - protein, 10 aa, Artificial Sequence
  Glyoxalase domain-containing protein 4 (145-154)
VSDLQKSLNY

SEQ ID NO: 14520 - protein, 9 aa, Artificial Sequence
  Tripeptidyl-peptidase 1 (68-76)
VSDPSSPQY

SEQ ID NO: 14521 - protein, 9 aa, Artificial Sequence
  DENN domain-containing protein 1B (677-685)
VSDPTSGLD

SEQ ID NO: 14522 - protein, 10 aa, Artificial Sequence
  DENN domain-containing protein 1B (677-686)
VSDPTSGLDF

SEQ ID NO: 14523 - protein, 11 aa, Artificial Sequence
  Liprin-beta-1 (207-217)
VSEMDSERLQY

SEQ ID NO: 14524 - protein, 9 aa, Artificial Sequence
  DnaJ homolog subfamily B member 12 (287-295)
VTDHLGVVY

SEQ ID NO: 14525 - protein, 9 aa, Artificial Sequence
  Selenocysteine insertion sequence-binding protein 2 (645-653)
VTDLLKELV

SEQ ID NO: 14526 - protein, 9 aa, Artificial Sequence
  Disabled homolog 2 (128-136)
VTDNRAFGY

SEQ ID NO: 14527 - protein, 9 aa, Artificial Sequence
  Integrin beta-1 (77-85)
VTEEFQPVY

SEQ ID NO: 14528 - protein, 11 aa, Artificial Sequence
  Neutral alpha-glucosidase AB (29-39)
VTEGGEPYRLY

SEQ ID NO: 14529 - protein, 9 aa, Artificial Sequence
  Cohesin subunit SA-1 (101-109)
VVDDWIESY

SEQ ID NO: 14530 - protein, 10 aa, Artificial Sequence
  Tubulin-tyrosine ligase (13-22)
VYAEVSRLLL

SEQ ID NO: 14531 - protein, 9 aa, Artificial Sequence
  E3 ubiquitin-protein ligase MARCH6 (744-752)
VYANGIRNI

SEQ ID NO: 14532 - protein, 9 aa, Artificial Sequence
  Enoyl-CoA delta isomerase 2, mitochondrial (230-238)
VYASDRATF

SEQ ID NO: 14533 - protein, 9 aa, Artificial Sequence
  Receptor tyrosine-protein kinase erbB-3 (110-118)
VYDGKFAIF

SEQ ID NO: 14534 - protein, 9 aa, Artificial Sequence
  SRR1-like protein (178-186)
VYDPLFSQL

SEQ ID NO: 14535 - protein, 11 aa, Artificial Sequence
  Prolow-density lipoprotein receptor-related protein 1 (736-746)
VYEGPELNHAF

SEQ ID NO: 14536 - protein, 10 aa, Artificial Sequence
  Partitioning defective 3 homolog B (682-691)
VYFPDQHINF

SEQ ID NO: 14537 - protein, 9 aa, Artificial Sequence
  Exocyst complex component 6B (452-460)
VYGFPVNQL

SEQ ID NO: 14538 - protein, 11 aa, Artificial Sequence
  Phosphatidylinositol-binding clathrin assembly protein (87-97)
VYGNERFIQYL

SEQ ID NO: 14539 - protein, 9 aa, Artificial Sequence
  Alanine-tRNA ligase, cytoplasmic (92-100)
VYHHTFFEM

SEQ ID NO: 14540 - protein, 9 aa, Artificial Sequence
  Elongator complex protein 1 (1236-1244)
VYHILKVLF

SEQ ID NO: 14541 - protein, 9 aa, Artificial Sequence
  Sterol regulatory element-binding protein cleavage-activating protein (751-759)
VYIDQTMVL

SEQ ID NO: 14542 - protein, 9 aa, Artificial Sequence
  Prelamin-A/C (44-52)
VYIDRVRSL

SEQ ID NO: 14543 - protein, 9 aa, Artificial Sequence
  F-box only protein 42 (181-189)
VYKDLLVLF

SEQ ID NO: 14544 - protein, 9 aa, Artificial Sequence
  mRNA cap guanine-N7 methyltransferase (390-398)
VYKKTFLEF

SEQ ID NO: 14545 - protein, 9 aa, Artificial Sequence
  Kelch repeat and BTB domain-containing protein 6 (407-415)
VYKPAQNSW

SEQ ID NO: 14546 - protein, 9 aa, Artificial Sequence
  Brain-specific angiogenesis inhibitor 1-associated protein 2 (16-24)
VYKTIMEQF

SEQ ID NO: 14547 - protein, 9 aa, Artificial Sequence
  Polymerase I and transcript release factor (225-233)
VYKVPPFTF

SEQ ID NO: 14548 - protein, 9 aa, Artificial Sequence
  Sarcolemmal membrane-associated protein (22-30)
VYLDEPIKI

SEQ ID NO: 14549 - protein, 11 aa, Artificial Sequence
  Molybdenum cofactor sulfurase (50-60)
VYLDHAGATLF

SEQ ID NO: 14550 - protein, 10 aa, Artificial Sequence
  Plectin (3681-3690)
VYLPGSRQTL

SEQ ID NO: 14551 - protein, 9 aa, Artificial Sequence
  Nuclear nucleic acid-binding protein C1D (92-100)
VYMNRVKEI

SEQ ID NO: 14552 - protein, 9 aa, Artificial Sequence
  Pre-mRNA-splicing factor SPF27 (137-145)
VYNENLVHM

SEQ ID NO: 14553 - protein, 9 aa, Artificial Sequence
  Kelch-like protein 11 (473-481)
VYNPELDKW

SEQ ID NO: 14554 - protein, 9 aa, Artificial Sequence
  Kelch repeat and BTB domain-containing protein 6 (536-544)
VYNPVRAEW

SEQ ID NO: 14555 - protein, 11 aa, Artificial Sequence
  Zinc transporter ZIP6 (191-201)
VYNTVSEGTHF

SEQ ID NO: 14556 - protein, 10 aa, Artificial Sequence
  BAG family molecular chaperone regulator 3 (113-122)
VYPQPGMQRF

SEQ ID NO: 14557 - protein, 11 aa, Artificial Sequence
  3-ketodihydrosphingosine reductase (150-160)
VYPSRAVITTM

SEQ ID NO: 14558 - protein, 9 aa, Artificial Sequence
  Hemoglobin subunit gamma-2 (35-43)
VYPWTQRFF

SEQ ID NO: 14559 - protein, 9 aa, Artificial Sequence
  Nuclear factor of activated T-cells 5 (855-863)
VYQQTSHMM

SEQ ID NO: 14560 - protein, 9 aa, Artificial Sequence
  Anaphase-promoting complex subunit 2 (564-572)
VYSAGVYRL

SEQ ID NO: 14561 - protein, 11 aa, Artificial Sequence
  N-acetylgalactosamine kinase (311-321)
VYSEAARVLQF

SEQ ID NO: 14562 - protein, 9 aa, Artificial Sequence
  Zinc transporter 6 (62-70)
VYSFGFERL

SEQ ID NO: 14563 - protein, 9 aa, Artificial Sequence
  La-related protein 4 (319-327)
VYSIVPQSW

SEQ ID NO: 14564 - protein, 11 aa, Artificial Sequence
  Pre-mRNA-processing-splicing factor 8 (1177-1187)
VYSKDNPNLLF

SEQ ID NO: 14565 - protein, 9 aa, Artificial Sequence
  Condensin-2 complex subunit H2 (66-74)
VYSKKVEYL

SEQ ID NO: 14566 - protein, 9 aa, Artificial Sequence
  Zinc transporter 7 (318-326)
VYSLQEQHF

SEQ ID NO: 14567 - protein, 11 aa, Artificial Sequence
  Ribonuclease P protein subunit p30 (155-165)
VYSPAIKDSTM

SEQ ID NO: 14568 - protein, 9 aa, Artificial Sequence
  E3 ubiquitin-protein ligase MGRN1 (148-156)
VYSPKSPSL

SEQ ID NO: 14569 - protein, 9 aa, Artificial Sequence
  DDB1- and CUL4-associated factor 13 (310-318)
VYTGIDHHW

SEQ ID NO: 14570 - protein, 10 aa, Artificial Sequence
  Nuclear pore complex protein Nup153 (667-676)
VYTRPAISSF

SEQ ID NO: 14571 - protein, 9 aa, Artificial Sequence
  Tensin-2 (334-342)
VYTSGVYHI

SEQ ID NO: 14572 - protein, 9 aa, Artificial Sequence
  Pre-mRNA-processing-splicing factor 8 (809-817)
VYTTTVHWL

SEQ ID NO: 14573 - protein, 9 aa, Artificial Sequence
  Volume-regulated anion channel subunit LRRC8E (11-19)
VYVEKISFL

SEQ ID NO: 14574 - protein, 9 aa, Artificial Sequence
  Cleavage and polyadenylation specificity factor subunit 7 (127-135)
VYVGSFSWW

SEQ ID NO: 14575 - protein, 9 aa, Artificial Sequence
  Kinesin-like protein KIF3B (174-182)
VYVKDLSSF

SEQ ID NO: 14576 - protein, 9 aa, Artificial Sequence
  Cytochrome c oxidase assembly protein COX11, mitochondrial (223-231)
VYVLESWHL

SEQ ID NO: 14577 - protein, 9 aa, Artificial Sequence
  Splicing factor 3B subunit 1 (254-262)
VYWKIYNSI

SEQ ID NO: 14578 - protein, 9 aa, Artificial Sequence
  Dolichyl-diphosphooligosaccharide-proteinosyltransferase subunit 2 (453-461)
VYWTQLNMF

SEQ ID NO: 14579 - protein, 9 aa, Artificial Sequence
  Tripartite motif-containing protein 47 (182-190)
YADRALAFY

SEQ ID NO: 14580 - protein, 9 aa, Artificial Sequence
  Monocarboxylate transporter 1 (34-42)
YAFPKSITV

SEQ ID NO: 14581 - protein, 8 aa, Artificial Sequence
  DDB1- and CUL4-associated factor 4 (355-362)
YAYLPLHV

SEQ ID NO: 14582 - protein, 10 aa, Artificial Sequence
  Septin-9 (180-189)
YFIPATGHSL

SEQ ID NO: 14583 - protein, 9 aa, Artificial Sequence
  Serine/threonine-protein kinase ATR (1253-1261)
YFLPDHPEL

SEQ ID NO: 14584 - protein, 9 aa, Artificial Sequence
  Cytochrome c oxidase subunit 2 (113-121)
YGGLIFNSY

SEQ ID NO: 14585 - protein, 9 aa, Artificial Sequence
  Sterol O-acyltransferase 1 (161-169)
YIDEGRLVL

SEQ ID NO: 14586 - protein, 9 aa, Artificial Sequence
  Unconventional myosin-Ic (44-52)
YIGPVLVSV

SEQ ID NO: 14587 - protein, 9 aa, Artificial Sequence
  DENN domain-containing protein 5B (228-236)
YIHNILYEV

SEQ ID NO: 14588 - protein, 9 aa, Artificial Sequence
  Kinesin-like protein KIF1A (510-518)
YIKDGITRV

SEQ ID NO: 14589 - protein, 12 aa, Artificial Sequence
  Signal recognition particle 9 kDa protein (18-29)
YLADPMKARVVL

SEQ ID NO: 14590 - protein, 9 aa, Artificial Sequence
  Ras GTPase-activating-like protein IQGAP2 (898-906)
YLAKLIFQM

SEQ ID NO: 14591 - protein, 9 aa, Artificial Sequence
  Kinesin-like protein KIF13A (1108-1116)
YLDEQIKKV

SEQ ID NO: 14592 - protein, 9 aa, Artificial Sequence
  Metastasis-associated protein MTA3 (123-131)
YLDKEDTFF

SEQ ID NO: 14593 - protein, 8 aa, Artificial Sequence
  Guanine nucleotide-binding protein-like 3-like protein (294-301)
YLDKFIRL

SEQ ID NO: 14594 - protein, 9 aa, Artificial Sequence
  DNA topoisomerase 1 (723-731)
YLDPRITVA

SEQ ID NO: 14595 - protein, 10 aa, Artificial Sequence
  Proteasome activator complex subunit 3 (188-197)
YLDQISRYYI

SEQ ID NO: 14596 - protein, 12 aa, Artificial Sequence
  Lysosomal protective protein (125-136)
YLESPAGVGFSY

SEQ ID NO: 14597 - protein, 11 aa, Artificial Sequence
  ATP synthase F(0) complex subunit B1, mitochondrial (165-175)
YLFDVQRNNIA

SEQ ID NO: 14598 - protein, 12 aa, Artificial Sequence
  ATP synthase F(0) complex subunit B1, mitochondrial (165-176)
YLFDVQRNNIAM

SEQ ID NO: 14599 - protein, 9 aa, Artificial Sequence
  WD repeat-containing protein 81 (72-80)
YLFEPVAKA

SEQ ID NO: 14600 - protein, 9 aa, Artificial Sequence
  WD repeat and FYVE domain-containing protein 3 (158-166)
YLFFDLPHV

SEQ ID NO: 14601 - protein, 9 aa, Artificial Sequence
  LIM domain-containing protein ajuba (391-399)
YLFSGFQEA

SEQ ID NO: 14602 - protein, 9 aa, Artificial Sequence
  Heat shock cognate 71 kDa protein (134-142)
YLGKTVTNA

SEQ ID NO: 14603 - protein, 10 aa, Artificial Sequence
  Intraflagellar transport protein 172 homolog (461-470)
YLIDIKTIAI

SEQ ID NO: 14604 - protein, 9 aa, Artificial Sequence
  Ankyrin repeat domain-containing protein 17 (599-607)
YLLDYPNNL

SEQ ID NO: 14605 - protein, 10 aa, Artificial Sequence
  Ankyrin repeat domain-containing protein 17 (599-608)
YLLDYPNNLL

SEQ ID NO: 14606 - protein, 11 aa, Artificial Sequence
  Filamin-A (148-158)
YLLKDKGEYTL

SEQ ID NO: 14607 - protein, 9 aa, Artificial Sequence
  Condensin complex subunit 3 (370-378)
YLLSYIQSI

SEQ ID NO: 14608 - protein, 9 aa, Artificial Sequence
  UDP-glucose 6-dehydrogenase (143-151)
YLMDEGAHL

SEQ ID NO: 14609 - protein, 9 aa, Artificial Sequence
  L-lactate dehydrogenase A chain (172-180)
YLMGERLGV

SEQ ID NO: 14610 - protein, 12 aa, Artificial Sequence
  H/ACA ribonucleoprotein complex subunit 3 (6-17)
YLNEQGDRVYTL

SEQ ID NO: 14611 - protein, 9 aa, Artificial Sequence
  POZ-, AT hook-, and zinc finger-containing protein 1 (645-653)
YLNKHIQKV

SEQ ID NO: 14612 - protein, 9 aa, Artificial Sequence
  Structural maintenance of chromosomes protein 4 (748-756)
YLNVQVKEL

SEQ ID NO: 14613 - protein, 9 aa, Artificial Sequence
  Mitochondrial-processing peptidase subunit alpha (107-115)
YLSGIAHFL

SEQ ID NO: 14614 - protein, 9 aa, Artificial Sequence
  Gelsolin (409-417)
YLSSHIANV

SEQ ID NO: 14615 - protein, 9 aa, Artificial Sequence
  Protein S100-A10 (25-33)
YLTKEDLRV

SEQ ID NO: 14616 - protein, 10 aa, Artificial Sequence
  Plectin (73-82)
YLTNEGIAHL

SEQ ID NO: 14617 - protein, 11 aa, Artificial Sequence
  Mitochondrial carrier homolog 1 (278-288)
YLVDDSFSQAL

SEQ ID NO: 14618 - protein, 9 aa, Artificial Sequence
  Thimet oligopeptidase (612-620)
YLWSEVYSM

SEQ ID NO: 14619 - protein, 12 aa, Artificial Sequence
  SWI/SNF-related matrix-associated actin-dependent regulator of chromatin subfamily A containing DEAD/H box 1 (108-119)
YLYQEGNNGPHL

SEQ ID NO: 14620 - protein, 9 aa, Artificial Sequence
  Transcriptional enhancer factor TEF-3 (369-377)
YMINFIHKL

SEQ ID NO: 14621 - protein, 8 aa, Artificial Sequence
  Pterin-4-alpha-carbinolamine dehydratase (70-77)
YNKVHITL

SEQ ID NO: 14622 - protein, 8 aa, Artificial Sequence
  Mid1-interacting protein 1 (7-14)
YNQKHSLF

SEQ ID NO: 14623 - protein, 9 aa, Artificial Sequence
  Phosducin-like protein 3 (158-166)
YPDRNLPTI

SEQ ID NO: 14624 - protein, 11 aa, Artificial Sequence
  Lipase maturation factor 2 (522-532)
YPFHKQPPTYV

SEQ ID NO: 14625 - protein, 8 aa, Artificial Sequence
  Ubiquitin-conjugating enzyme E2 K (66-73)
YPFNPPKV

SEQ ID NO: 14626 - protein, 12 aa, Artificial Sequence
  Dolichyl-diphosphooligosaccharide-proteinosyltransferase 48 kDa subunit (233-244)
YPHAVGKNTLLI

SEQ ID NO: 14627 - protein, 9 aa, Artificial Sequence
  Ganglioside-induced differentiation-associated protein 2 (176-184)
YPLEDATHI

SEQ ID NO: 14628 - protein, 9 aa, Artificial Sequence
  TFIIH basal transcription factor complex helicase XPD subunit (39-47)
YPLEVTKLI

SEQ ID NO: 14629 - protein, 9 aa, Artificial Sequence
  AP-2 complex subunit beta (421-429)
YPNKYESII

SEQ ID NO: 14630 - protein, 10 aa, Artificial Sequence
  BAG family molecular chaperone regulator 4 (184-193)
YPYGDGNRSV

SEQ ID NO: 14631 - protein, 11 aa, Artificial Sequence
  InaD-like protein (703-713)
YQDPLDPTRSV

SEQ ID NO: 14632 - protein, 11 aa, Artificial Sequence
  DNA mismatch repair protein Msh6 (977-987)
YQLEIPENFTT

SEQ ID NO: 14633 - protein, 9 aa, Artificial Sequence
  Ubiquitin-like-conjugating enzyme ATG3 (210-218)
YQTPRLWLF

SEQ ID NO: 14634 - protein, 9 aa, Artificial Sequence
  RNA binding protein fox-1 homolog 2 (317-325)
YSDGYGRVY

SEQ ID NO: 14635 - protein, 9 aa, Artificial Sequence
  Signal transducer and activator of transcription 3 (22-30)
YSDSFPMEL

SEQ ID NO: 14636 - protein, 10 aa, Artificial Sequence
  Protein TANC2 (62-71)
YSENVERTKY

SEQ ID NO: 14637 - protein, 8 aa, Artificial Sequence
  Putative heat shock protein HSP 90-beta 2 (33-40)
YSNKEIFL

SEQ ID NO: 14638 - protein, 11 aa, Artificial Sequence
  Probable E3 ubiquitin-protein ligase HECTD2 (624-634)
YTDFLLNKSIY

SEQ ID NO: 14639 - protein, 9 aa, Artificial Sequence
  Tight junction protein ZO-1 (1054-1062)
YTDQFSRNY

SEQ ID NO: 14640 - protein, 9 aa, Artificial Sequence
  RNA-binding protein FUS (324-332)
YTDRETGKL

SEQ ID NO: 14641 - protein, 10 aa, Artificial Sequence
  Cytochrome c oxidase subunit 2 (110-119)
YTDYGGLIFN

SEQ ID NO: 14642 - protein, 11 aa, Artificial Sequence
  Cytochrome c oxidase subunit 2 (110-120)
YTDYGGLIFNS

SEQ ID NO: 14643 - protein, 8 aa, Artificial Sequence
  Peroxisomal multifunctional enzyme type 2 (339-346)
YTELEAIM

SEQ ID NO: 14644 - protein, 9 aa, Artificial Sequence
  Peroxisomal multifunctional enzyme type 2 (339-347)
YTELEAIMY

SEQ ID NO: 14645 - protein, 9 aa, Artificial Sequence
  RNA-binding protein FUS (6-14)
YTQQATQSY

SEQ ID NO: 14646 - protein, 10 aa, Artificial Sequence
  F-box only protein 11 (224-233)
YTSYPMHDFY

SEQ ID NO: 14647 - protein, 9 aa, Artificial Sequence
  Zinc finger and BTB domain-containing protein 38 (794-802)
YVADPGGSL

SEQ ID NO: 14648 - protein, 8 aa, Artificial Sequence
  Bax inhibitor 1 (92-99)
YVHMVTHF

SEQ ID NO: 14649 - protein, 12 aa, Artificial Sequence
  Negative elongation factor E (265-276)
YVYGEDMTPTLL

SEQ ID NO: 14650 - protein, 9 aa, Artificial Sequence
  Medium-chain specific acyl-CoA dehydrogenase, mitochondrial (316-324)
YYASIAKAF

SEQ ID NO: 14651 - protein, 10 aa, Artificial Sequence
  Eukaryotic translation initiation factor 3 subunit A (275-284)
YYNKVSTVFW

SEQ ID NO: 14652 - protein, 11 aa, Artificial Sequence
  Importin-7 (763-773)
YYNPHLLLNTL

SEQ ID NO: 14653 - protein, 9 aa, Artificial Sequence
  Prenylcysteine oxidase 1 (220-228)
YYQHIVTTL

SEQ ID NO: 14654 - protein, 9 aa, Artificial Sequence
  Protein PAT1 homolog 1 (367-375)
YYQNYFEKL

SEQ ID NO: 14655 - protein, 9 aa, Artificial Sequence
  ATP-binding cassette sub-family F member 1 (528-536)
YYRGNYMTF

SEQ ID NO: 14656 - protein, 9 aa, Artificial Sequence
  Polypyrimidine tract-binding protein 2 (124-132)
YYSAVTPHL

SEQ ID NO: 14657 - protein, 9 aa, Artificial Sequence
  Eukaryotic translation initiation factor 2A (345-353)
YYSPHGHIL

SEQ ID NO: 14658 - protein, 9 aa, Artificial Sequence
  26S protease regulatory subunit 6B (111-119)
YYVRILSTI

SEQ ID NO: 14659 - protein, 11 aa, Artificial Sequence
  Glutathione peroxidase 1 (7-17)
AAAAAAAQSVY

SEQ ID NO: 14660 - protein, 9 aa, Artificial Sequence
  Interferon alpha-inducible protein 27-like protein 2 (6-14)
AAAAVGGAL

SEQ ID NO: 14661 - protein, 9 aa, Artificial Sequence
  Pumilio homolog 2 (304-312)
AAANPTLAF

SEQ ID NO: 14662 - protein, 9 aa, Artificial Sequence
  Angiomotin (918-926)
AAAPAAAAA

SEQ ID NO: 14663 - protein, 9 aa, Artificial Sequence
  RNA-binding protein 38 (217-225)
AAAPAGTTF

SEQ ID NO: 14664 - protein, 10 aa, Artificial Sequence
  Protein SON (246-255)
AAAPVPTTTL

SEQ ID NO: 14665 - protein, 9 aa, Artificial Sequence
  Kelch-like protein 7 (15-23)
AAASHFFNL

SEQ ID NO: 14666 - protein, 9 aa, Artificial Sequence
  Ephrin-A1 (167-175)
AADDPEVRV

SEQ ID NO: 14667 - protein, 9 aa, Artificial Sequence
  RNA-binding protein 4 (47-55)
AAEDAIRNL

SEQ ID NO: 14668 - protein, 9 aa, Artificial Sequence
  Death-associated protein kinase 3 (334-342)
AAEEGLREL

SEQ ID NO: 14669 - protein, 9 aa, Artificial Sequence
  Perilipin-3 (62-70)
AAEKGVRTL

SEQ ID NO: 14670 - protein, 8 aa, Artificial Sequence
  Ribosome-binding protein 1 (105-112)
AAFEKQVL

SEQ ID NO: 14671 - protein, 9 aa, Artificial Sequence
  Glycine dehydrogenase (decarboxylating), mitochondrial (969-977)
AAFPLPFVK

SEQ ID NO: 14672 - protein, 9 aa, Artificial Sequence
  DNA-directed RNA polymerase II subunit RPB1 (1495-1503)
AAGPTGMFF

SEQ ID NO: 14673 - protein, 9 aa, Artificial Sequence
  Programmed cell death protein 4 (282-290)
AALDKATVL

SEQ ID NO: 14674 - protein, 9 aa, Artificial Sequence
  Leucine-rich repeat-containing protein 59 (36-44)
AALPKATIL

SEQ ID NO: 14675 - protein, 9 aa, Artificial Sequence
  E3 ubiquitin-protein ligase BRE1B (225-233)
AAQAHTREL

SEQ ID NO: 14676 - protein, 11 aa, Artificial Sequence
  NEDD8-activating enzyme E1 regulatory subunit (495-505)
AAQEVIKIITK

SEQ ID NO: 14677 - protein, 9 aa, Artificial Sequence
  Protein FAM50A (7-15)
AASEAGRAM

SEQ ID NO: 14678 - protein, 9 aa, Artificial Sequence
  4F2 cell-surface antigen heavy chain (127-135)
AASGAAMSL

SEQ ID NO: 14679 - protein, 9 aa, Artificial Sequence
  Nuclear pore membraneoprotein 210 (1023-1031)
AASPIITLV

SEQ ID NO: 14680 - protein, 9 aa, Artificial Sequence
  Cirhin (108-116)
AASPSGSQL

SEQ ID NO: 14681 - protein, 9 aa, Artificial Sequence
  40S ribosomal protein SA (92-100)
AATGATPIA

SEQ ID NO: 14682 - protein, 9 aa, Artificial Sequence
  ELM2 and SANT domain-containing protein 1 (966-974)
AAVKATQTL

SEQ ID NO: 14683 - protein, 9 aa, Artificial Sequence
  UPF0668 protein C10orf76 (556-564)
AAVNHISQL

SEQ ID NO: 14684 - protein, 9 aa, Artificial Sequence
  Leucine-rich repeat and calponin homology domain-containing protein 3 (56-64)
AAVTGVLSL

SEQ ID NO: 14685 - protein, 9 aa, Artificial Sequence
  Synaptonemal complex protein SC65 (428-436)
AEAEPEPEL

SEQ ID NO: 14686 - protein, 9 aa, Artificial Sequence
  Rhotekin (187-195)
AEAGPDFEL

SEQ ID NO: 14687 - protein, 10 aa, Artificial Sequence
  Catenin alpha-1 (750-759)
AEAGSRMDKL

SEQ ID NO: 14688 - protein, 9 aa, Artificial Sequence
  Leucine-tRNA ligase, cytoplasmic (461-469)
AEAKEKIYL

SEQ ID NO: 14689 - protein, 12 aa, Artificial Sequence
  5'-AMP-activated protein kinase catalytic subunit alpha-1 (501-512)
AEAQGKSSEVSL

SEQ ID NO: 14690 - protein, 9 aa, Artificial Sequence
  Something about silencing protein 10 (119-127)
AEASVDPSL

SEQ ID NO: 14691 - protein, 11 aa, Artificial Sequence
  Mediator of DNA damage checkpoint protein 1 (431-441)
AEEDMPQRVVL

SEQ ID NO: 14692 - protein, 9 aa, Artificial Sequence
  NudC domain-containing protein 1 (175-183)
AEEHSIATL

SEQ ID NO: 14693 - protein, 9 aa, Artificial Sequence
  Peroxisome assembly protein 26 (71-79)
AEEPAGTSL

SEQ ID NO: 14694 - protein, 9 aa, Artificial Sequence
  Alpha-actinin-4 (804-812)
AEFNRIMSL

SEQ ID NO: 14695 - protein, 9 aa, Artificial Sequence
  Coatomer subunit beta' (333-341)
AEIKDGERL

SEQ ID NO: 14696 - protein, 11 aa, Artificial Sequence
  Stathmin (73-83)
AEKREHEKEVL

SEQ ID NO: 14697 - protein, 9 aa, Artificial Sequence
  Heat shock protein 105 kDa (311-319)
AELLQKIEV

SEQ ID NO: 14698 - protein, 9 aa, Artificial Sequence
  LisH domain-containing protein ARMC9 (557-565)
AEMIRQIEF

SEQ ID NO: 14699 - protein, 12 aa, Artificial Sequence
  V-type proton ATPase subunit C 1 (170-181)
AEMVVPRSSNVL

SEQ ID NO: 14700 - protein, 11 aa, Artificial Sequence
  Centromere protein F (2273-2283)
AENSKAEVETL

SEQ ID NO: 14701 - protein, 11 aa, Artificial Sequence
  Thioredoxin domain-containing protein 5 (207-217)
AEPEADKGTVL

SEQ ID NO: 14702 - protein, 11 aa, Artificial Sequence
  Cell cycle and apoptosis regulator protein 2 (303-313)
AEQQDSGRLYL

SEQ ID NO: 14703 - protein, 10 aa, Artificial Sequence
  AP-1 complex subunit beta-1 (188-197)
AESHPSSNLL

SEQ ID NO: 14704 - protein, 11 aa, Artificial Sequence
  Clathrin heavy chain 1 (493-503)
AETGQVQKIVL

SEQ ID NO: 14705 - protein, 13 aa, Artificial Sequence
  T-complex protein 1 subunit eta (76-88)
AEVGDGTTSVTLL

SEQ ID NO: 14706 - protein, 9 aa, Artificial Sequence
  Heterogeneous nuclear ribonucleoprotein M (129-137)
AEVLNKHSL

SEQ ID NO: 14707 - protein, 9 aa, Artificial Sequence
  X-box-binding protein 1 (28-36)
AGAPAGQAL

SEQ ID NO: 14708 - protein, 9 aa, Artificial Sequence
  Protein YIF1A (153-161)
AGMALGIQK

SEQ ID NO: 14709 - protein, 9 aa, Artificial Sequence
  PAB-dependent poly(A)-specific ribonuclease subunit PAN2 (870-878)
AHIKVGETY

SEQ ID NO: 14710 - protein, 9 aa, Artificial Sequence
  Coatomer subunit gamma-1 (45-53)
AHILTKILY

SEQ ID NO: 14711 - protein, 9 aa, Artificial Sequence
  Clathrin heavy chain 1 (1312-1320)
AHMGMFTEL

SEQ ID NO: 14712 - protein, 9 aa, Artificial Sequence
  Elongation factor 2 (491-499)
AHNMRVMKF

SEQ ID NO: 14713 - protein, 9 aa, Artificial Sequence
  Methionine-R-sulfoxide reductase B1 (38-46)
AHSSPWPAF

SEQ ID NO: 14714 - protein, 9 aa, Artificial Sequence
  Calcineurin-binding protein cabin-1 (1962-1970)
AHTKPRPAL

SEQ ID NO: 14715 - protein, 9 aa, Artificial Sequence
  Protein RTF2 homolog (296-304)
AHWVTHTSY

SEQ ID NO: 14716 - protein, 10 aa, Artificial Sequence
  Endoplasmic reticulum-Golgi intermediate compartment protein 2 (241-250)
AIDHNQMFQY

SEQ ID NO: 14717 - protein, 9 aa, Artificial Sequence
  E3 ubiquitin-protein ligase RNF135 (258-266)
AIHPTFNLK

SEQ ID NO: 14718 - protein, 9 aa, Artificial Sequence
  Proteasome subunit alpha type-2 (187-195)
AIHTAILTL

SEQ ID NO: 14719 - protein, 9 aa, Artificial Sequence
  All-trans-retinol 13,14-reductase (189-197)
AIIDKYIKL

SEQ ID NO: 14720 - protein, 9 aa, Artificial Sequence
  General transcription factor 3C polypeptide 3 (294-302)
AILDKNFRK

SEQ ID NO: 14721 - protein, 9 aa, Artificial Sequence
  AP-1 complex subunit beta-1 (487-495)
AIVKLFLKK

SEQ ID NO: 14722 - protein, 9 aa, Artificial Sequence
  Ribosomal RNA processing protein 36 homolog (221-229)
ALAEKFKEL

SEQ ID NO: 14723 - protein, 9 aa, Artificial Sequence
  Gem-associated protein 4 (288-296)
ALAEKVKEA

SEQ ID NO: 14724 - protein, 9 aa, Artificial Sequence
  Glycosylphosphatidylinositol anchor attachment 1 protein (584-592)
ALAQGVLEH

SEQ ID NO: 14725 - protein, 13 aa, Artificial Sequence
  Ankyrin repeat and KH domain-containing protein 1 (182-194)
ALDEAAAALTRMK

SEQ ID NO: 14726 - protein, 9 aa, Artificial Sequence
  Hexokinase-1 (530-538)
ALDLGGTNF

SEQ ID NO: 14727 - protein, 10 aa, Artificial Sequence
  N-acylneuraminate cytidylyltransferase (79-88)
ALDSGAFQSV

SEQ ID NO: 14728 - protein, 10 aa, Artificial Sequence
  EP300-interacting inhibitor of differentiation 1 (70-79)
ALEEADKMFL

SEQ ID NO: 14729 - protein, 10 aa, Artificial Sequence
  Zinc finger protein ZXDC (46-55)
ALFSDTPANA

SEQ ID NO: 14730 - protein, 9 aa, Artificial Sequence
  Dystonin (1368-1376)
ALFSKVLER

SEQ ID NO: 14731 - protein, 9 aa, Artificial Sequence
  Protein transport protein Sec23A (40-48)
ALFTPLKER

SEQ ID NO: 14732 - protein, 9 aa, Artificial Sequence
  PRKCA-binding protein (279-287)
ALGEPLYRV

SEQ ID NO: 14733 - protein, 9 aa, Artificial Sequence
  Talin-2 (171-179)
ALHDLLQHV

SEQ ID NO: 14734 - protein, 9 aa, Artificial Sequence
  Golgin subfamily A member 3 (270-278)
ALHERIQAL

SEQ ID NO: 14735 - protein, 9 aa, Artificial Sequence
  SURP and G-patch domain-containing protein 2 (429-437)
ALLGQTFSL

SEQ ID NO: 14736 - protein, 9 aa, Artificial Sequence
  E3 ubiquitin-protein ligase AMFR (24-32)
ALLGTIISA

SEQ ID NO: 14737 - protein, 10 aa, Artificial Sequence
  Tropomodulin-3 (44-53)
ALLPAGFRQK

SEQ ID NO: 14738 - protein, 12 aa, Artificial Sequence
  RNA-binding protein NOB1 (19-30)
ALQDIGKNIYTI

SEQ ID NO: 14739 - protein, 9 aa, Artificial Sequence
  Kinesin-1 heavy chain (666-674)
ALSEELVQL

SEQ ID NO: 14740 - protein, 10 aa, Artificial Sequence
  Syntaxin-8 (157-166)
ALSSIISRQK

SEQ ID NO: 14741 - protein, 9 aa, Artificial Sequence
  Protein RCC2 (151-159)
ALTETGSVF

SEQ ID NO: 14742 - protein, 9 aa, Artificial Sequence
  Zinc finger BED domain-containing protein 4 (250-258)
ALVGSSPHL

SEQ ID NO: 14743 - protein, 11 aa, Artificial Sequence
  Protein unc-93 homolog B1 (440-450)
ALWGVGSALNK

SEQ ID NO: 14744 - protein, 10 aa, Artificial Sequence
  Galectin-3-binding protein (184-193)
ALWKEPGSNV

SEQ ID NO: 14745 - protein, 9 aa, Artificial Sequence
  Fructose-bisphosphate aldolase A (132-140)
AMATVTALR

SEQ ID NO: 14746 - protein, 10 aa, Artificial Sequence
  Myosin-9 (1912-1921)
AMNREVSSLK

SEQ ID NO: 14747 - protein, 9 aa, Artificial Sequence
  NAD(P)H dehydrogenase (quinone) 1 (128-136)
AMYDKGPFR

SEQ ID NO: 14748 - protein, 9 aa, Artificial Sequence
  Type II inositol 3,4-bisphosphate 4-phosphatase (368-376)
APAAHFQGF

SEQ ID NO: 14749 - protein, 11 aa, Artificial Sequence
  Ankyrin repeat and zinc finger domain-containing protein 1 (4-14)
APDAAPAPASI

SEQ ID NO: 14750 - protein, 10 aa, Artificial Sequence
  E3 ubiquitin-protein ligase NEURL1B (119-128)
APRPDGGRTL

SEQ ID NO: 14751 - protein, 9 aa, Artificial Sequence
  40S ribosomal protein S4, Y isoform 1 (27-35)
APRPSTGPH

SEQ ID NO: 14752 - protein, 10 aa, Artificial Sequence
  60S ribosomal protein L36 (51-60)
APYERRAMEL

SEQ ID NO: 14753 - protein, 10 aa, Artificial Sequence
  PHD and RING finger domain-containing protein 1 (159-168)
AQFGGKILRK

SEQ ID NO: 14754 - protein, 11 aa, Artificial Sequence
  Cleavage stimulation factor subunit 3 (59-69)
AQFPSSGRFWK

SEQ ID NO: 14755 - protein, 10 aa, Artificial Sequence
  Transcription and mRNA export factor ENY2 (10-19)
AQMRAAINQK

SEQ ID NO: 14756 - protein, 9 aa, Artificial Sequence
  V-type proton ATPase 21 kDa proteolipid subunit (10-18)
AQNPSLFVK

SEQ ID NO: 14757 - protein, 8 aa, Artificial Sequence
  Myosin-9 (2-9)
AQQAADKY

SEQ ID NO: 14758 - protein, 9 aa, Artificial Sequence
  MICOS complex subunit MIC60 (196-204)
AQQEKQEQV

SEQ ID NO: 14759 - protein, 9 aa, Artificial Sequence
  Ubiquitin-like protein 5 (33-41)
AQTGTRWNK

SEQ ID NO: 14760 - protein, 9 aa, Artificial Sequence
  Cytochrome c oxidase assembly factor 3 homolog, mitochondrial (44-52)
AQWQKVLPR

SEQ ID NO: 14761 - protein, 9 aa, Artificial Sequence
  SUMO-activating enzyme subunit 1 (17-25)
AQYDRQIRL

SEQ ID NO: 14762 - protein, 9 aa, Artificial Sequence
  Poly(U)-binding-splicing factor PUF60 (204-212)
ARAFNRIYV

SEQ ID NO: 14763 - protein, 9 aa, Artificial Sequence
  Protein transport protein Sec61 subunit alpha isoform 1 (310-318)
ARFSGNLLV

SEQ ID NO: 14764 - protein, 9 aa, Artificial Sequence
  Ran GTPase-activating protein 1 (576-584)
ARHSLLQTL

SEQ ID NO: 14765 - protein, 11 aa, Artificial Sequence
  Probable RNA-binding protein 19 (488-498)
ASALGSSSYKK

SEQ ID NO: 14766 - protein, 9 aa, Artificial Sequence
  Polyadenylate-binding protein 1 (551-559)
ASAPPQEQK

SEQ ID NO: 14767 - protein, 9 aa, Artificial Sequence
  3'(2'),5'-bisphosphate nucleotidase 1 (13-21)
ASAYSIAQK

SEQ ID NO: 14768 - protein, 9 aa, Artificial Sequence
  WD repeat-containing protein 26 (616-624)
ASDDGTVRI

SEQ ID NO: 14769 - protein, 9 aa, Artificial Sequence
  WD repeat-containing protein 61 (115-123)
ASDDGYIKI

SEQ ID NO: 14770 - protein, 10 aa, Artificial Sequence
  Selenoprotein O (215-224)
ASDNTGRYAY

SEQ ID NO: 14771 - protein, 9 aa, Artificial Sequence
  Protein flightless-1 homolog (1107-1115)
ASDPDEAKL

SEQ ID NO: 14772 - protein, 10 aa, Artificial Sequence
  Transcription factor 20 (70-79)
ASETSGHQGY

SEQ ID NO: 14773 - protein, 11 aa, Artificial Sequence
  Zinc finger protein 622 (77-87)
ASFNAYENHLK

SEQ ID NO: 14774 - protein, 9 aa, Artificial Sequence
  LIM domain and actin-binding protein 1 (496-504)
ASFQSTSVK

SEQ ID NO: 14775 - protein, 11 aa, Artificial Sequence
  Origin recognition complex subunit 3 (514-524)
ASGSQPKGLQK

SEQ ID NO: 14776 - protein, 11 aa, Artificial Sequence
  Serine/threonine-protein phosphatase 6 regulatory ankyrin repeat subunit B (624-634)
ASIFVKDNVTK

SEQ ID NO: 14777 - protein, 11 aa, Artificial Sequence
  Serine/threonine-protein phosphatase 6 regulatory ankyrin repeat subunit A (637-647)
ASILVKDYILK

SEQ ID NO: 14778 - protein, 11 aa, Artificial Sequence
  39S ribosomal protein L22, mitochondrial (37-47)
ASLDISRKWEK

SEQ ID NO: 14779 - protein, 9 aa, Artificial Sequence
  Centrosome-associated protein 350 (95-103)
ASLIKQLEV

SEQ ID NO: 14780 - protein, 11 aa, Artificial Sequence
  Deoxynucleotidyltransferase terminal-interacting protein 2 (668-678)
ASMDPKRFYKK

SEQ ID NO: 14781 - protein, 11 aa, Artificial Sequence
  Myosin-10 (370-380)
ASMPENTVAQK

SEQ ID NO: 14782 - protein, 12 aa, Artificial Sequence
  Discoidin, CUB and LCCL domain-containing protein 2 (153-164)
ASNFLEPEFSKY

SEQ ID NO: 14783 - protein, 9 aa, Artificial Sequence
  Chromosome transmission fidelity protein 8 homolog isoform 2 (379-387)
ASNPATFQR

SEQ ID NO: 14784 - protein, 12 aa, Artificial Sequence
  Heterogeneous nuclear ribonucleoprotein H (160-171)
ASQEIAEKALKK

SEQ ID NO: 14785 - protein, 9 aa, Artificial Sequence
  Zinc finger protein 574 (226-234)
ASQELWLNH

SEQ ID NO: 14786 - protein, 9 aa, Artificial Sequence
  E3 ubiquitin-protein ligase MARCH7 (344-352)
ASQGFRFLR

SEQ ID NO: 14787 - protein, 9 aa, Artificial Sequence
  Ubiquitin-conjugating enzyme E2 T (183-191)
ASQLVGIEK

SEQ ID NO: 14788 - protein, 13 aa, Artificial Sequence
  Anthrax toxin receptor 2 (131-143)
ASYYGGRGVGGIK

SEQ ID NO: 14789 - protein, 9 aa, Artificial Sequence
  Transmembrane protein 147 (107-115)
ATAELIMSR

SEQ ID NO: 14790 - protein, 10 aa, Artificial Sequence
  Multifunctional protein ADE2 (2-11)
ATAEVLNIGK

SEQ ID NO: 14791 - protein, 11 aa, Artificial Sequence
  Clathrin heavy chain 1 (311-321)
ATAGIIGVNRK

SEQ ID NO: 14792 - protein, 9 aa, Artificial Sequence
  Cilia- and flagella-associated protein 58 (79-87)
ATALKLSQD

SEQ ID NO: 14793 - protein, 11 aa, Artificial Sequence
  Mitogen-activated protein kinase-binding protein 1 (686-696)
ATASPFSGLQK

SEQ ID NO: 14794 - protein, 9 aa, Artificial Sequence
  Glucosamine 6-phosphate N-acetyltransferase (99-107)
ATATLIIEH

SEQ ID NO: 14795 - protein, 9 aa, Artificial Sequence
  UPF0472 protein C16orf72 (67-75)
ATAVAQLYK

SEQ ID NO: 14796 - protein, 10 aa, Artificial Sequence
  NAD(P) transhydrogenase, mitochondrial (730-739)
ATDAAANLTK

SEQ ID NO: 14797 - protein, 11 aa, Artificial Sequence
  E3 ubiquitin-protein ligase RNF220 (291-301)
ATDDLHHSDRY

SEQ ID NO: 14798 - protein, 10 aa, Artificial Sequence
  Collagen alpha-1(XII) chain (183-192)
ATDPDDTHAY

SEQ ID NO: 14799 - protein, 9 aa, Artificial Sequence
  V-type proton ATPase 21 kDa proteolipid subunit (120-128)
ATDPKAIGH

SEQ ID NO: 14800 - protein, 9 aa, Artificial Sequence
  ATP-dependent RNA helicase DDX1 (614-622)
ATEKEKVWY

SEQ ID NO: 14801 - protein, 12 aa, Artificial Sequence
  Apoptosis inhibitor 5 (17-28)
ATEQVGQHKDAY

SEQ ID NO: 14802 - protein, 11 aa, Artificial Sequence
  Calcium-binding protein 39 (186-196)
ATFKDLLTRHK

SEQ ID NO: 14803 - protein, 10 aa, Artificial Sequence
  Serine/threonine-protein kinase OSR1 (172-181)
ATGGDITRNK

SEQ ID NO: 14804 - protein, 10 aa, Artificial Sequence
  Inositol-pentakisphosphate 2-kinase (170-179)
ATGKWKQISK

SEQ ID NO: 14805 - protein, 10 aa, Artificial Sequence
  DNA-directed RNA polymerase II subunit RPB2 (442-451)
ATGNWGDQKK

SEQ ID NO: 14806 - protein, 9 aa, Artificial Sequence
  Plexin-B2 (68-76)
ATGPALDNK

SEQ ID NO: 14807 - protein, 9 aa, Artificial Sequence
  General transcription factor IIH subunit 2 (32-40)
ATIEDILFK

SEQ ID NO: 14808 - protein, 11 aa, Artificial Sequence
  Polycomb group RING finger protein 6 (210-220)
ATIGHVEKFLR

SEQ ID NO: 14809 - protein, 11 aa, Artificial Sequence
  Isocitrate dehydrogenase (NAD) subunit alpha, mitochondrial (333-343)
ATIKDGKSLTK

SEQ ID NO: 14810 - protein, 9 aa, Artificial Sequence
  Protein MMS22-like (831-839)
ATIPPISSL

SEQ ID NO: 14811 - protein, 10 aa, Artificial Sequence
  Ankyrin repeat and KH domain-containing protein 1 (1428-1437)
ATITDKELLK

SEQ ID NO: 14812 - protein, 11 aa, Artificial Sequence
  Ankyrin repeat and KH domain-containing protein 1 (1428-1438)
ATITDKELLKK

SEQ ID NO: 14813 - protein, 11 aa, Artificial Sequence
  Ankyrin repeat domain-containing protein 17 (1306-1316)
ATITDKEMLKK

SEQ ID NO: 14814 - protein, 10 aa, Artificial Sequence
  HAUS augmin-like complex subunit 7 (418-427)
ATKMNELMEK

SEQ ID NO: 14815 - protein, 9 aa, Artificial Sequence
  E3 SUMO-protein ligase NSE2 (69-77)
ATLDRQLNH

SEQ ID NO: 14816 - protein, 11 aa, Artificial Sequence
  PIN2/TERF1-interacting telomerase inhibitor 1 (312-322)
ATLEETLVKKK

SEQ ID NO: 14817 - protein, 11 aa, Artificial Sequence
  Coatomer subunit beta (111-121)
ATLGDLKLVEK

SEQ ID NO: 14818 - protein, 12 aa, Artificial Sequence
  DNA-directed RNA polymerase II subunit RPB1 (907-918)
ATLKPSNKAFEK

SEQ ID NO: 14819 - protein, 11 aa, Artificial Sequence
  Telomerase protein component 1 (83-93)
ATLSDLKTMEK

SEQ ID NO: 14820 - protein, 10 aa, Artificial Sequence
  KIF1-binding protein (254-263)
ATLSQFYINK

SEQ ID NO: 14821 - protein, 12 aa, Artificial Sequence
  Eukaryotic initiation factor 4A-I (214-225)
ATMPSDVLEVTK

SEQ ID NO: 14822 - protein, 11 aa, Artificial Sequence
  Activity-dependent neuroprotector homeobox protein (988-998)
ATMQGDREQLK

SEQ ID NO: 14823 - protein, 10 aa, Artificial Sequence
  Arf-GAP with coiled-coil, ANK repeat and PH domain-containing protein 2 (155-164)
ATNILTATRK

SEQ ID NO: 14824 - protein, 10 aa, Artificial Sequence
  Homeobox protein Hox-A13 (342-351)
ATNKFITKDK

SEQ ID NO: 14825 - protein, 10 aa, Artificial Sequence
  Rho-related BTB domain-containing protein 3 (557-566)
ATNYLIFSQK

SEQ ID NO: 14826 - protein, 9 aa, Artificial Sequence
  Glutathione S-transferase kappa 1 (148-156)
ATPKVKNQL

SEQ ID NO: 14827 - protein, 10 aa, Artificial Sequence
  Splicing factor 1 (7-16)
ATPLDFPSKK

SEQ ID NO: 14828 - protein, 9 aa, Artificial Sequence
  Geranylgeranyl transferase type-2 subunit alpha (31-39)
ATQAVFQKR

SEQ ID NO: 14829 - protein, 12 aa, Artificial Sequence
  Forkhead box protein J3 (44-55)
ATQNAHGTGISK

SEQ ID NO: 14830 - protein, 9 aa, Artificial Sequence
  Tubby-related protein 4 (741-749)
ATQYPVSNR

SEQ ID NO: 14831 - protein, 11 aa, Artificial Sequence
  Importin subunit alpha-5 (407-417)
ATSGGSAEQIK

SEQ ID NO: 14832 - protein, 9 aa, Artificial Sequence
  CLIP-associating protein 1 (426-434)
ATSGVVAVR

SEQ ID NO: 14833 - protein, 9 aa, Artificial Sequence
  Origin recognition complex subunit 3 (253-261)
ATSPIIIHR

SEQ ID NO: 14834 - protein, 10 aa, Artificial Sequence
  Origin recognition complex subunit 3 (253-262)
ATSPIIIHRL

SEQ ID NO: 14835 - protein, 9 aa, Artificial Sequence
  Importin subunit alpha-1 (60-68)
ATSPLQENR

SEQ ID NO: 14836 - protein, 9 aa, Artificial Sequence
  tRNA pseudouridine synthase-like 1 (125-133)
ATSRTYLYR

SEQ ID NO: 14837 - protein, 11 aa, Artificial Sequence
  Golgi apparatus membrane protein TVP23 homolog B (186-196)
ATSYFGKQFLR

SEQ ID NO: 14838 - protein, 11 aa, Artificial Sequence
  ATP-citrate synthase (93-103)
ATVGKATGFLK

SEQ ID NO: 14839 - protein, 9 aa, Artificial Sequence
  Phosphoribosyl pyrophosphate synthase-associated protein 1 (222-230)
ATVHPGLEL

SEQ ID NO: 14840 - protein, 10 aa, Artificial Sequence
  Integrator complex subunit 7 (445-454)
ATVIFVASQK

SEQ ID NO: 14841 - protein, 9 aa, Artificial Sequence
  Pre-mRNA-processing factor 19 (180-188)
ATVLTTERK

SEQ ID NO: 14842 - protein, 11 aa, Artificial Sequence
  Mitochondrial folate transporter/carrier (241-251)
ATYPYQVVRAR

SEQ ID NO: 14843 - protein, 11 aa, Artificial Sequence
  Eukaryotic translation initiation factor 3 subunit D (48-58)
ATYQDKRYTNK

SEQ ID NO: 14844 - protein, 9 aa, Artificial Sequence
  Cleavage and polyadenylation specificity factor subunit 2 (52-60)
ATYVQPRRK

SEQ ID NO: 14845 - protein, 9 aa, Artificial Sequence
  Protein phosphatase methylesterase 1 (362-370)
AVATFLIRH

SEQ ID NO: 14846 - protein, 9 aa, Artificial Sequence
  Serine/threonine-protein kinase SIK2 (699-707)
AVDPQHNGY

SEQ ID NO: 14847 - protein, 9 aa, Artificial Sequence
  Fanconi anemia group D2 protein (69-77)
AVDQIAFQK

SEQ ID NO: 14848 - protein, 9 aa, Artificial Sequence
  Breast cancer type 1 susceptibility protein (1104-1112)
AVFSKSVQK

SEQ ID NO: 14849 - protein, 11 aa, Artificial Sequence
  Uncharacterized aarF domain-containing protein kinase 5 (335-345)
AVHDIAEKLIK

SEQ ID NO: 14850 - protein, 9 aa, Artificial Sequence
  Telomere-associated protein RIF1 (481-489)
AVHDSFVAV

SEQ ID NO: 14851 - protein, 11 aa, Artificial Sequence
  Protein canopy homolog 4 (15-25)
AVHEAWAGMLK

SEQ ID NO: 14852 - protein, 9 aa, Artificial Sequence
  Zinc transporter ZIP3 (302-310)
AVHETLVAV

SEQ ID NO: 14853 - protein, 9 aa, Artificial Sequence
  Bifunctional methylenetetrahydrofolate dehydrogenase/cyclohydrolase, mitochondrial (270-278)
AVIDVGINR

SEQ ID NO: 14854 - protein, 13 aa, Artificial Sequence
  Cytoplasmic dynein 1 heavy chain 1 (3288-3300)
AVIEAQNAVKSIK

SEQ ID NO: 14855 - protein, 9 aa, Artificial Sequence
  Nucleosome-remodeling factor subunit BPTF (2407-2415)
AVIEHLKQK

SEQ ID NO: 14856 - protein, 11 aa, Artificial Sequence
  L-xylulose reductase (110-120)
AVIQVSQIVAR

SEQ ID NO: 14857 - protein, 11 aa, Artificial Sequence
  Protein S100-A16 (11-21)
AVIVLVENFYK

SEQ ID NO: 14858 - protein, 10 aa, Artificial Sequence
  Periodic tryptophan protein 1 homolog (46-55)
AVLDLSWNKL

SEQ ID NO: 14859 - protein, 11 aa, Artificial Sequence
  Zinc finger SWIM domain-containing protein 8 (430-440)
AVLDPALSPQR

SEQ ID NO: 14860 - protein, 9 aa, Artificial Sequence
  Vacuolar protein sorting-associated protein 11 homolog (740-748)
AVLKHIENK

SEQ ID NO: 14861 - protein, 11 aa, Artificial Sequence
  Charged multivesicular body protein 3 (30-40)
AVLRVAGSLQK

SEQ ID NO: 14862 - protein, 11 aa, Artificial Sequence
  Long-chain-fatty-acid-CoA ligase 4 (332-342)
AVPEIMDRIYK

SEQ ID NO: 14863 - protein, 11 aa, Artificial Sequence
  Aspartyl aminopeptidase (23-33)
AVQTAAKELLK

SEQ ID NO: 14864 - protein, 10 aa, Artificial Sequence
  TSC22 domain family protein 4 (336-345)
AVREEVEVLK

SEQ ID NO: 14865 - protein, 10 aa, Artificial Sequence
  Peroxisomal acyl-coenzyme A oxidase 1 (63-72)
AVRKSAIMVK

SEQ ID NO: 14866 - protein, 11 aa, Artificial Sequence
  Pre-mRNA-processing factor 6 (914-924)
AVSKDIANWQK

SEQ ID NO: 14867 - protein, 9 aa, Artificial Sequence
  5'-AMP-activated protein kinase subunit gamma-1 (141-149)
AVSSLIRNK

SEQ ID NO: 14868 - protein, 11 aa, Artificial Sequence
  CD99 antigen-like protein 2 (58-68)
AVSSYISYQQK

SEQ ID NO: 14869 - protein, 9 aa, Artificial Sequence
  Inactive hydroxysteroid dehydrogenase-like protein 1 (258-266)
AVSTLGISK

SEQ ID NO: 14870 - protein, 11 aa, Artificial Sequence
  CD81 antigen (63-73)
AVVDDDANNAK

SEQ ID NO: 14871 - protein, 9 aa, Artificial Sequence
  GTP-binding protein 2 (496-504)
AVVEKIHAK

SEQ ID NO: 14872 - protein, 11 aa, Artificial Sequence
  Mitochondrial folate transporter/carrier (154-164)
AVVNSPHRQYK

SEQ ID NO: 14873 - protein, 9 aa, Artificial Sequence
  Inositol 1,4,5-trisphosphate receptor-interacting protein (385-393)
AVYERHFLR

SEQ ID NO: 14874 - protein, 11 aa, Artificial Sequence
  Nuclear factor interleukin-3-regulated protein (146-156)
AVYFQDYQTSK

SEQ ID NO: 14875 - protein, 9 aa, Artificial Sequence
  Aladin (158-166)
AWHPHTNKF

SEQ ID NO: 14876 - protein, 9 aa, Artificial Sequence
  Ankyrin-2 (1480-1488)
AYIADHLGF

SEQ ID NO: 14877 - protein, 9 aa, Artificial Sequence
  Leucine-rich repeat protein SHOC-2 (468-476)
AYLKDLQKL

SEQ ID NO: 14878 - protein, 9 aa, Artificial Sequence
  Fragile X mental retardation syndrome-related protein 1 (356-364)
AYLKEVEQL

SEQ ID NO: 14879 - protein, 9 aa, Artificial Sequence
  Serine/threonine-protein kinase RIO1 (156-164)
AYLSKAMEI

SEQ ID NO: 14880 - protein, 9 aa, Artificial Sequence
  ER degradation-enhancing alpha-mannosidase-like protein 1 (395-403)
AYQSIQNYL

SEQ ID NO: 14881 - protein, 9 aa, Artificial Sequence
  Angiomotin-like protein 1 (604-612)
AYVEKVEKL

SEQ ID NO: 14882 - protein, 9 aa, Artificial Sequence
  Angiomotin-like protein 2 (481-489)
AYVEKVERL

SEQ ID NO: 14883 - protein, 9 aa, Artificial Sequence
  Zinc finger protein 580 (248-256)
DAAELAQHV

SEQ ID NO: 14884 - protein, 9 aa, Artificial Sequence
  Embryonic stem cell-specific 5-hydroxymethylcytosine-binding protein (62-70)
DADSSERII

SEQ ID NO: 14885 - protein, 9 aa, Artificial Sequence
  Proteasome subunit beta type-10 (90-98)
DAEMTTRMV

SEQ ID NO: 14886 - protein, 9 aa, Artificial Sequence
  Torsin-1A-interacting protein 2 (129-137)
DAHLGSSSV

SEQ ID NO: 14887 - protein, 9 aa, Artificial Sequence
  Centrosomal protein of 95 kDa (61-69)
DAHNVQAVI

SEQ ID NO: 14888 - protein, 9 aa, Artificial Sequence
  Cohesin subunit SA-1 (302-310)
DAIAEIRAI

SEQ ID NO: 14889 - protein, 9 aa, Artificial Sequence
  Heat shock cognate 71 kDa protein (323-331)
DAKLDKSQI

SEQ ID NO: 14890 - protein, 8 aa, Artificial Sequence
  Phosphatidylinositol 4-kinase alpha (403-410)
DAPELSHV

SEQ ID NO: 14891 - protein, 8 aa, Artificial Sequence
  Carnitine O-palmitoyltransferase 1, liver isoform (477-484)
DAPIVAHL

SEQ ID NO: 14892 - protein, 10 aa, Artificial Sequence
  Transcription activator BRG1 (696-705)
DAPKAGQLEA

SEQ ID NO: 14893 - protein, 9 aa, Artificial Sequence
  Protein RMD5 homolog B (51-59)
DAREQQQQI

SEQ ID NO: 14894 - protein, 9 aa, Artificial Sequence
  Myotubularin (278-286)
DARPSVNAV

SEQ ID NO: 14895 - protein, 9 aa, Artificial Sequence
  Filamin-A (1614-1622)
DASKCTVTV

SEQ ID NO: 14896 - protein, 9 aa, Artificial Sequence
  E3 ubiquitin-protein ligase RNF114 (127-135)
DASLQPRNV

SEQ ID NO: 14897 - protein, 9 aa, Artificial Sequence
  Translocon-associated protein subunit delta (40-48)
DAVISTETV

SEQ ID NO: 14898 - protein, 8 aa, Artificial Sequence
  DNA-directed RNA polymerase II subunit RPB2 (306-313)
DAVNVQKI

SEQ ID NO: 14899 - protein, 9 aa, Artificial Sequence
  Adipocyte plasma membrane-associated protein (180-188)
DAYKGLFEV

SEQ ID NO: 14900 - protein, 9 aa, Artificial Sequence
  Securin (108-116)
DAYPEIEKF

SEQ ID NO: 14901 - protein, 11 aa, Artificial Sequence
  Proteasome subunit beta type-4 (118-128)
DEELLGDGHSY

SEQ ID NO: 14902 - protein, 9 aa, Artificial Sequence
  DNA polymerase alpha catalytic subunit (336-344)
DEEQVFHFY

SEQ ID NO: 14903 - protein, 11 aa, Artificial Sequence
  26S protease regulatory subunit 8 (123-133)
DEIDSIGSSRL

SEQ ID NO: 14904 - protein, 9 aa, Artificial Sequence
  N-alpha-acetyltransferase 10 (47-55)
DENGKIVGY

SEQ ID NO: 14905 - protein, 9 aa, Artificial Sequence
  40S ribosomal protein S18 (62-70)
DEVERVITI

SEQ ID NO: 14906 - protein, 9 aa, Artificial Sequence
  Rab GDP dissociation inhibitor beta (21-29)
DFKVTEGSF

SEQ ID NO: 14907 - protein, 9 aa, Artificial Sequence
  Fatty acid synthase (2469-2477)
DGKVSVHVI

SEQ ID NO: 14908 - protein, 9 aa, Artificial Sequence
  Nucleoporin NUP53 (211-219)
DGRIFGESI

SEQ ID NO: 14909 - protein, 9 aa, Artificial Sequence
  Nicotinamide/nicotinic acid mononucleotide adenylyltransferase 1 (112-120)
DHQQNSPTL

SEQ ID NO: 14910 - protein, 14 aa, Artificial Sequence
  Glia-derived nexin (118-131)
DIVTVANAVFVKNA

SEQ ID NO: 14911 - protein, 9 aa, Artificial Sequence
  Non-POU domain-containing octamer-binding protein (226-234)
DLMRRQEEL

SEQ ID NO: 14912 - protein, 9 aa, Artificial Sequence
  Homeodomain-interacting protein kinase 1 (252-260)
DPFQQTFIV

SEQ ID NO: 14913 - protein, 9 aa, Artificial Sequence
  Mediator of RNA polymerase II transcription subunit 13-like (1410-1418)
DPYGGHRDV

SEQ ID NO: 14914 - protein, 8 aa, Artificial Sequence
  Plectin (3424-3431)
DPYSGSTI

SEQ ID NO: 14915 - protein, 9 aa, Artificial Sequence
  Elongator complex protein 2 (46-54)
DQFQKVLSL

SEQ ID NO: 14916 - protein, 10 aa, Artificial Sequence
  Ras GTPase-activating protein-binding protein 2 (285-294)
DSDNRRIIRY

SEQ ID NO: 14917 - protein, 8 aa, Artificial Sequence
  AP-3 complex subunit delta-1 (314-321)
DSDQNLKY

SEQ ID NO: 14918 - protein, 9 aa, Artificial Sequence
  Ubiquitin carboxyl-terminal hydrolase 28 (507-515)
DSYGGLRNV

SEQ ID NO: 14919 - protein, 9 aa, Artificial Sequence
  Zinc transporter ZIP6 (485-493)
DTDDRTEGY

SEQ ID NO: 14920 - protein, 8 aa, Artificial Sequence
  Poly (ADP-ribose) polymerase 14 (118-125)
DTIMATKL

SEQ ID NO: 14921 - protein, 8 aa, Artificial Sequence
  Protein S100-A9 (67-74)
DTNADKQL

SEQ ID NO: 14922 - protein, 9 aa, Artificial Sequence
  Protein FAM172A (263-271)
DVKNKVTAV

SEQ ID NO: 14923 - protein, 9 aa, Artificial Sequence
  Cytochrome c oxidase subunit 6C (57-65)
DVMKDFEEM

SEQ ID NO: 14924 - protein, 9 aa, Artificial Sequence
  N-acetyl-D-glucosamine kinase (175-183)
EAAPHDIGY

SEQ ID NO: 14925 - protein, 10 aa, Artificial Sequence
  Myosin light polypeptide 6 (148-157)
EAFVRHILSG

SEQ ID NO: 14926 - protein, 9 aa, Artificial Sequence
  Hsp70-binding protein 1 (201-209)
EAGAAGLRW

SEQ ID NO: 14927 - protein, 8 aa, Artificial Sequence
  Probable U3 small nucleolar RNA-associated protein 11 (43-50)
EAKKIERL

SEQ ID NO: 14928 - protein, 9 aa, Artificial Sequence
  Ribosomal RNA-processing protein 7 homolog A (260-268)
EEDKQRIEL

SEQ ID NO: 14929 - protein, 9 aa, Artificial Sequence
  WD40 repeat-containing protein SMU1 (197-205)
EEEKFPTQL

SEQ ID NO: 14930 - protein, 10 aa, Artificial Sequence
  Guanine nucleotide-binding protein-like 3-like protein (97-106)
EEFEHKEEVL

SEQ ID NO: 14931 - protein, 9 aa, Artificial Sequence
  Protocadherin Fat 1 (2948-2956)
EEINRQVTY

SEQ ID NO: 14932 - protein, 9 aa, Artificial Sequence
  Midasin (582-590)
EEISHLISF

SEQ ID NO: 14933 - protein, 9 aa, Artificial Sequence
  Protein strawberry notch homolog 2 (93-101)
EELGHTETY

SEQ ID NO: 14934 - protein, 9 aa, Artificial Sequence
  X-ray repair cross-complementing protein 5 (651-659)
EEQRFNNFL

SEQ ID NO: 14935 - protein, 8 aa, Artificial Sequence
  Angiomotin-like protein 2 (573-580)
EERAMRQF

SEQ ID NO: 14936 - protein, 10 aa, Artificial Sequence
  Methylmalonic aciduria and homocystinuria type D protein, mitochondrial (191-200)
EEVEIEREVL

SEQ ID NO: 14937 - protein, 9 aa, Artificial Sequence
  Mitotic checkpoint serine/threonine-protein kinase BUB1 beta (160-168)
EEYEARENF

SEQ ID NO: 14938 - protein, 9 aa, Artificial Sequence
  Mediator of RNA polymerase II transcription subunit 18 (128-136)
EFVAKGHLF

SEQ ID NO: 14939 - protein, 9 aa, Artificial Sequence
  Glycerol-3-phosphate dehydrogenase 1-like protein (49-57)
EGPEGLKLI

SEQ ID NO: 14940 - protein, 9 aa, Artificial Sequence
  3-ketoacyl-CoA thiolase, mitochondrial (221-229)
EHARPQTTL

SEQ ID NO: 14941 - protein, 9 aa, Artificial Sequence
  COMM domain-containing protein 6 (77-85)
EIAAVIETV

SEQ ID NO: 14942 - protein, 10 aa, Artificial Sequence
  Actin-related protein 6 (47-56)
EIKDPSGLFY

SEQ ID NO: 14943 - protein, 9 aa, Artificial Sequence
  Spectrin beta chain, non-erythrocytic 1 (1987-1995)
EIKEKLLQL

SEQ ID NO: 14944 - protein, 9 aa, Artificial Sequence
  DnaJ homolog subfamily C member 8 (83-91)
EIKKRFRQL

SEQ ID NO: 14945 - protein, 9 aa, Artificial Sequence
  Heat shock protein 105 kDa (740-748)
EIKTKIKEL

SEQ ID NO: 14946 - protein, 9 aa, Artificial Sequence
  Replication protein A 14 kDa subunit (62-70)
EISGIVEVV

SEQ ID NO: 14947 - protein, 9 aa, Artificial Sequence
  Centrosomal protein of 170 kDa (1472-1480)
EISSILQEL

SEQ ID NO: 14948 - protein, 11 aa, Artificial Sequence
  Peptidyl-prolyl cis-trans isomerase CWC27 homolog (445-455)
EIYDPRNPVNK

SEQ ID NO: 14949 - protein, 9 aa, Artificial Sequence
  Serine-protein kinase ATM (1146-1154)
EIYNRKSVL

SEQ ID NO: 14950 - protein, 9 aa, Artificial Sequence
  Translin-associated protein X (45-53)
ELDARHDKY

SEQ ID NO: 14951 - protein, 9 aa, Artificial Sequence
  Ankyrin repeat domain-containing protein 40 (281-289)
ELDRQELTY

SEQ ID NO: 14952 - protein, 9 aa, Artificial Sequence
  Uncharacterized protein C16orf45 (98-106)
ELIQKIHKL

SEQ ID NO: 14953 - protein, 9 aa, Artificial Sequence
  ATP-dependent DNA helicase Q1 (34-42)
ELIQKKKVL

SEQ ID NO: 14954 - protein, 9 aa, Artificial Sequence
  Dedicator of cytokinesis protein 7 (661-669)
ELKSSISAL

SEQ ID NO: 14955 - protein, 9 aa, Artificial Sequence
  Protein Spindly (108-116)
ELKTKIEKL

SEQ ID NO: 14956 - protein, 9 aa, Artificial Sequence
  Hypoxia-inducible factor 1-alpha (705-713)
ELNPKILAL

SEQ ID NO: 14957 - protein, 9 aa, Artificial Sequence
  NF-kappa-B inhibitor-interacting Ras-like protein 1 (70-78)
ELPKHYFSF

SEQ ID NO: 14958 - protein, 9 aa, Artificial Sequence
  Transmembrane emp24 domain-containing protein 9 (163-171)
ELQLRVRQL

SEQ ID NO: 14959 - protein, 9 aa, Artificial Sequence
  FRAS1-related extracellular matrix protein 2 (2560-2568)
ELSNFELTL

SEQ ID NO: 14960 - protein, 9 aa, Artificial Sequence
  Immediate early response gene 5 protein (99-107)
EPQPERSSV

SEQ ID NO: 14961 - protein, 9 aa, Artificial Sequence
  Tubulin beta-6 chain (116-124)
EPYNATLSV

SEQ ID NO: 14962 - protein, 10 aa, Artificial Sequence
  Proline-rich protein PRCC (289-298)
EPYPYPIPTV

SEQ ID NO: 14963 - protein, 8 aa, Artificial Sequence
  Eukaryotic translation initiation factor 3 subunit A (641-648)
EQIKKTEL

SEQ ID NO: 14964 - protein, 9 aa, Artificial Sequence
  Integrator complex subunit 1 (747-755)
EQPETYYKW

SEQ ID NO: 14965 - protein, 9 aa, Artificial Sequence
  Oxysterol-binding protein-related protein 9 (151-159)
EQRKKIETL

SEQ ID NO: 14966 - protein, 13 aa, Artificial Sequence
  (1108-1120)
ESDKYAERKGAAY

SEQ ID NO: 14967 - protein, 10 aa, Artificial Sequence
  39S ribosomal protein L2, mitochondrial (197-206)
ESEPGRGAQY

SEQ ID NO: 14968 - protein, 9 aa, Artificial Sequence
  Trafficking protein particle complex subunit 3 (73-81)
ETADVIAKV

SEQ ID NO: 14969 - protein, 11 aa, Artificial Sequence
  60S ribosomal protein L17 (31-41)
ETAQAIKGMHI

SEQ ID NO: 14970 - protein, 11 aa, Artificial Sequence
  Semaphorin-3C (312-322)
ETDNPRTTLVY

SEQ ID NO: 14971 - protein, 9 aa, Artificial Sequence
  Maturin (26-34)
ETERRMDFY

SEQ ID NO: 14972 - protein, 9 aa, Artificial Sequence
  Type II inositol 3,4-bisphosphate 4-phosphatase (389-397)
ETERRNTGY

SEQ ID NO: 14973 - protein, 9 aa, Artificial Sequence
  Crooked neck-like protein 1 (679-687)
ETERTRNLY

SEQ ID NO: 14974 - protein, 9 aa, Artificial Sequence
  Mortality factor 4-like protein 1 (187-195)
ETFMNRVEV

SEQ ID NO: 14975 - protein, 9 aa, Artificial Sequence
  Proteasome-associated protein ECM29 homolog (349-357)
ETFPANIQV

SEQ ID NO: 14976 - protein, 9 aa, Artificial Sequence
  Nucleoporin NUP188 homolog (337-345)
ETSSVVRKI

SEQ ID NO: 14977 - protein, 9 aa, Artificial Sequence
  NF-kappa-B-repressing factor (487-495)
EVIAEAVGV

SEQ ID NO: 14978 - protein, 9 aa, Artificial Sequence
  Sphingolipid delta(4)-desaturase DES1 (150-158)
EVINTVAQV

SEQ ID NO: 14979 - protein, 9 aa, Artificial Sequence
  U11/U12 small nuclear ribonucleoprotein 48 kDa protein (239-247)
EVIRDVINV

SEQ ID NO: 14980 - protein, 9 aa, Artificial Sequence
  T-complex protein 1 subunit theta (462-470)
EVISKLYAV

SEQ ID NO: 14981 - protein, 9 aa, Artificial Sequence
  Protein O-GlcNAcase (266-274)
EVSKIIKRA

SEQ ID NO: 14982 - protein, 10 aa, Artificial Sequence
  Prolyl 3-hydroxylase OGFOD1 (211-220)
EVSPVSFHQV

SEQ ID NO: 14983 - protein, 10 aa, Artificial Sequence
  Melanoma-associated antigen 1 (222-231)
EVYDGREHSA

SEQ ID NO: 14984 - protein, 9 aa, Artificial Sequence
  Exocyst complex component 4 (587-595)
EYIHALTLL

SEQ ID NO: 14985 - protein, 11 aa, Artificial Sequence
  Inactive tyrosine-protein kinase transmembrane receptor ROR1 (4-14)
EYINQGDLHEF

SEQ ID NO: 14986 - protein, 9 aa, Artificial Sequence
  Vacuolar protein sorting-associated protein 4B (64-72)
EYLDRAEKL

SEQ ID NO: 14987 - protein, 9 aa, Artificial Sequence
  5'-3' exoribonuclease 1 (989-997)
EYLERAPEL

SEQ ID NO: 14988 - protein, 8 aa, Artificial Sequence
  Tubulin beta chain (178-185)
EYPDRIMN

SEQ ID NO: 14989 - protein, 10 aa, Artificial Sequence
  Zinc finger protein 281 (515-524)
EYSKYLQQAF

SEQ ID NO: 14990 - protein, 9 aa, Artificial Sequence
  UPF0469 protein KIAA0907 (327-335)
EYSRFVNQI

SEQ ID NO: 14991 - protein, 9 aa, Artificial Sequence
  Melanoma-associated antigen D1 (504-512)
EYTDVYPEI

SEQ ID NO: 14992 - protein, 9 aa, Artificial Sequence
  Probable global transcription activator SNF2L2 (535-543)
EYVANLTNL

SEQ ID NO: 14993 - protein, 11 aa, Artificial Sequence
  HLA class I histocompatibility antigen, alpha chain F (43-53)
EYVDDTQFLRF

SEQ ID NO: 14994 - protein, 9 aa, Artificial Sequence
  Zinc finger protein 506 (117-125)
EYVKFLHKF

SEQ ID NO: 14995 - protein, 9 aa, Artificial Sequence
  Kinesin-like protein KIF22 (218-226)
FADFERHFL

SEQ ID NO: 14996 - protein, 9 aa, Artificial Sequence
  Phosphatidylinositol 4-phosphate 3-kinase C2 domain-containing subunit alpha (950-958)
FADQEVRSL

SEQ ID NO: 14997 - protein, 9 aa, Artificial Sequence
  E3 ubiquitin-protein ligase TRIM22 (386-394)
FAFDPSVNY

SEQ ID NO: 14998 - protein, 9 aa, Artificial Sequence
  Protein disulfide-isomerase A3 (184-192)
FAHTNVESL

SEQ ID NO: 14999 - protein, 9 aa, Artificial Sequence
  Sarcosine dehydrogenase, mitochondrial (859-867)
FAIDKTIAY

SEQ ID NO: 15000 - protein, 9 aa, Artificial Sequence
  Eukaryotic translation initiation factor 3 subunit E (53-61)
FAMDVYKNL

SEQ ID NO: 15001 - protein, 9 aa, Artificial Sequence
  Protein-tyrosine kinase 2-beta (257-265)
FANIDQETY

SEQ ID NO: 15002 - protein, 11 aa, Artificial Sequence
  Glutamine and serine-rich protein 1 (1659-1669)
FAVDPEKIQLY

SEQ ID NO: 15003 - protein, 9 aa, Artificial Sequence
  Ubiquilin-1 (50-58)
FAVPENSSV

SEQ ID NO: 15004 - protein, 10 aa, Artificial Sequence
  Eukaryotic translation initiation factor 3 subunit B (568-577)
FAWEPNGSKF

SEQ ID NO: 15005 - protein, 11 aa, Artificial Sequence
  Probable ATP-dependent RNA helicase DDX56 (464-474)
FEDNPRDLQLL

SEQ ID NO: 15006 - protein, 9 aa, Artificial Sequence
  Coatomer subunit gamma-1 (783-791)
FEKEETFTL

SEQ ID NO: 15007 - protein, 9 aa, Artificial Sequence
  Alpha-parvin (133-141)
FEKLESEKL

SEQ ID NO: 15008 - protein, 10 aa, Artificial Sequence
  Glycogen phosphorylase, brain form (327-336)
FETFPDKVAI

SEQ ID NO: 15009 - protein, 11 aa, Artificial Sequence
  Destrin (89-99)
FETKESRKEEL

SEQ ID NO: 15010 - protein, 9 aa, Artificial Sequence
  Zinc finger protein 462 (268-276)
FGDSGRLYY

SEQ ID NO: 15011 - protein, 9 aa, Artificial Sequence
  Endoplasmic reticulum-Golgi intermediate compartment protein 3 (214-222)
FHFAPGKSF

SEQ ID NO: 15012 - protein, 10 aa, Artificial Sequence
  HLA class II histocompatibility antigen, DQ alpha 1 chain (134-143)
FIDKFTPPVV

SEQ ID NO: 15013 - protein, 9 aa, Artificial Sequence
  Guanine nucleotide-binding protein G(I)/G(S)/G(T) subunit beta-1 (58-66)
FLDDNQIVT

SEQ ID NO: 15014 - protein, 9 aa, Artificial Sequence
  Basigin (25-33)
FLPEPMGTA

SEQ ID NO: 15015 - protein, 10 aa, Artificial Sequence
  Volume-regulated anion channel subunit LRRC8D (80-89)
FLSEVSENKL

SEQ ID NO: 15016 - protein, 9 aa, Artificial Sequence
  Transmembrane protein 97 (18-26)
FLSHIPITL

SEQ ID NO: 15017 - protein, 10 aa, Artificial Sequence
  Vitamin K-dependent protein S (26-35)
FLSKQQASQV

SEQ ID NO: 15018 - protein, 9 aa, Artificial Sequence
  Helicase with zinc finger domain 2 (630-638)
FRPPTRAEL

SEQ ID NO: 15019 - protein, 9 aa, Artificial Sequence
  Myeloid leukemia factor 2 (203-211)
FRQQRPLEF

SEQ ID NO: 15020 - protein, 9 aa, Artificial Sequence
  Importin subunit alpha-7 (90-98)
FSDDSDLQL

SEQ ID NO: 15021 - protein, 9 aa, Artificial Sequence
  Protein phosphatase 1D (12-20)
FSDQGGRKY

SEQ ID NO: 15022 - protein, 9 aa, Artificial Sequence
  60S ribosomal protein L11 (98-106)
FSDTGNFGF

SEQ ID NO: 15023 - protein, 9 aa, Artificial Sequence
  Renin receptor (105-113)
FSEETPVVL

SEQ ID NO: 15024 - protein, 9 aa, Artificial Sequence
  Transforming protein RhoA (80-88)
FSIDSPDSL

SEQ ID NO: 15025 - protein, 9 aa, Artificial Sequence
  Condensin complex subunit 3 (305-313)
FSITPLSEL

SEQ ID NO: 15026 - protein, 9 aa, Artificial Sequence
  Unconventional myosin-Ib (364-372)
FSSDHLIEM

SEQ ID NO: 15027 - protein, 9 aa, Artificial Sequence
  TBC1 domain family member 22B (80-88)
FSSPSFQTL

SEQ ID NO: 15028 - protein, 9 aa, Artificial Sequence
  Basic leucine zipper and W2 domain-containing protein 2 (234-242)
FTDAGLKEL

SEQ ID NO: 15029 - protein, 9 aa, Artificial Sequence
  Multidrug resistance protein 1 (175-183)
FTDKELLAY

SEQ ID NO: 15030 - protein, 9 aa, Artificial Sequence
  Protein VPRBP (1070-1078)
FTEDHYVEF

SEQ ID NO: 15031 - protein, 10 aa, Artificial Sequence
  Neuronal calcium sensor 1 (22-31)
FTEKEVQQWY

SEQ ID NO: 15032 - protein, 9 aa, Artificial Sequence
  RNMT-activating mini protein (19-27)
FTENDKEYQ

SEQ ID NO: 15033 - protein, 13 aa, Artificial Sequence
  DNA-directed RNA polymerase II subunit RPB7 (31-43)
FTEVEGTCTGKYG

SEQ ID NO: 15034 - protein, 9 aa, Artificial Sequence
  SURP and G-patch domain-containing protein 1 (198-206)
FVAEGGPEL

SEQ ID NO: 15035 - protein, 10 aa, Artificial Sequence
  Glutamyl-tRNA(Gln) amidotransferase subunit C, mitochondrial (112-121)
FVAPPGNISL

SEQ ID NO: 15036 - protein, 9 aa, Artificial Sequence
  E3 ubiquitin-protein ligase RNF187 (182-190)
FVEEEEHFL

SEQ ID NO: 15037 - protein, 9 aa, Artificial Sequence
  Ubiquitin carboxyl-terminal hydrolase 22 (45-53)
FVWSGTAEA

SEQ ID NO: 15038 - protein, 11 aa, Artificial Sequence
  Membrane cofactor protein (69-79)
FYIPPLATHTI

SEQ ID NO: 15039 - protein, 9 aa, Artificial Sequence
  GPI transamidase component PIG-T (539-547)
FYNLLTRTF

SEQ ID NO: 15040 - protein, 9 aa, Artificial Sequence
  RNA polymerase II-associated factor 1 homolog (423-431)
GATAAAPVP

SEQ ID NO: 15041 - protein, 11 aa, Artificial Sequence
  Nuclear mitotic apparatus protein 1 (775-785)
GEAHQAETEVL

SEQ ID NO: 15042 - protein, 10 aa, Artificial Sequence
  Cytoplasmic dynein 1 light intermediate chain 2 (61-70)
GEDGSGKTTL

SEQ ID NO: 15043 - protein, 11 aa, Artificial Sequence
  von Willebrand factor A domain-containing protein 5A (208-218)
GEDKTSAQVSL

SEQ ID NO: 15044 - protein, 9 aa, Artificial Sequence
  Protein Jade-2 (168-176)
GEDLEKVTL

SEQ ID NO: 15045 - protein, 10 aa, Artificial Sequence
  Zinc finger protein 622 (359-368)
GEDPNKAEEL

SEQ ID NO: 15046 - protein, 11 aa, Artificial Sequence
  Eukaryotic translation initiation factor 3 subunit C-like protein (542-552)
GEDSAVLMERL

SEQ ID NO: 15047 - protein, 9 aa, Artificial Sequence
  Poly(U)-binding-splicing factor PUF60 (123-131)
GEDTIRQAF

SEQ ID NO: 15048 - protein, 10 aa, Artificial Sequence
  Glutamine-tRNA ligase (351-360)
GEELKGHNTL

SEQ ID NO: 15049 - protein, 9 aa, Artificial Sequence
  DNA damage-binding protein 1 (783-791)
GEEVEVHNL

SEQ ID NO: 15050 - protein, 10 aa, Artificial Sequence
  RNA-binding protein 8A (81-90)
GEIKNIHLNL

SEQ ID NO: 15051 - protein, 11 aa, Artificial Sequence
  Supervillin (797-807)
GEIKTPTGEGL

SEQ ID NO: 15052 - protein, 9 aa, Artificial Sequence
  Hsc70-interacting protein (128-136)
GELQKAIDL

SEQ ID NO: 15053 - protein, 9 aa, Artificial Sequence
  Antigen peptide transporter 2 (87-95)
GELTQGSLL

SEQ ID NO: 15054 - protein, 10 aa, Artificial Sequence
  Cytoplasmic dynein 1 heavy chain 1 (2173-2182)
GEMTALREEL

SEQ ID NO: 15055 - protein, 10 aa, Artificial Sequence
  Ras-related protein Rab-5A (27-36)
GESAVGKSSL

SEQ ID NO: 15056 - protein, 11 aa, Artificial Sequence
  U4/U6 small nuclear ribonucleoprotein Prp4 (45-55)
GESGILGKDGL

SEQ ID NO: 15057 - protein, 9 aa, Artificial Sequence
  tRNA wybutosine-synthesizing protein 2 homolog (54-62)
GETLPEQHL

SEQ ID NO: 15058 - protein, 9 aa, Artificial Sequence
  Nuclear protein localization protein 4 homolog (480-488)
GETQDFHSL

SEQ ID NO: 15059 - protein, 9 aa, Artificial Sequence
  Eukaryotic translation initiation factor 5A-1 (106-114)
GEVREDLRL

SEQ ID NO: 15060 - protein, 9 aa, Artificial Sequence
  Heterogeneous nuclear ribonucleoprotein H (422-430)
GGYGGQSSM

SEQ ID NO: 15061 - protein, 9 aa, Artificial Sequence
  Class E basic helix-loop-helix protein 41 (81-89)
GHLEKAVVL

SEQ ID NO: 15062 - protein, 9 aa, Artificial Sequence
  Guanine nucleotide-binding protein subunit beta-2-like 1 (13-21)
GHNGWVTQI

SEQ ID NO: 15063 - protein, 9 aa, Artificial Sequence
  Oxysterol-binding protein-related protein 9 (262-270)
GHSPPSSSL

SEQ ID NO: 15064 - protein, 9 aa, Artificial Sequence
  DNA replication licensing factor MCM6 (508-516)
GHYDRSKSL

SEQ ID NO: 15065 - protein, 11 aa, Artificial Sequence
  40S ribosomal protein S15 (113-123)
GHYLGEFSITY

SEQ ID NO: 15066 - protein, 9 aa, Artificial Sequence
  Coatomer subunit alpha (731-739)
GHYQNALYL

SEQ ID NO: 15067 - protein, 9 aa, Artificial Sequence
  Poly(rC)-binding protein 1 (259-267)
GIDSSSPEV

SEQ ID NO: 15068 - protein, 9 aa, Artificial Sequence
  Mitogen-activated protein kinase kinase kinase 6 (197-205)
GLADGLVQA

SEQ ID NO: 15069 - protein, 9 aa, Artificial Sequence
  Multiple PDZ domain protein (814-822)
GLADKPLFR

SEQ ID NO: 15070 - protein, 9 aa, Artificial Sequence
  Ras GTPase-activating-like protein IQGAP3 (153-161)
GLAPQIHDL

SEQ ID NO: 15071 - protein, 9 aa, Artificial Sequence
  26S protease regulatory subunit 8 (27-35)
GLDKQIKEI

SEQ ID NO: 15072 - protein, 9 aa, Artificial Sequence
  Nuclear autoantigenic sperm protein (409-417)
GLEEKVRAK

SEQ ID NO: 15073 - protein, 9 aa, Artificial Sequence
  Nuclear pore complex protein Nup98-Nup96 (50-58)
GLFGNSQTK

SEQ ID NO: 15074 - protein, 9 aa, Artificial Sequence
  Box C/D snoRNA protein 1 (14-22)
GLHSVAEGV

SEQ ID NO: 15075 - protein, 9 aa, Artificial Sequence
  60S ribosomal protein L11 (85-93)
GLKVREYEL

SEQ ID NO: 15076 - protein, 9 aa, Artificial Sequence
  Kinesin-like protein KIF3A (576-584)
GLLENIRQL

SEQ ID NO: 15077 - protein, 11 aa, Artificial Sequence
  Mitochondrial import inner membrane translocase subunit TIM50 (78-88)
GLLGAGGTVSV

SEQ ID NO: 15078 - protein, 9 aa, Artificial Sequence
  C-terminal-binding protein 1 (238-246)
GLNEHNHHL

SEQ ID NO: 15079 - protein, 10 aa, Artificial Sequence
  Acyl-CoA synthetase family member 4 (721-730)
GLNSPVLIGK

SEQ ID NO: 15080 - protein, 9 aa, Artificial Sequence
  Fos-related antigen 2 (165-173)
GLQKEIAEL

SEQ ID NO: 15081 - protein, 9 aa, Artificial Sequence
  Mitofusin-1 (547-555)
GLSEPIFQL

SEQ ID NO: 15082 - protein, 9 aa, Artificial Sequence
  Serine/threonine-protein phosphatase 2B catalytic subunit beta isoform (228-236)
GLSPEIHTL

SEQ ID NO: 15083 - protein, 9 aa, Artificial Sequence
  Neurofibromin (37-45)
GLTTILKNV

SEQ ID NO: 15084 - protein, 9 aa, Artificial Sequence
  Retinoic acid receptor gamma (203-211)
GLWDKFSEL

SEQ ID NO: 15085 - protein, 9 aa, Artificial Sequence
  Uncharacterized protein C17orf85 (252-260)
GLYADTREK

SEQ ID NO: 15086 - protein, 8 aa, Artificial Sequence
  Very-long-chain (3R)-3-hydroxyacyl-CoA dehydratase 1 (106-113)
GLYKSIQK

SEQ ID NO: 15087 - protein, 9 aa, Artificial Sequence
  Tripartite motif-containing protein 65 (17-25)
GLYQDPVTL

SEQ ID NO: 15088 - protein, 10 aa, Artificial Sequence
  Thioredoxin reductase 1, cytoplasmic (282-291)
GQFIGPHRIK

SEQ ID NO: 15089 - protein, 9 aa, Artificial Sequence
  Cdc42 effector protein 3 (76-84)
GQFPGHNEF

SEQ ID NO: 15090 - protein, 9 aa, Artificial Sequence
  Regulator of chromosome condensation (439-447)
GQHTVLLVK

SEQ ID NO: 15091 - protein, 9 aa, Artificial Sequence
  Chromodomain-helicase-DNA-binding protein 4 (1164-1172)
GQNKKVMIY

SEQ ID NO: 15092 - protein, 13 aa, Artificial Sequence
  EH domain-containing protein 2 (65-77)
GQYSTGKTSFIQY

SEQ ID NO: 15093 - protein, 11 aa, Artificial Sequence
  Heterogeneous nuclear ribonucleoprotein H (256-266)
GSDRFGRDLNY

SEQ ID NO: 15094 - protein, 9 aa, Artificial Sequence
  Mitochondrial import inner membrane translocase subunit TIM50 (62-70)
GSEGPSYAK

SEQ ID NO: 15095 - protein, 11 aa, Artificial Sequence
  Ribonucleoside-diphosphate reductase subunit M2 (238-248)
GSFASIFWLKK

SEQ ID NO: 15096 - protein, 9 aa, Artificial Sequence
  HLA class I histocompatibility antigen, A-2 alpha chain (25-33)
GSHSMRYFF

SEQ ID NO: 15097 - protein, 10 aa, Artificial Sequence
  HLA class I histocompatibility antigen, A-1 alpha chain (25-34)
GSHSMRYFFT

SEQ ID NO: 15098 - protein, 9 aa, Artificial Sequence
  HLA class I histocompatibility antigen, Cw-4 alpha chain (25-33)
GSHSMRYFS

SEQ ID NO: 15099 - protein, 9 aa, Artificial Sequence
  60S ribosomal protein L37 (23-31)
GSKAYHLQK

SEQ ID NO: 15100 - protein, 11 aa, Artificial Sequence
  Protein PRR14L (865-875)
GSLPGDKIRNK

SEQ ID NO: 15101 - protein, 10 aa, Artificial Sequence
  Smoothelin (449-458)
GTAEPGGSMK

SEQ ID NO: 15102 - protein, 11 aa, Artificial Sequence
  Embryonic stem cell-specific 5-hydroxymethylcytosine-binding protein (329-339)
GTAGLLEQWLK

SEQ ID NO: 15103 - protein, 11 aa, Artificial Sequence
  Glutamine-rich protein 1 (209-219)
GTASVLQPVKK

SEQ ID NO: 15104 - protein, 10 aa, Artificial Sequence
  Sphingosine-1-phosphate phosphatase 1 (135-144)
GTELGNELFY

SEQ ID NO: 15105 - protein, 11 aa, Artificial Sequence
  WD repeat-containing protein 92 (479-489)
GTFGATSLQQR

SEQ ID NO: 15106 - protein, 11 aa, Artificial Sequence
  Cactin isoform X2  (208-218)
GTFIWNKALEK

SEQ ID NO: 15107 - protein, 11 aa, Artificial Sequence
  Unconventional myosin-IXa (2491-2501)
GTFNPEKGKQK

SEQ ID NO: 15108 - protein, 9 aa, Artificial Sequence
  Biogenesis of lysosome-related organelles complex 1 subunit 4 (164-172)
GTFPRAFKK

SEQ ID NO: 15109 - protein, 10 aa, Artificial Sequence
  Actin-like protein 6A (362-371)
GTFQQMWISK

SEQ ID NO: 15110 - protein, 11 aa, Artificial Sequence
  Neurobeachin-like protein 1 (754-764)
GTIEKSKLITK

SEQ ID NO: 15111 - protein, 9 aa, Artificial Sequence
  Isoleucine-tRNA ligase, cytoplasmic (62-70)
GTIKDIVTR

SEQ ID NO: 15112 - protein, 12 aa, Artificial Sequence
  Histone H2B type 1-K (115-126)
GTKAVTKYTSAK

SEQ ID NO: 15113 - protein, 10 aa, Artificial Sequence
  Integrator complex subunit 5 (378-387)
GTLQPPFTAR

SEQ ID NO: 15114 - protein, 9 aa, Artificial Sequence
  Phosphomannomutase 1 (22-30)
GTLTPARQK

SEQ ID NO: 15115 - protein, 11 aa, Artificial Sequence
  Probable phospholipid-transporting ATPase IIA (238-248)
GTLTQNEMIFK

SEQ ID NO: 15116 - protein, 9 aa, Artificial Sequence
  Thioredoxin domain-containing protein 9 (203-211)
GTNFTKLEK

SEQ ID NO: 15117 - protein, 9 aa, Artificial Sequence
  Rho guanine nucleotide exchange factor 17 (1361-1369)
GTQGSPITK

SEQ ID NO: 15118 - protein, 10 aa, Artificial Sequence
  Inter-alpha-trypsin inhibitor heavy chain H5 (656-665)
GTQPGPLLKK

SEQ ID NO: 15119 - protein, 12 aa, Artificial Sequence
  Sorting nexin-1 (275-286)
GTQTLSGAGLLK

SEQ ID NO: 15120 - protein, 13 aa, Artificial Sequence
  HCLS1-binding protein 3 (136-148)
GTRSPGAAGLTSR

SEQ ID NO: 15121 - protein, 9 aa, Artificial Sequence
  Bardet-Biedl syndrome 10 protein (375-383)
GTSSLFIYK

SEQ ID NO: 15122 - protein, 9 aa, Artificial Sequence
  Proteasome subunit beta type-7 (229-237)
GTTAVLTEK

SEQ ID NO: 15123 - protein, 10 aa, Artificial Sequence
  E3 ubiquitin-protein ligase CBL (49-58)
GTVDKKMVEK

SEQ ID NO: 15124 - protein, 9 aa, Artificial Sequence
  E3 SUMO-protein ligase PIAS1 (411-419)
GTWAPMRSK

SEQ ID NO: 15125 - protein, 9 aa, Artificial Sequence
  Rho-associated protein kinase 2 (301-309)
GTYSKIMDH

SEQ ID NO: 15126 - protein, 9 aa, Artificial Sequence
  40S ribosomal protein S16 (64-72)
GVDIRVRVK

SEQ ID NO: 15127 - protein, 10 aa, Artificial Sequence
  Phosphoribosyl pyrophosphate synthase-associated protein 1 (94-103)
GVIPYFPYSK

SEQ ID NO: 15128 - protein, 9 aa, Artificial Sequence
  Tenascin (23-31)
GVLKKVIRH

SEQ ID NO: 15129 - protein, 9 aa, Artificial Sequence
  Sterol regulatory element-binding protein 2 (852-860)
GVMSPPLSR

SEQ ID NO: 15130 - protein, 10 aa, Artificial Sequence
  NADH dehydrogenase (ubiquinone) iron-sulfur protein 6, mitochondrial (29-38)
GVRVSPTGEK

SEQ ID NO: 15131 - protein, 9 aa, Artificial Sequence
  Double-strand-break repair protein rad21 homolog (62-70)
GVVRIYHRK

SEQ ID NO: 15132 - protein, 8 aa, Artificial Sequence
  Melanoma-associated antigen B2 (231-238)
GVYDGEEH

SEQ ID NO: 15133 - protein, 9 aa, Artificial Sequence
  RNA-binding motif, single-stranded-interacting protein 2 (399-407)
GVYSFQFNK

SEQ ID NO: 15134 - protein, 9 aa, Artificial Sequence
  Glutathione synthetase (158-166)
GYMPRQYSL

SEQ ID NO: 15135 - protein, 9 aa, Artificial Sequence
  Far upstream element-binding protein 3 (340-348)
HAAHIISEL

SEQ ID NO: 15136 - protein, 9 aa, Artificial Sequence
  Ectonucleoside triphosphate diphosphohydrolase 4 (473-481)
HADLHRLKY

SEQ ID NO: 15137 - protein, 9 aa, Artificial Sequence
  V-type proton ATPase subunit B, brain isoform (310-318)
HADVSNQLY

SEQ ID NO: 15138 - protein, 9 aa, Artificial Sequence
  BRCA1-A complex subunit BRE (227-235)
HALGGSSAL

SEQ ID NO: 15139 - protein, 8 aa, Artificial Sequence
  Dolichyl-diphosphooligosaccharide-proteinosyltransferase 48 kDa subunit (235-242)
HAVGKNTL

SEQ ID NO: 15140 - protein, 9 aa, Artificial Sequence
  Perilipin-3 (249-257)
HAYEHSLGK

SEQ ID NO: 15141 - protein, 9 aa, Artificial Sequence
  TBC1 domain family member 14 (206-214)
HEAEEGSKL

SEQ ID NO: 15142 - protein, 11 aa, Artificial Sequence
  DNA-directed RNA polymerases I and III subunit RPAC2 (45-55)
HEEDHTLGNSL

SEQ ID NO: 15143 - protein, 10 aa, Artificial Sequence
  Exosome complex exonuclease RRP44 (679-688)
HEEFSEHALL

SEQ ID NO: 15144 - protein, 9 aa, Artificial Sequence
  THO complex subunit 5 homolog (154-162)
HEEIDLVSL

SEQ ID NO: 15145 - protein, 9 aa, Artificial Sequence
  Tuftelin-interacting protein 11 (365-373)
HEERVISNL

SEQ ID NO: 15146 - protein, 9 aa, Artificial Sequence
  X-linked retinitis pigmentosa GTPase regulator (637-645)
HEFSKTEEL

SEQ ID NO: 15147 - protein, 9 aa, Artificial Sequence
  GON-4-like protein (1051-1059)
HEGGPDSKL

SEQ ID NO: 15148 - protein, 9 aa, Artificial Sequence
  AP-3 complex subunit delta-1 (103-111)
HEGTDVIML

SEQ ID NO: 15149 - protein, 9 aa, Artificial Sequence
  Gem-associated protein 5 (588-596)
HEHGSQPEL

SEQ ID NO: 15150 - protein, 9 aa, Artificial Sequence
  Zinc finger protein 644 (930-938)
HEIHDPQHL

SEQ ID NO: 15151 - protein, 9 aa, Artificial Sequence
  Glycerol-3-phosphate dehydrogenase, mitochondrial (539-547)
HEILNEVDL

SEQ ID NO: 15152 - protein, 9 aa, Artificial Sequence
  Eukaryotic translation initiation factor 3 subunit I (165-173)
HESGELNQY

SEQ ID NO: 15153 - protein, 9 aa, Artificial Sequence
  Insulin-like growth factor 2 mRNA-binding protein 2 (301-309)
HETGTKITI

SEQ ID NO: 15154 - protein, 9 aa, Artificial Sequence
  Inositol-trisphosphate 3-kinase B (874-882)
HEVIGSSLL

SEQ ID NO: 15155 - protein, 9 aa, Artificial Sequence
  Trabeculin-alpha (2620-2628)
HEVKEAQTL

SEQ ID NO: 15156 - protein, 10 aa, Artificial Sequence
  Translocation protein SEC62 (284-293)
HEYKGPKADL

SEQ ID NO: 15157 - protein, 8 aa, Artificial Sequence
  Bifunctional glutamate/proline-tRNA ligase (272-279)
HFETIMKY

SEQ ID NO: 15158 - protein, 9 aa, Artificial Sequence
  PTB domain-containing engulfment adapter protein 1 (23-31)
HFIPYNAKF

SEQ ID NO: 15159 - protein, 9 aa, Artificial Sequence
  Squalene synthase (268-276)
HHIPDVITY

SEQ ID NO: 15160 - protein, 9 aa, Artificial Sequence
  CD109 antigen (1425-1433)
HHSSVIFIF

SEQ ID NO: 15161 - protein, 9 aa, Artificial Sequence
  Protein Churchill (92-100)
HHVIARHEY

SEQ ID NO: 15162 - protein, 9 aa, Artificial Sequence
  SUN domain-containing protein 1 (591-599)
HHVSVTKQL

SEQ ID NO: 15163 - protein, 9 aa, Artificial Sequence
  Huntingtin (895-903)
HHYTGLLKL

SEQ ID NO: 15164 - protein, 11 aa, Artificial Sequence
  DNA-directed RNA polymerase III subunit RPC1 (122-132)
HIDEQSGKEKY

SEQ ID NO: 15165 - protein, 12 aa, Artificial Sequence
  GPI transamidase component PIG-T (548-559)
HIEEPRTGGLAK

SEQ ID NO: 15166 - protein, 9 aa, Artificial Sequence
  Peroxisomal acyl-coenzyme A oxidase 1 (21-29)
HILDGSPEK

SEQ ID NO: 15167 - protein, 11 aa, Artificial Sequence
  Kinesin-like protein KIF20B (82-92)
HILDSQTVVLK

SEQ ID NO: 15168 - protein, 10 aa, Artificial Sequence
  Protein polybromo-1 (618-627)
HILEKLLKEK

SEQ ID NO: 15169 - protein, 9 aa, Artificial Sequence
  ADNP homeobox protein 2 (899-907)
HIMPTVHTV

SEQ ID NO: 15170 - protein, 9 aa, Artificial Sequence
  Cytoskeleton-associated protein 5 (447-455)
HINDSAPEV

SEQ ID NO: 15171 - protein, 10 aa, Artificial Sequence
  Tumor suppressor candidate 3 (250-259)
HIRGPPYAHK

SEQ ID NO: 15172 - protein, 9 aa, Artificial Sequence
  E3 ubiquitin-protein ligase pellino homolog 3 (110-118)
HISTPLVSK

SEQ ID NO: 15173 - protein, 9 aa, Artificial Sequence
  Death-associated protein kinase 3 (166-174)
HKIEAGNEF

SEQ ID NO: 15174 - protein, 9 aa, Artificial Sequence
  Alpha-actinin-4 (413-421)
HLAEKFRQK

SEQ ID NO: 15175 - protein, 9 aa, Artificial Sequence
  Synembryn-A (382-390)
HLDTDVKRV

SEQ ID NO: 15176 - protein, 9 aa, Artificial Sequence
  CAD protein (188-196)
HLFNVAHTL

SEQ ID NO: 15177 - protein, 10 aa, Artificial Sequence
  AP-5 complex subunit zeta-1 (1130-1139)
HLFSGHLSTL

SEQ ID NO: 15178 - protein, 10 aa, Artificial Sequence
  Proteasome inhibitor PI31 subunit (116-125)
HLGDFHRTYK

SEQ ID NO: 15179 - protein, 9 aa, Artificial Sequence
  Cytoplasmic FMR1-interacting protein 1 (638-646)
HLINFSETL

SEQ ID NO: 15180 - protein, 11 aa, Artificial Sequence
  Centromere protein H (132-142)
HLLELNKLIMK

SEQ ID NO: 15181 - protein, 9 aa, Artificial Sequence
  Solute carrier family 35 member C2 (289-297)
HLLGDQISL

SEQ ID NO: 15182 - protein, 9 aa, Artificial Sequence
  Rotatin (987-995)
HLPVHVIGH

SEQ ID NO: 15183 - protein, 9 aa, Artificial Sequence
  SAP30-binding protein (125-133)
HLQDKIQKL

SEQ ID NO: 15184 - protein, 11 aa, Artificial Sequence
  Collagen alpha-1(XV) chain (1257-1267)
HLQDLSTIVRK

SEQ ID NO: 15185 - protein, 9 aa, Artificial Sequence
  Small integral membrane protein 17 (92-100)
HLTIMVAVV

SEQ ID NO: 15186 - protein, 10 aa, Artificial Sequence
  Dysbindin (37-46)
HLVEKQLISK

SEQ ID NO: 15187 - protein, 9 aa, Artificial Sequence
  Zinc finger and BTB domain-containing protein 7B (252-260)
HLVPEVPTV

SEQ ID NO: 15188 - protein, 10 aa, Artificial Sequence
  Ubinuclein-1 (86-95)
HLYEQGGRLK

SEQ ID NO: 15189 - protein, 10 aa, Artificial Sequence
  Fructosamine-3-kinase (111-120)
HLYNQKLREK

SEQ ID NO: 15190 - protein, 10 aa, Artificial Sequence
  Cysteine-tRNA ligase, cytoplasmic (30-39)
HLYNSLTRNK

SEQ ID NO: 15191 - protein, 9 aa, Artificial Sequence
  Protein TANC1 (1825-1833)
HLYQESISK

SEQ ID NO: 15192 - protein, 9 aa, Artificial Sequence
  Importin-7 (406-414)
HMIGSLAEI

SEQ ID NO: 15193 - protein, 11 aa, Artificial Sequence
  ATP-dependent RNA helicase DDX18 (255-265)
HMQNTPGFMYK

SEQ ID NO: 15194 - protein, 9 aa, Artificial Sequence
  Proline-rich protein 11 (150-158)
HMSGKLTNV

SEQ ID NO: 15195 - protein, 9 aa, Artificial Sequence
  Protein CutA (98-106)
HPYEVAEVI

SEQ ID NO: 15196 - protein, 9 aa, Artificial Sequence
  Cyclic AMP-dependent transcription factor ATF-6 beta (691-699)
HQASHQPLY

SEQ ID NO: 15197 - protein, 9 aa, Artificial Sequence
  NUAK family SNF1-like kinase 2 (201-209)
HQGKFLQTF

SEQ ID NO: 15198 - protein, 9 aa, Artificial Sequence
  Golgi resident protein GCP60 (496-504)
HQYPGRGVY

SEQ ID NO: 15199 - protein, 9 aa, Artificial Sequence
  Major prion protein (148-156)
HRYPNQVYY

SEQ ID NO: 15200 - protein, 9 aa, Artificial Sequence
  STAGA complex 65 subunit gamma (129-137)
HSDPESDFY

SEQ ID NO: 15201 - protein, 9 aa, Artificial Sequence
  Histone-lysine N-methyltransferase NSD3 (877-885)
HSDPMFSSY

SEQ ID NO: 15202 - protein, 10 aa, Artificial Sequence
  Protein FAM135A (1394-1403)
HSDPRQTFLY

SEQ ID NO: 15203 - protein, 9 aa, Artificial Sequence
  PERQ amino acid-rich with GYF domain-containing protein 1 (731-739)
HSDPSILGY

SEQ ID NO: 15204 - protein, 9 aa, Artificial Sequence
  NAD(P)H dehydrogenase (quinone) 1 (9-17)
HSERTSFNY

SEQ ID NO: 15205 - protein, 11 aa, Artificial Sequence
  Heterogeneous nuclear ribonucleoproteins A2/B1 (72-82)
HSIDGRVVEPK

SEQ ID NO: 15206 - protein, 10 aa, Artificial Sequence
  Rho-related BTB domain-containing protein 3 (176-185)
HSLDDFYIGK

SEQ ID NO: 15207 - protein, 9 aa, Artificial Sequence
  Cytochrome c1, heme protein, mitochondrial (27-35)
HSMDFVAYR

SEQ ID NO: 15208 - protein, 9 aa, Artificial Sequence
  FUN14 domain-containing protein 1 (39-47)
HSSGPMVEK

SEQ ID NO: 15209 - protein, 9 aa, Artificial Sequence
  Isocitrate dehydrogenase (NAD) subunit gamma, mitochondrial (342-350)
HSYATSIRK

SEQ ID NO: 15210 - protein, 9 aa, Artificial Sequence
  KAT8 regulatory NSL complex subunit 1 (802-810)
HTDMSSSSY

SEQ ID NO: 15211 - protein, 10 aa, Artificial Sequence
  Histone-lysine N-methyltransferase SETD1A (230-239)
HTITNLTTPK

SEQ ID NO: 15212 - protein, 11 aa, Artificial Sequence
  DNA damage-binding protein 2 (96-106)
HTLDSYRILQK

SEQ ID NO: 15213 - protein, 9 aa, Artificial Sequence
  Transmembraneoprotein NMB (178-186)
HTLGQYFQK

SEQ ID NO: 15214 - protein, 9 aa, Artificial Sequence
  Necdin (95-103)
HTMEFALVK

SEQ ID NO: 15215 - protein, 9 aa, Artificial Sequence
  Integrin beta-5 (781-789)
HTVDFTFNK

SEQ ID NO: 15216 - protein, 9 aa, Artificial Sequence
  Histone-lysine N-methyltransferase 2A (25-33)
HVDQDLTTY

SEQ ID NO: 15217 - protein, 9 aa, Artificial Sequence
  Adapter protein CIKS (72-80)
HVYSWPKNK

SEQ ID NO: 15218 - protein, 9 aa, Artificial Sequence
  KN motif and ankyrin repeat domain-containing protein 1 (825-833)
HYIERIQKL

SEQ ID NO: 15219 - protein, 9 aa, Artificial Sequence
  Astrotactin-2 (291-299)
HYNSHYEKF

SEQ ID NO: 15220 - protein, 9 aa, Artificial Sequence
  Tensin-1 (1660-1668)
HYPLNTVTF

SEQ ID NO: 15221 - protein, 9 aa, Artificial Sequence
  Kelch-like protein 15 (472-480)
HYSDSILTF

SEQ ID NO: 15222 - protein, 9 aa, Artificial Sequence
  ATP-dependent RNA helicase DHX36 (726-734)
IADARRKEL

SEQ ID NO: 15223 - protein, 10 aa, Artificial Sequence
  Small ubiquitin-related modifier 1 (46-55)
IADNHTPKEL

SEQ ID NO: 15224 - protein, 9 aa, Artificial Sequence
  Sarcoplasmic/endoplasmic reticulum calcium ATPase 1 (718-726)
IAMGSGTAV

SEQ ID NO: 15225 - protein, 10 aa, Artificial Sequence
  DNA-directed RNA polymerase I subunit RPA1 (1631-1640)
IAVDPRHLSL

SEQ ID NO: 15226 - protein, 9 aa, Artificial Sequence
  Derlin-3 (176-184)
IAVGHIYYF

SEQ ID NO: 15227 - protein, 11 aa, Artificial Sequence
  CD99 antigen (129-139)
IAYQKKKLCFK

SEQ ID NO: 15228 - protein, 9 aa, Artificial Sequence
  Dolichyl-diphosphooligosaccharide-proteinosyltransferase subunit 1 (381-389)
IEIDSPYEI

SEQ ID NO: 15229 - protein, 9 aa, Artificial Sequence
  NEDD8-activating enzyme E1 regulatory subunit (166-174)
IESHPDNAL

SEQ ID NO: 15230 - protein, 9 aa, Artificial Sequence
  Splicing factor 3A subunit 1 (762-770)
IFIKDSNSL

SEQ ID NO: 15231 - protein, 9 aa, Artificial Sequence
  Retinoic acid receptor RXR-gamma (443-451)
IGDTPIDTF

SEQ ID NO: 15232 - protein, 9 aa, Artificial Sequence
  C-myc promoter-binding protein (1082-1090)
IGKPPLRSK

SEQ ID NO: 15233 - protein, 9 aa, Artificial Sequence
  Serine/threonine-protein kinase tousled-like 2 (421-429)
IHNEDNSQF

SEQ ID NO: 15234 - protein, 9 aa, Artificial Sequence
  Exportin-2 (769-777)
IIIPEIQKV

SEQ ID NO: 15235 - protein, 9 aa, Artificial Sequence
  Cytoplasmic dynein 1 heavy chain 1 (201-209)
IITKDLFQV

SEQ ID NO: 15236 - protein, 9 aa, Artificial Sequence
  Renin receptor (326-334)
IIYRMTNQK

SEQ ID NO: 15237 - protein, 13 aa, Artificial Sequence
  Putative heat shock 70 kDa protein 7 (30-42)
ILANDQGNRTTPS

SEQ ID NO: 15238 - protein, 9 aa, Artificial Sequence
  Very-long-chain enoyl-CoA reductase (8-16)
ILDAKTREK

SEQ ID NO: 15239 - protein, 11 aa, Artificial Sequence
  Ribosome-binding protein 1 (545-555)
ILEDEQTQRQK

SEQ ID NO: 15240 - protein, 10 aa, Artificial Sequence
  60S ribosomal protein L19 (118-127)
ILMEHIHKLK

SEQ ID NO: 15241 - protein, 9 aa, Artificial Sequence
  Chromobox protein homolog 6 (175-183)
ILNLKVIDK

SEQ ID NO: 15242 - protein, 10 aa, Artificial Sequence
  A-kinase anchor protein 8-like (468-477)
ILNNKLISKK

SEQ ID NO: 15243 - protein, 12 aa, Artificial Sequence
  Replication factor C subunit 3 (55-66)
ILRELYGVGVEK

SEQ ID NO: 15244 - protein, 11 aa, Artificial Sequence
  Beta-crystallin B2 (110-120)
ILYENPNFTGK

SEQ ID NO: 15245 - protein, 12 aa, Artificial Sequence
  Discoidin, CUB and LCCL domain-containing protein 2 (337-348)
ILYSDDGQKWTV

SEQ ID NO: 15246 - protein, 9 aa, Artificial Sequence
  Tight junction protein ZO-1 (1314-1322)
IPEPQKPQL

SEQ ID NO: 15247 - protein, 9 aa, Artificial Sequence
  Histone H2A.V (85-93)
IPHIHKSLI

SEQ ID NO: 15248 - protein, 9 aa, Artificial Sequence
  Msx2-interacting protein (466-474)
IPIPTLPSV

SEQ ID NO: 15249 - protein, 9 aa, Artificial Sequence
  Histone-lysine N-methyltransferase 2E (370-378)
IPKGTEITI

SEQ ID NO: 15250 - protein, 9 aa, Artificial Sequence
  E3 ubiquitin-protein ligase UBR4 (92-100)
IPRNQLQSV

SEQ ID NO: 15251 - protein, 9 aa, Artificial Sequence
  Nucleoporin GLE1 (428-436)
IPVSQISTI

SEQ ID NO: 15252 - protein, 9 aa, Artificial Sequence
  ER membrane protein complex subunit 1 (895-903)
IPYSPDVQI

SEQ ID NO: 15253 - protein, 11 aa, Artificial Sequence
  Elongator complex protein 6 (249-259)
IQDKSVSFFAK

SEQ ID NO: 15254 - protein, 9 aa, Artificial Sequence
  GPI transamidase component PIG-T (440-448)
IQFERALLK

SEQ ID NO: 15255 - protein, 10 aa, Artificial Sequence
  Kelch domain-containing protein 2 (308-317)
IQFNHPYTEK

SEQ ID NO: 15256 - protein, 9 aa, Artificial Sequence
  Helicase with zinc finger domain 2 (2172-2180)
IQGPPGTGK

SEQ ID NO: 15257 - protein, 9 aa, Artificial Sequence
  Large proline-rich protein BAG6 (377-385)
IQINVGTTV

SEQ ID NO: 15258 - protein, 10 aa, Artificial Sequence
  Focadhesin (263-272)
IQLTQMSLQL

SEQ ID NO: 15259 - protein, 12 aa, Artificial Sequence
  Beta-2-microglobulin (21-32)
IQRTPKIQVYSR

SEQ ID NO: 15260 - protein, 10 aa, Artificial Sequence
  26S proteasome non-ATPase regulatory subunit 7 (266-275)
IRSVVALHNL

SEQ ID NO: 15261 - protein, 9 aa, Artificial Sequence
  Kinesin-like protein KIF20B (1684-1692)
ISDDRNSSV

SEQ ID NO: 15262 - protein, 9 aa, Artificial Sequence
  Sperm-specific antigen 2 (226-234)
ISDEANSNF

SEQ ID NO: 15263 - protein, 9 aa, Artificial Sequence
  Lysosome-associated membraneoprotein 2 (66-74)
ISDHGTVTY

SEQ ID NO: 15264 - protein, 9 aa, Artificial Sequence
  Dolichyl-diphosphooligosaccharide-proteinosyltransferase 48 kDa subunit (164-172)
ISDLGQHTL

SEQ ID NO: 15265 - protein, 9 aa, Artificial Sequence
  Dynamin-1-like protein (174-182)
ISNPNSIIL

SEQ ID NO: 15266 - protein, 9 aa, Artificial Sequence
  HEAT repeat-containing protein 1 (915-923)
ISSPVVTSL

SEQ ID NO: 15267 - protein, 11 aa, Artificial Sequence
  UBAP1-MVB12-associated (UMA)-domain containing protein 1 isoform b (69-79)
ITDLPDHLLSY

SEQ ID NO: 15268 - protein, 9 aa, Artificial Sequence
  U4/U6.U5 tri-snRNP-associated protein 2 (264-272)
ITEKEYKTY

SEQ ID NO: 15269 - protein, 10 aa, Artificial Sequence
  T-complex protein 1 subunit delta (70-79)
ITNDGATILK

SEQ ID NO: 15270 - protein, 11 aa, Artificial Sequence
  Cytoplasmic dynein 2 heavy chain 1 (74-84)
ITYESPPGLKK

SEQ ID NO: 15271 - protein, 11 aa, Artificial Sequence
  Isocitrate dehydrogenase (NADP) cytoplasmic (55-65)
ITYTPSDGTQK

SEQ ID NO: 15272 - protein, 9 aa, Artificial Sequence
  ATP-binding cassette sub-family F member 1 (656-664)
IVGPNGVGK

SEQ ID NO: 15273 - protein, 13 aa, Artificial Sequence
  Glia-derived nexin (119-131)
IVTVANAVFVKNA

SEQ ID NO: 15274 - protein, 10 aa, Artificial Sequence
  Protein enabled homolog (37-46)
IYHHTGNNTF

SEQ ID NO: 15275 - protein, 9 aa, Artificial Sequence
  Vacuolar protein sorting-associated protein 13C (1267-1275)
IYHPDIQLL

SEQ ID NO: 15276 - protein, 9 aa, Artificial Sequence
  Calpain-5 (449-457)
IYINSRSVF

SEQ ID NO: 15277 - protein, 9 aa, Artificial Sequence
  Cyclin E variant ex7del (19-27)
IYPPKLHQF

SEQ ID NO: 15278 - protein, 9 aa, Artificial Sequence
  BTB/POZ domain-containing protein 10 (83-91)
IYSTKLYRF

SEQ ID NO: 15279 - protein, 10 aa, Artificial Sequence
  Beta-soluble NSF attachment protein (71-80)
IYTDMGRFTI

SEQ ID NO: 15280 - protein, 9 aa, Artificial Sequence
  WD repeat-containing protein 1 (53-61)
IYTEHAHQV

SEQ ID NO: 15281 - protein, 9 aa, Artificial Sequence
  SMC5-SMC6 complex localization factor protein 2 (149-157)
IYVPSSYHL

SEQ ID NO: 15282 - protein, 11 aa, Artificial Sequence
  WW domain-binding protein 2 (229-239)
KAAEAAASAYY

SEQ ID NO: 15283 - protein, 9 aa, Artificial Sequence
  40S ribosomal protein S17 (11-19)
KAARVIIEK

SEQ ID NO: 15284 - protein, 9 aa, Artificial Sequence
  F-box/WD repeat-containing protein 8 (325-333)
KAEDSARTL

SEQ ID NO: 15285 - protein, 12 aa, Artificial Sequence
  Vacuolar fusion protein CCZ1 homolog (154-165)
KAMEDGGVKLLK

SEQ ID NO: 15286 - protein, 9 aa, Artificial Sequence
  Ceramide synthase 2 (35-43)
KASDLYITL

SEQ ID NO: 15287 - protein, 9 aa, Artificial Sequence
  Vacuolar protein sorting-associated protein 11 homolog (811-819)
KASPKIFQK

SEQ ID NO: 15288 - protein, 9 aa, Artificial Sequence
  60S ribosomal protein L4 (175-183)
KAWNDIKKV

SEQ ID NO: 15289 - protein, 11 aa, Artificial Sequence
  Replication protein A 70 kDa DNA-binding subunit (157-167)
KAYGASKTFGK

SEQ ID NO: 15290 - protein, 12 aa, Artificial Sequence
  NHP2-like protein 1 (9-20)
KAYPLADAHLTK

SEQ ID NO: 15291 - protein, 9 aa, Artificial Sequence
  WD repeat-containing protein WRAP73 (276-284)
KEAEKSPQL

SEQ ID NO: 15292 - protein, 10 aa, Artificial Sequence
  Kinesin-like protein KIF20A (425-434)
KEAGNINTSL

SEQ ID NO: 15293 - protein, 10 aa, Artificial Sequence
  Golgin subfamily B member 1 (533-542)
KEAQEEIAFL

SEQ ID NO: 15294 - protein, 10 aa, Artificial Sequence
  Transmembrane protein 165 (82-91)
KEDPATQTNL

SEQ ID NO: 15295 - protein, 9 aa, Artificial Sequence
  Zinc finger protein AEBP2 (439-447)
KEDSGKIKL

SEQ ID NO: 15296 - protein, 9 aa, Artificial Sequence
  Charged multivesicular body protein 4a (192-200)
KEEEPSVKL

SEQ ID NO: 15297 - protein, 9 aa, Artificial Sequence
  E3 ubiquitin-protein ligase makorin-1 (351-359)
KEEKQKLIL

SEQ ID NO: 15298 - protein, 9 aa, Artificial Sequence
  DNA topoisomerase I, mitochondrial (544-552)
KEENKQVAL

SEQ ID NO: 15299 - protein, 11 aa, Artificial Sequence
  DNA damage-binding protein 1 (287-297)
KEEQMDGTVTL

SEQ ID NO: 15300 - protein, 10 aa, Artificial Sequence
  TATA element modulatory factor (490-499)
KEESSSISSL

SEQ ID NO: 15301 - protein, 9 aa, Artificial Sequence
  Transcriptional adapter 3 (372-380)
KEEVSRQEL

SEQ ID NO: 15302 - protein, 9 aa, Artificial Sequence
  Peptidyl-prolyl cis-trans isomerase-like 2 (4-12)
KEFKGDEIL

SEQ ID NO: 15303 - protein, 10 aa, Artificial Sequence
  Protein transport protein Sec31A (436-445)
KEFLSRSDQL

SEQ ID NO: 15304 - protein, 9 aa, Artificial Sequence
  Heterogeneous nuclear ribonucleoprotein Q (66-74)
KEFNEDGAL

SEQ ID NO: 15305 - protein, 9 aa, Artificial Sequence
  CUGBP Elav-like family member 2 (417-425)
KEGPEGANL

SEQ ID NO: 15306 - protein, 9 aa, Artificial Sequence
  Nuclear nucleic acid-binding protein C1D (79-87)
KEHPVKQEL

SEQ ID NO: 15307 - protein, 10 aa, Artificial Sequence
  Trafficking kinesin-binding protein 2 (299-308)
KEHVIEKEEL

SEQ ID NO: 15308 - protein, 11 aa, Artificial Sequence
  HEAT repeat-containing protein 1 (449-459)
KEIADLKKQEL

SEQ ID NO: 15309 - protein, 10 aa, Artificial Sequence
  Serine palmitoyltransferase 2 (526-535)
KEIDEVGDLL

SEQ ID NO: 15310 - protein, 10 aa, Artificial Sequence
  (Pyruvate dehydrogenase (acetyl-transferring)) kinase isozyme 4, mitochondrial (34-43)
KEIDILPTQL

SEQ ID NO: 15311 - protein, 11 aa, Artificial Sequence
  Cytochrome b-c1 complex subunit Rieske, mitochondrial (182-192)
KEIEQEAAVEL

SEQ ID NO: 15312 - protein, 11 aa, Artificial Sequence
  40S ribosomal protein S7 (47-57)
KEIEVGGGRKA

SEQ ID NO: 15313 - protein, 9 aa, Artificial Sequence
  RuvB-like 1 (172-180)
KEIIQDVTL

SEQ ID NO: 15314 - protein, 10 aa, Artificial Sequence
  Structural maintenance of chromosomes protein 4 (263-272)
KEINEKSNIL

SEQ ID NO: 15315 - protein, 10 aa, Artificial Sequence
  Deoxynucleotidyltransferase terminal-interacting protein 2 (311-320)
KEINEKSSQL

SEQ ID NO: 15316 - protein, 9 aa, Artificial Sequence
  Protein bicaudal D homolog 2 (150-158)
KEINQNVEI

SEQ ID NO: 15317 - protein, 9 aa, Artificial Sequence
  Nibrin (635-643)
KEISNNDKL

SEQ ID NO: 15318 - protein, 11 aa, Artificial Sequence
  SNW domain-containing protein 1 (141-151)
KEITEKTRVAL

SEQ ID NO: 15319 - protein, 9 aa, Artificial Sequence
  Sperm-associated antigen 5 (893-901)
KEKTEQETL

SEQ ID NO: 15320 - protein, 10 aa, Artificial Sequence
  Microfibrillar-associated protein 1 (250-259)
KELEENKRSL

SEQ ID NO: 15321 - protein, 9 aa, Artificial Sequence
  LYR motif-containing protein 2 (77-85)
KELEKTLAL

SEQ ID NO: 15322 - protein, 10 aa, Artificial Sequence
  Prefoldin subunit 1 (92-101)
KELEQKKSYL

SEQ ID NO: 15323 - protein, 10 aa, Artificial Sequence
  Developmentally-regulated GTP-binding protein 2 (161-170)
KELESVGIRL

SEQ ID NO: 15324 - protein, 10 aa, Artificial Sequence
  Ancient ubiquitous protein 1 (250-259)
KELGQTGTRL

SEQ ID NO: 15325 - protein, 10 aa, Artificial Sequence
  U2 small nuclear ribonucleoprotein B'' (57-66)
KELGSSTNAL

SEQ ID NO: 15326 - protein, 10 aa, Artificial Sequence
  TSC22 domain family protein 1 (1011-1020)
KELIEKNSQL

SEQ ID NO: 15327 - protein, 10 aa, Artificial Sequence
  Bifunctional 3'-phosphoadenosine 5'-phosphosulfate synthase 1 (235-244)
KELYVPENKL

SEQ ID NO: 15328 - protein, 11 aa, Artificial Sequence
  Polymerase I and transcript release factor (170-180)
KENLEKTRHTL

SEQ ID NO: 15329 - protein, 9 aa, Artificial Sequence
  SCY1-like protein 2 (264-272)
KEQEQAQKL

SEQ ID NO: 15330 - protein, 10 aa, Artificial Sequence
  Corepressor interacting with RBPJ 1 (48-57)
KEQESYDNRL

SEQ ID NO: 15331 - protein, 9 aa, Artificial Sequence
  Kinesin-like protein (323-331)
KEQITISQL

SEQ ID NO: 15332 - protein, 10 aa, Artificial Sequence
  Catenin alpha-1 (81-90)
KESQFLKEEL

SEQ ID NO: 15333 - protein, 9 aa, Artificial Sequence
  General transcription factor II-I repeat domain-containing protein 1 (343-351)
KETEDINTL

SEQ ID NO: 15334 - protein, 9 aa, Artificial Sequence
  Endothelial PAS domain-containing protein 1 (29-37)
KETEVFYEL

SEQ ID NO: 15335 - protein, 11 aa, Artificial Sequence
  Activator of 90 kDa heat shock protein ATPase homolog 1 (136-146)
KETFLTSPEEL

SEQ ID NO: 15336 - protein, 9 aa, Artificial Sequence
  Double-strand-break repair protein rad21 homolog (364-372)
KETGGVEKL

SEQ ID NO: 15337 - protein, 10 aa, Artificial Sequence
  Transcription factor BTF3 (46-55)
KETIMNQEKL

SEQ ID NO: 15338 - protein, 9 aa, Artificial Sequence
  RNA-binding protein PNO1 (122-130)
KETKDVSAL

SEQ ID NO: 15339 - protein, 9 aa, Artificial Sequence
  Spectrin beta chain, non-erythrocytic 1 (832-840)
KEVAELTRL

SEQ ID NO: 15340 - protein, 10 aa, Artificial Sequence
  Sequestosome-1 (324-333)
KEVDPSTGEL

SEQ ID NO: 15341 - protein, 10 aa, Artificial Sequence
  Vacuolar protein sorting-associated protein 52 homolog (10-19)
KEVESFQQLL

SEQ ID NO: 15342 - protein, 10 aa, Artificial Sequence
  Sodium/potassium-transporting ATPase subunit alpha-1 (37-46)
KEVSMDDHKL

SEQ ID NO: 15343 - protein, 11 aa, Artificial Sequence
  Actin-related protein 5 (555-565)
KEYEEKGGEYL

SEQ ID NO: 15344 - protein, 9 aa, Artificial Sequence
  Erythrocyte band 7 integral membrane protein (58-66)
KEYERAIIF

SEQ ID NO: 15345 - protein, 9 aa, Artificial Sequence
  Son of sevenless homolog 1 (679-687)
KEYIQPVQL

SEQ ID NO: 15346 - protein, 9 aa, Artificial Sequence
  Ran-binding protein 17 (349-357)
KEYPEVIRL

SEQ ID NO: 15347 - protein, 12 aa, Artificial Sequence
  Intermediate filament family orphan 2 (103-114)
KEYQETIGQIEL

SEQ ID NO: 15348 - protein, 9 aa, Artificial Sequence
  Mitochondrial ubiquitin ligase activator of NFKB 1 (158-166)
KFHPSIQSF

SEQ ID NO: 15349 - protein, 10 aa, Artificial Sequence
  Structural maintenance of chromosomes protein 4 (295-304)
KFIEENKEKF

SEQ ID NO: 15350 - protein, 9 aa, Artificial Sequence
  NADH dehydrogenase (ubiquinone) 1 alpha subcomplex subunit 12 (107-115)
KFIWTNHKF

SEQ ID NO: 15351 - protein, 9 aa, Artificial Sequence
  Kelch domain-containing protein 3 (136-144)
KFNPVSFTW

SEQ ID NO: 15352 - protein, 9 aa, Artificial Sequence
  Bromodomain and WD repeat-containing protein 1 (309-317)
KFSPRPLKF

SEQ ID NO: 15353 - protein, 9 aa, Artificial Sequence
  Protein SHQ1 homolog (255-263)
KFVNKSYLL

SEQ ID NO: 15354 - protein, 9 aa, Artificial Sequence
  Tyrosine-protein phosphatase non-receptor type 9 (176-184)
KGAFPARLK

SEQ ID NO: 15355 - protein, 9 aa, Artificial Sequence
  Protein SCAF8 (528-536)
KGLPPIRSK

SEQ ID NO: 15356 - protein, 9 aa, Artificial Sequence
  BTB/POZ domain-containing adapter for CUL3-mediated RhoA degradation protein 2 (78-86)
KHFGTILNY

SEQ ID NO: 15357 - protein, 9 aa, Artificial Sequence
  Hsp90 co-chaperone Cdc37 (147-155)
KHKTFVEKY

SEQ ID NO: 15358 - protein, 9 aa, Artificial Sequence
  Transcription intermediary factor 1-beta (340-348)
KHQEHILRF

SEQ ID NO: 15359 - protein, 9 aa, Artificial Sequence
  Proliferating cell nuclear antigen (240-248)
KIADMGHLK

SEQ ID NO: 15360 - protein, 9 aa, Artificial Sequence
  Ubiquitin-conjugating enzyme E2 G2 (125-133)
KIAKQIVQK

SEQ ID NO: 15361 - protein, 9 aa, Artificial Sequence
  Signal peptidase complex subunit 2 (40-48)
KIDDKPVKI

SEQ ID NO: 15362 - protein, 9 aa, Artificial Sequence
  T-box transcription factor TBX3 (273-281)
KIDNNPFAK

SEQ ID NO: 15363 - protein, 9 aa, Artificial Sequence
  Myeloid leukemia factor 1 (90-98)
KIGDEPPKV

SEQ ID NO: 15364 - protein, 9 aa, Artificial Sequence
  Ras GTPase-activating-like protein IQGAP1 (916-924)
KIGLLVKNK

SEQ ID NO: 15365 - protein, 11 aa, Artificial Sequence
  Replication factor C subunit 1 (468-478)
KIIDEDGLLNL

SEQ ID NO: 15366 - protein, 9 aa, Artificial Sequence
  Nucleoprotein TPR (1420-1428)
KIIDIQEKV

SEQ ID NO: 15367 - protein, 9 aa, Artificial Sequence
  Importin-8 (102-110)
KILDQYRQK

SEQ ID NO: 15368 - protein, 11 aa, Artificial Sequence
  Sorting nexin-14 (635-645)
KILPDVNLGKI

SEQ ID NO: 15369 - protein, 9 aa, Artificial Sequence
  V-type proton ATPase subunit E 2 (52-60)
KIMEYYEKK

SEQ ID NO: 15370 - protein, 9 aa, Artificial Sequence
  Heat shock protein HSP 90-alpha (389-397)
KIMKDILEK

SEQ ID NO: 15371 - protein, 9 aa, Artificial Sequence
  Calcium-independent phospholipase A2-gamma (789-797)
KINDWIKLK

SEQ ID NO: 15372 - protein, 9 aa, Artificial Sequence
  Heterogeneous nuclear ribonucleoprotein U-like protein 1 (262-270)
KINEEISVK

SEQ ID NO: 15373 - protein, 10 aa, Artificial Sequence
  UDP-glucose:glycoprotein glucosyltransferase 2 (148-157)
KINEIKKLLK

SEQ ID NO: 15374 - protein, 10 aa, Artificial Sequence
  Serine/threonine-protein phosphatase 4 regulatory subunit 3B (55-64)
KINPNTAYQK

SEQ ID NO: 15375 - protein, 10 aa, Artificial Sequence
  Oral-facial-digital syndrome 1 protein (116-125)
KINPTSSLYK

SEQ ID NO: 15376 - protein, 9 aa, Artificial Sequence
  Poly(A) polymerase alpha (641-649)
KIPTPIVGV

SEQ ID NO: 15377 - protein, 9 aa, Artificial Sequence
  Prefoldin subunit 5 (129-137)
KIQPALQEK

SEQ ID NO: 15378 - protein, 12 aa, Artificial Sequence
  Oxysterol-binding protein-related protein 9 (687-698)
KIRDIDAATEAK

SEQ ID NO: 15379 - protein, 9 aa, Artificial Sequence
  Protein IMPACT (108-116)
KIRDVLIQK

SEQ ID NO: 15380 - protein, 10 aa, Artificial Sequence
  Proto-oncogene tyrosine-protein kinase receptor Ret (156-165)
KIREYEQTLK

SEQ ID NO: 15381 - protein, 10 aa, Artificial Sequence
  Heat shock factor protein 1 (131-140)
KIRQDSVTKL

SEQ ID NO: 15382 - protein, 12 aa, Artificial Sequence
  PDZ domain-containing RING finger protein 4 (443-454)
KIRSDGTRYITK

SEQ ID NO: 15383 - protein, 11 aa, Artificial Sequence
  Insulin-like growth factor I (3-13)
KISSLPTQLFK

SEQ ID NO: 15384 - protein, 9 aa, Artificial Sequence
  Importin-7 (419-427)
KIYKDQMEY

SEQ ID NO: 15385 - protein, 9 aa, Artificial Sequence
  Mothers against decapentaplegic homolog 4 (428-436)
KIYPSAYIK

SEQ ID NO: 15386 - protein, 9 aa, Artificial Sequence
  RING finger protein 113A (151-159)
KIYRGINNY

SEQ ID NO: 15387 - protein, 10 aa, Artificial Sequence
  Prefoldin subunit 1 (28-37)
KLADIQIEQL

SEQ ID NO: 15388 - protein, 12 aa, Artificial Sequence
  DNA topoisomerase 2-alpha (976-987)
KLAEAERVGLHK

SEQ ID NO: 15389 - protein, 9 aa, Artificial Sequence
  Retinoblastoma-like protein 1 (329-337)
KLAEILYYK

SEQ ID NO: 15390 - protein, 9 aa, Artificial Sequence
  Neuron navigator 3 (940-948)
KLAEYVITK

SEQ ID NO: 15391 - protein, 11 aa, Artificial Sequence
  Protein PRR14L (1625-1635)
KLAPAMKTQKL

SEQ ID NO: 15392 - protein, 9 aa, Artificial Sequence
  Ubiquitin-40S ribosomal protein S27a (95-103)
KLAVLKYYK

SEQ ID NO: 15393 - protein, 10 aa, Artificial Sequence
  Disco-interacting protein 2 homolog A (376-385)
KLAYTLLNKL

SEQ ID NO: 15394 - protein, 9 aa, Artificial Sequence
  Conserved oligomeric Golgi complex subunit 3 (394-402)
KLDELLEKL

SEQ ID NO: 15395 - protein, 10 aa, Artificial Sequence
  REST corepressor 1 (145-154)
KLDEYIAIAK

SEQ ID NO: 15396 - protein, 10 aa, Artificial Sequence
  40S ribosomal protein S7 (145-154)
KLDGSRLIKV

SEQ ID NO: 15397 - protein, 9 aa, Artificial Sequence
  CASP8-associated protein 2 (343-351)
KLDKNPNQV

SEQ ID NO: 15398 - protein, 9 aa, Artificial Sequence
  Cysteine and histidine-rich protein 1 (100-108)
KLEERLYSV

SEQ ID NO: 15399 - protein, 9 aa, Artificial Sequence
  Glutathione S-transferase omega-1 (152-160)
KLEEVLTNK

SEQ ID NO: 15400 - protein, 11 aa, Artificial Sequence
  Thioredoxin domain-containing protein 5 (32-42)
KLFKPGQEAVK

SEQ ID NO: 15401 - protein, 11 aa, Artificial Sequence
  Mitotic checkpoint serine/threonine-protein kinase BUB1 (954-964)
KLFPKGTIFTA

SEQ ID NO: 15402 - protein, 9 aa, Artificial Sequence
  Vacuolar protein sorting-associated protein 11 homolog (687-695)
KLFQQIMHY

SEQ ID NO: 15403 - protein, 13 aa, Artificial Sequence
  YEATS domain-containing protein 4 (115-127)
KLFQSDTNAMLGK

SEQ ID NO: 15404 - protein, 9 aa, Artificial Sequence
  Peroxisomal acyl-coenzyme A oxidase 1 (537-545)
KLFSEKLLK

SEQ ID NO: 15405 - protein, 11 aa, Artificial Sequence
  28S ribosomal protein S33, mitochondrial (35-45)
KLFSELPLAKK

SEQ ID NO: 15406 - protein, 9 aa, Artificial Sequence
  BAH and coiled-coil domain-containing protein 1 (52-60)
KLFYKAIVR

SEQ ID NO: 15407 - protein, 10 aa, Artificial Sequence
  Nucleolar protein 58 (93-102)
KLGGVIKEKL

SEQ ID NO: 15408 - protein, 10 aa, Artificial Sequence
  Histone H1.2 (81-90)
KLGLKSLVSK

SEQ ID NO: 15409 - protein, 9 aa, Artificial Sequence
  Cytochrome c oxidase subunit NDUFA4 (39-47)
KLGPNDQYK

SEQ ID NO: 15410 - protein, 9 aa, Artificial Sequence
  DCC-interacting protein 13-alpha (553-561)
KLIDPQTQV

SEQ ID NO: 15411 - protein, 9 aa, Artificial Sequence
  DNA topoisomerase 2-beta (209-217)
KLIEVVKKK

SEQ ID NO: 15412 - protein, 9 aa, Artificial Sequence
  Dynactin subunit 4 (146-154)
KLIEYYQQL

SEQ ID NO: 15413 - protein, 10 aa, Artificial Sequence
  Glycerol-3-phosphate dehydrogenase 1-like protein (55-64)
KLISDIIREK

SEQ ID NO: 15414 - protein, 9 aa, Artificial Sequence
  Spectrin beta chain, non-erythrocytic 1 (387-395)
KLISDINKA

SEQ ID NO: 15415 - protein, 13 aa, Artificial Sequence
  Transcription elongation factor B polypeptide 1 (4-16)
KLISSDGHEFIVK

SEQ ID NO: 15416 - protein, 9 aa, Artificial Sequence
  Vacuolar protein sorting-associated protein 4B (71-79)
KLKEYLKNK

SEQ ID NO: 15417 - protein, 12 aa, Artificial Sequence
  Heterogeneous nuclear ribonucleoproteins C1/C2 (187-198)
KLKGDDLQAIKK

SEQ ID NO: 15418 - protein, 11 aa, Artificial Sequence
  Tight junction-associated protein 1 (150-160)
KLLDAKNTINK

SEQ ID NO: 15419 - protein, 11 aa, Artificial Sequence
  26S proteasome non-ATPase regulatory subunit 7 (204-214)
KLLDIRSYLEK

SEQ ID NO: 15420 - protein, 11 aa, Artificial Sequence
  Methionine-tRNA ligase, cytoplasmic (453-463)
KLLDLKKQLAV

SEQ ID NO: 15421 - protein, 9 aa, Artificial Sequence
  Dihydrolipoyllysine-residue succinyltransferase component of 2-oxoglutarate dehydrogenase complex, mitochondrial (80-88)
KLLETQLQK

SEQ ID NO: 15422 - protein, 10 aa, Artificial Sequence
  Aspartate-tRNA ligase, cytoplasmic (373-382)
KLLGHLVKEK

SEQ ID NO: 15423 - protein, 9 aa, Artificial Sequence
  U3 small nucleolar ribonucleoprotein protein IMP3 (11-19)
KLLKQVDFL

SEQ ID NO: 15424 - protein, 9 aa, Artificial Sequence
  Protein Smaug homolog 1 (103-111)
KLLPKILAH

SEQ ID NO: 15425 - protein, 9 aa, Artificial Sequence
  Box C/D snoRNA protein 1 (321-329)
KLLPNGFTK

SEQ ID NO: 15426 - protein, 9 aa, Artificial Sequence
  Anaphase-promoting complex subunit 5 (482-490)
KLLQKLLVH

SEQ ID NO: 15427 - protein, 11 aa, Artificial Sequence
  Nucleoprotein TPR (1356-1366)
KLLSEKEVHTK

SEQ ID NO: 15428 - protein, 10 aa, Artificial Sequence
  DNA replication ATP-dependent helicase/nuclease DNA2 (580-589)
KLMENTFVSK

SEQ ID NO: 15429 - protein, 10 aa, Artificial Sequence
  Integrin alpha-9 (198-207)
KLNDEVIMNR

SEQ ID NO: 15430 - protein, 9 aa, Artificial Sequence
  Eukaryotic translation initiation factor 3 subunit C-like protein (333-341)
KLNEILQAR

SEQ ID NO: 15431 - protein, 11 aa, Artificial Sequence
  Eukaryotic translation initiation factor 3 subunit C-like protein (333-343)
KLNEILQARGK

SEQ ID NO: 15432 - protein, 9 aa, Artificial Sequence
  PHD finger protein 14 (693-701)
KLNIPAILR

SEQ ID NO: 15433 - protein, 9 aa, Artificial Sequence
  EH domain-containing protein 4 (478-486)
KLPNSVLGK

SEQ ID NO: 15434 - protein, 10 aa, Artificial Sequence
  Sarcospan (62-71)
KLPSSEPLSR

SEQ ID NO: 15435 - protein, 9 aa, Artificial Sequence
  40S ribosomal protein S18 (106-114)
KLREDLERL

SEQ ID NO: 15436 - protein, 11 aa, Artificial Sequence
  Catenin delta-1 (688-698)
KLRETQGIEKL

SEQ ID NO: 15437 - protein, 11 aa, Artificial Sequence
  Ankycorbin (218-228)
KLSENAGIQSL

SEQ ID NO: 15438 - protein, 9 aa, Artificial Sequence
  Serine/threonine-protein kinase N1 (262-270)
KLTESNQKL

SEQ ID NO: 15439 - protein, 9 aa, Artificial Sequence
  Melanoma-associated antigen D1 (477-485)
KLVKYLMLK

SEQ ID NO: 15440 - protein, 9 aa, Artificial Sequence
  Cytochrome c oxidase subunit 5B, mitochondrial (121-129)
KLVPQQLAH

SEQ ID NO: 15441 - protein, 10 aa, Artificial Sequence
  E3 ubiquitin-protein ligase TTC3 (1097-1106)
KLWDMNPKQK

SEQ ID NO: 15442 - protein, 10 aa, Artificial Sequence
  Fatty acid desaturase 2 (413-422)
KLWLDAYLHK

SEQ ID NO: 15443 - protein, 9 aa, Artificial Sequence
  Serine/threonine-protein kinase ATR (289-297)
KLYEEPLSK

SEQ ID NO: 15444 - protein, 9 aa, Artificial Sequence
  Retinoblastoma-like protein 2 (304-312)
KLYEKKLLK

SEQ ID NO: 15445 - protein, 10 aa, Artificial Sequence
  Lamina-associated polypeptide 2, isoforms beta/gamma (140-149)
KLYEKKLLKL

SEQ ID NO: 15446 - protein, 9 aa, Artificial Sequence
  Dedicator of cytokinesis protein 7 (424-432)
KLYPDSRVR

SEQ ID NO: 15447 - protein, 9 aa, Artificial Sequence
  Protein diaphanous homolog 3 (930-938)
KLYQSIIGY

SEQ ID NO: 15448 - protein, 10 aa, Artificial Sequence
  Nuclear pore complex protein Nup98-Nup96 (1480-1489)
KLYSDSIREK

SEQ ID NO: 15449 - protein, 9 aa, Artificial Sequence
  NADH dehydrogenase (ubiquinone) iron-sulfur protein 7, mitochondrial (74-82)
KMAPALRKV

SEQ ID NO: 15450 - protein, 9 aa, Artificial Sequence
  TRPM8 channel-associated factor 1 (447-455)
KMFSHQVQK

SEQ ID NO: 15451 - protein, 12 aa, Artificial Sequence
  Heat shock cognate 71 kDa protein (82-93)
KMKEIAEAYLGK

SEQ ID NO: 15452 - protein, 10 aa, Artificial Sequence
  Neuroblast differentiation-associated protein AHNAK (380-389)
KMPKMKMPTF

SEQ ID NO: 15453 - protein, 9 aa, Artificial Sequence
  DNA replication licensing factor MCM7 (236-244)
KMQEHSDQV

SEQ ID NO: 15454 - protein, 9 aa, Artificial Sequence
  Intraflagellar transport protein 74 homolog (462-470)
KMTEEQHSL

SEQ ID NO: 15455 - protein, 9 aa, Artificial Sequence
  Nuclear receptor corepressor 1 (1336-1344)
KPYDGITTI

SEQ ID NO: 15456 - protein, 10 aa, Artificial Sequence
  Hippocampus abundant transcript-like protein 1 (216-225)
KQADPFASLK

SEQ ID NO: 15457 - protein, 9 aa, Artificial Sequence
  T-complex protein 1 subunit zeta (39-47)
KQDEPIDLF

SEQ ID NO: 15458 - protein, 9 aa, Artificial Sequence
  Catenin alpha-1 (865-873)
KQDETQTKI

SEQ ID NO: 15459 - protein, 9 aa, Artificial Sequence
  Cytoplasmic dynein 1 heavy chain 1 (1181-1189)
KQFEKQVEL

SEQ ID NO: 15460 - protein, 9 aa, Artificial Sequence
  Probable E3 ubiquitin-protein ligase makorin-2 (226-234)
KQFENPIIK

SEQ ID NO: 15461 - protein, 9 aa, Artificial Sequence
  Bromodomain adjacent to zinc finger domain protein 2A (588-596)
KQFPEVIKY

SEQ ID NO: 15462 - protein, 9 aa, Artificial Sequence
  60S ribosomal protein L22-like 1 (69-77)
KQFSKRYLK

SEQ ID NO: 15463 - protein, 9 aa, Artificial Sequence
  Interleukin enhancer-binding factor 3 (519-527)
KQQGPILTK

SEQ ID NO: 15464 - protein, 9 aa, Artificial Sequence
  Actin-related protein 8 (80-88)
KQQGQPLYK

SEQ ID NO: 15465 - protein, 9 aa, Artificial Sequence
  SAM and SH3 domain-containing protein 1 (898-906)
KRFSEPQKL

SEQ ID NO: 15466 - protein, 9 aa, Artificial Sequence
  AP-3 complex subunit mu-2 (240-248)
KRWESERIL

SEQ ID NO: 15467 - protein, 9 aa, Artificial Sequence
  AP-3 complex subunit mu-1 (186-194)
KRWESERVL

SEQ ID NO: 15468 - protein, 9 aa, Artificial Sequence
  Rabankyrin-5 (851-859)
KSAEAILKR

SEQ ID NO: 15469 - protein, 9 aa, Artificial Sequence
  Neuron-specific calcium-binding protein hippocalcin (174-182)
KSDPSIVRL

SEQ ID NO: 15470 - protein, 10 aa, Artificial Sequence
  Pre-mRNA-processing factor 40 homolog B (165-174)
KSDTGKPYYY

SEQ ID NO: 15471 - protein, 10 aa, Artificial Sequence
  Supervillin (396-405)
KSFDEQNVPK

SEQ ID NO: 15472 - protein, 11 aa, Artificial Sequence
  Tumor protein D54 (26-36)
KSFEDRVGTIK

SEQ ID NO: 15473 - protein, 9 aa, Artificial Sequence
  Mitogen-activated protein kinase kinase kinase kinase 4 (1062-1070)
KSFGELVHK

SEQ ID NO: 15474 - protein, 11 aa, Artificial Sequence
  Myristoylated alanine-rich C-kinase substrate (162-172)
KSFKLSGFSFK

SEQ ID NO: 15475 - protein, 9 aa, Artificial Sequence
  Kinetochore protein Spc25 (11-19)
KSINEFWNK

SEQ ID NO: 15476 - protein, 9 aa, Artificial Sequence
  MICOS complex subunit MIC60 (102-110)
KSIQSGPLK

SEQ ID NO: 15477 - protein, 9 aa, Artificial Sequence
  DNA-dependent protein kinase catalytic subunit (2416-2424)
KSKDFVQVM

SEQ ID NO: 15478 - protein, 9 aa, Artificial Sequence
  Choline-phosphate cytidylyltransferase A (259-267)
KSKEFVQKV

SEQ ID NO: 15479 - protein, 9 aa, Artificial Sequence
  Phosphatidylinositol 4,5-bisphosphate 3-kinase catalytic subunit delta isoform (860-868)
KSKNPGEAL

SEQ ID NO: 15480 - protein, 10 aa, Artificial Sequence
  Arf-GAP with Rho-GAP domain, ANK repeat and PH domain-containing protein 3 (219-228)
KSLDQPFLSK

SEQ ID NO: 15481 - protein, 10 aa, Artificial Sequence
  Golgi-specific brefeldin A-resistance guanine nucleotide exchange factor 1 (944-953)
KSLEETIIQK

SEQ ID NO: 15482 - protein, 11 aa, Artificial Sequence
  Charged multivesicular body protein 2a (94-104)
KSNNSMAQAMK

SEQ ID NO: 15483 - protein, 9 aa, Artificial Sequence
  B9 domain-containing protein 1 (56-64)
KSQDVRQAL

SEQ ID NO: 15484 - protein, 12 aa, Artificial Sequence
  5-aminolevulinate synthase, nonspecific, mitochondrial (174-185)
KTDGGDPSGLLK

SEQ ID NO: 15485 - protein, 9 aa, Artificial Sequence
  BRCA1-associated protein (26-34)
KTDGKIVQY

SEQ ID NO: 15486 - protein, 9 aa, Artificial Sequence
  Zinc finger homeobox protein 3 (90-98)
KTDKHVQKY

SEQ ID NO: 15487 - protein, 10 aa, Artificial Sequence
  Ubiquitin carboxyl-terminal hydrolase 7 (381-390)
KTDPKDPANY

SEQ ID NO: 15488 - protein, 9 aa, Artificial Sequence
  Origin recognition complex subunit 3 (194-202)
KTDPKMLSK

SEQ ID NO: 15489 - protein, 9 aa, Artificial Sequence
  U2 small nuclear ribonucleoprotein B'' (85-93)
KTDSDIISK

SEQ ID NO: 15490 - protein, 10 aa, Artificial Sequence
  Membrane metallo-endopeptidase-like 1 (728-737)
KTDVHSPLKY

SEQ ID NO: 15491 - protein, 9 aa, Artificial Sequence
  Phosphatidylinositol 4,5-bisphosphate 3-kinase catalytic subunit alpha isoform (1030-1038)
KTEQEALEY

SEQ ID NO: 15492 - protein, 9 aa, Artificial Sequence
  Vesicle-associated membrane protein-associated protein B/C (147-155)
KTETPIVSK

SEQ ID NO: 15493 - protein, 11 aa, Artificial Sequence
  Leukotriene A-4 hydrolase (355-365)
KTFGETHPFTK

SEQ ID NO: 15494 - protein, 10 aa, Artificial Sequence
  Zinc finger CCCH domain-containing protein 11A (404-413)
KTFSEVLAEK

SEQ ID NO: 15495 - protein, 11 aa, Artificial Sequence
  60S ribosomal protein L39-like (5-15)
KTFTIKRFLAK

SEQ ID NO: 15496 - protein, 9 aa, Artificial Sequence
  Microtubule-actin cross-linking factor 1, isoforms 1/2/3/5 (99-107)
KTFTKWVNK

SEQ ID NO: 15497 - protein, 10 aa, Artificial Sequence
  Transcription initiation factor TFIID subunit 7 (78-87)
KTIDKKTFYK

SEQ ID NO: 15498 - protein, 11 aa, Artificial Sequence
  Transforming growth factor beta-1 (34-44)
KTIDMELVKRK

SEQ ID NO: 15499 - protein, 9 aa, Artificial Sequence
  Max-like protein X (125-133)
KTIDYIQFL

SEQ ID NO: 15500 - protein, 11 aa, Artificial Sequence
  Max-like protein X (125-135)
KTIDYIQFLHK

SEQ ID NO: 15501 - protein, 13 aa, Artificial Sequence
  tRNA pseudouridine synthase A, mitochondrial (110-122)
KTIEDDLVSALVR

SEQ ID NO: 15502 - protein, 9 aa, Artificial Sequence
  Polymerase delta-interacting protein 3 (147-155)
KTIQVPQQK

SEQ ID NO: 15503 - protein, 11 aa, Artificial Sequence
  Cyclin-dependent kinase 11A (11-21)
KTLDEILQEKK

SEQ ID NO: 15504 - protein, 11 aa, Artificial Sequence
  Exportin-2 (17-27)
KTLDPDPAIRR

SEQ ID NO: 15505 - protein, 12 aa, Artificial Sequence
  Coatomer subunit gamma-1 (795-806)
KTLEEAVGNIVK

SEQ ID NO: 15506 - protein, 9 aa, Artificial Sequence
  Protein prune homolog 2 (118-126)
KTLESAVVK

SEQ ID NO: 15507 - protein, 11 aa, Artificial Sequence
  Chromatin assembly factor 1 subunit B (467-477)
KTLQPSSQNTK

SEQ ID NO: 15508 - protein, 11 aa, Artificial Sequence
  RE1-silencing transcription factor (417-427)
KTMDVSKVKLK

SEQ ID NO: 15509 - protein, 11 aa, Artificial Sequence
  Arfaptin-2 (216-226)
KTMEDTLMTVK

SEQ ID NO: 15510 - protein, 9 aa, Artificial Sequence
  Asparagine synthetase domain-containing protein 1 (361-369)
KTMPTTFNR

SEQ ID NO: 15511 - protein, 9 aa, Artificial Sequence
  Uncharacterized protein C15orf41 (95-103)
KTPDFILQV

SEQ ID NO: 15512 - protein, 9 aa, Artificial Sequence
  Neuroblast differentiation-associated protein AHNAK (489-497)
KTPEMIIQK

SEQ ID NO: 15513 - protein, 10 aa, Artificial Sequence
  LIM and SH3 domain protein 1 (112-121)
KTQDQISNIK

SEQ ID NO: 15514 - protein, 9 aa, Artificial Sequence
  mRNA-capping enzyme (403-411)
KTQEPFSVR

SEQ ID NO: 15515 - protein, 11 aa, Artificial Sequence
  mRNA-capping enzyme (403-413)
KTQEPFSVRNK

SEQ ID NO: 15516 - protein, 9 aa, Artificial Sequence
  Actin-related protein 10 (403-411)
KTQPPLMKR

SEQ ID NO: 15517 - protein, 11 aa, Artificial Sequence
  Src substrate cortactin (299-309)
KTVPVEAVTSK

SEQ ID NO: 15518 - protein, 12 aa, Artificial Sequence
  X-ray repair cross-complementing protein 5 (274-285)
KTWTVVDAKTLK

SEQ ID NO: 15519 - protein, 10 aa, Artificial Sequence
  NADH dehydrogenase (ubiquinone) 1 subunit C2 (106-115)
KTYGEIFEKF

SEQ ID NO: 15520 - protein, 11 aa, Artificial Sequence
  Zinc finger protein SNAI2 (135-145)
KTYSTFSGLAK

SEQ ID NO: 15521 - protein, 10 aa, Artificial Sequence
  ETS translocation variant 1 (301-310)
KVAGERYVYK

SEQ ID NO: 15522 - protein, 9 aa, Artificial Sequence
  5'-AMP-activated protein kinase catalytic subunit alpha-2 (41-49)
KVAVKILNR

SEQ ID NO: 15523 - protein, 9 aa, Artificial Sequence
  Heat shock cognate 71 kDa protein (601-609)
KVCNPIITK

SEQ ID NO: 15524 - protein, 8 aa, Artificial Sequence
  Proteasome activator complex subunit 3 (6-13)
KVDQEVKL

SEQ ID NO: 15525 - protein, 9 aa, Artificial Sequence
  Proteasome activator complex subunit 3 (6-14)
KVDQEVKLK

SEQ ID NO: 15526 - protein, 10 aa, Artificial Sequence
  Kinesin-like protein KIFC3 (522-531)
KVFEFGHTNR

SEQ ID NO: 15527 - protein, 11 aa, Artificial Sequence
  Nucleolin (370-380)
KVFGNEIKLEK

SEQ ID NO: 15528 - protein, 12 aa, Artificial Sequence
  CUGBP Elav-like family member 2 (453-464)
KVFIDKQTNLSK

SEQ ID NO: 15529 - protein, 9 aa, Artificial Sequence
  Cathepsin L1 (104-112)
KVFQEPLFY

SEQ ID NO: 15530 - protein, 9 aa, Artificial Sequence
  Aspartyl/asparaginyl beta-hydroxylase (462-470)
KVHYGFILK

SEQ ID NO: 15531 - protein, 13 aa, Artificial Sequence
  Homeodomain-interacting protein kinase 2 (343-355)
KVIDFGSASHVSK

SEQ ID NO: 15532 - protein, 11 aa, Artificial Sequence
  Leucine-rich repeat-containing protein 61 (158-168)
KVIDGERVIGR

SEQ ID NO: 15533 - protein, 9 aa, Artificial Sequence
  Prefoldin subunit 1 (19-27)
KVIDTQQKV

SEQ ID NO: 15534 - protein, 9 aa, Artificial Sequence
  UPF0428 protein CXorf56 (42-50)
KVIEKQLER

SEQ ID NO: 15535 - protein, 11 aa, Artificial Sequence
  Liprin-alpha-1 (251-261)
KVIELQEIISK

SEQ ID NO: 15536 - protein, 11 aa, Artificial Sequence
  Signal-induced proliferation-associated 1-like protein 2 (559-569)
KVINAENAAHK

SEQ ID NO: 15537 - protein, 9 aa, Artificial Sequence
  60S acidic ribosomal protein P2 (41-49)
KVISELNGK

SEQ ID NO: 15538 - protein, 11 aa, Artificial Sequence
  Protein PRRC2C (1140-1150)
KVISKDLVIER

SEQ ID NO: 15539 - protein, 11 aa, Artificial Sequence
  Zinc finger protein 721 (156-166)
KVITSSSSFAK

SEQ ID NO: 15540 - protein, 12 aa, Artificial Sequence
  Probable U3 small nucleolar RNA-associated protein 11 (109-120)
KVKGVTNQTGLK

SEQ ID NO: 15541 - protein, 11 aa, Artificial Sequence
  Neuroblast differentiation-associated protein AHNAK (487-497)
KVKTPEMIIQK

SEQ ID NO: 15542 - protein, 10 aa, Artificial Sequence
  Gamma-interferon-inducible protein 16 (243-252)
KVLNTSLKEK

SEQ ID NO: 15543 - protein, 10 aa, Artificial Sequence
  E3 ubiquitin-protein ligase RNF216 (197-206)
KVLPQTILYK

SEQ ID NO: 15544 - protein, 10 aa, Artificial Sequence
  Serine/threonine-protein kinase Sgk1 (222-231)
KVLQKKAILK

SEQ ID NO: 15545 - protein, 11 aa, Artificial Sequence
  Flavin reductaseADPH) (137-147)
KVLRESGLKYV

SEQ ID NO: 15546 - protein, 10 aa, Artificial Sequence
  Polymerase I and transcript release factor (227-236)
KVPPFTFHVK

SEQ ID NO: 15547 - protein, 11 aa, Artificial Sequence
  Leucine-tRNA ligase, cytoplasmic (486-496)
KVQDVKKTIQK

SEQ ID NO: 15548 - protein, 10 aa, Artificial Sequence
  28S ribosomal protein S29, mitochondrial (203-212)
KVQEKYVWNK

SEQ ID NO: 15549 - protein, 9 aa, Artificial Sequence
  Prelamin-A/C (108-116)
KVREEFKEL

SEQ ID NO: 15550 - protein, 10 aa, Artificial Sequence
  ATP-dependent RNA helicase DHX8 (1091-1100)
KVSDPTKLSK

SEQ ID NO: 15551 - protein, 9 aa, Artificial Sequence
  Protein O-GlcNAcase (850-858)
KVTDPSVAK

SEQ ID NO: 15552 - protein, 9 aa, Artificial Sequence
  Voltage-dependent anion-selective channel protein 1 (53-61)
KVTGSLETK

SEQ ID NO: 15553 - protein, 11 aa, Artificial Sequence
  Septin-9 (202-212)
KVVNIVPVIAK

SEQ ID NO: 15554 - protein, 9 aa, Artificial Sequence
  Arf-GAP with Rho-GAP domain, ANK repeat and PH domain-containing protein 3 (53-61)
KVYLGIRKK

SEQ ID NO: 15555 - protein, 9 aa, Artificial Sequence
  Ubiquitin carboxyl-terminal hydrolase 32 (278-286)
KYAPRFNGF

SEQ ID NO: 15556 - protein, 9 aa, Artificial Sequence
  Methionine synthase (216-224)
KYAPRPIFI

SEQ ID NO: 15557 - protein, 9 aa, Artificial Sequence
  Metastasis-associated protein MTA2 (282-290)
KYGKDFNDI

SEQ ID NO: 15558 - protein, 9 aa, Artificial Sequence
  Glycerol-3-phosphate acyltransferase 4 (365-373)
KYGMVTYLL

SEQ ID NO: 15559 - protein, 8 aa, Artificial Sequence
  Splicing factor 3B subunit 6 (41-48)
KYGPIRQI

SEQ ID NO: 15560 - protein, 9 aa, Artificial Sequence
  Inositol 1,4,5-trisphosphate receptor type 3 (117-125)
KYGSVIQLL

SEQ ID NO: 15561 - protein, 9 aa, Artificial Sequence
  KH domain-containing, RNA-binding, signal transduction-associated protein 3 (44-52)
KYIDVVINK

SEQ ID NO: 15562 - protein, 9 aa, Artificial Sequence
  Probable E3 ubiquitin-protein ligase HERC6 (822-830)
KYIDYIFNV

SEQ ID NO: 15563 - protein, 11 aa, Artificial Sequence
  Zinc finger FYVE domain-containing protein 16 (1129-1139)
KYIENLDNITF

SEQ ID NO: 15564 - protein, 9 aa, Artificial Sequence
  Serine/threonine-protein kinase RIO3 (304-312)
KYIKDDFRF

SEQ ID NO: 15565 - protein, 9 aa, Artificial Sequence
  FERM domain-containing protein 6 (210-218)
KYIKEAVRL

SEQ ID NO: 15566 - protein, 9 aa, Artificial Sequence
  ER membrane protein complex subunit 3 (66-74)
KYIPKQSFL

SEQ ID NO: 15567 - protein, 9 aa, Artificial Sequence
  Cleavage stimulation factor subunit 1 (212-220)
KYIQEAEML

SEQ ID NO: 15568 - protein, 9 aa, Artificial Sequence
  Poly(A)-specific ribonuclease PARN (21-29)
KYITKSFNF

SEQ ID NO: 15569 - protein, 9 aa, Artificial Sequence
  Tetratricopeptide repeat protein 14 (427-435)
KYMQKSLEL

SEQ ID NO: 15570 - protein, 9 aa, Artificial Sequence
  Heparan sulfate 2-sulfotransferase (241-249)
KYNLINEYF

SEQ ID NO: 15571 - protein, 9 aa, Artificial Sequence
  Homeobox protein Hox-B7 (13-21)
KYPASSSVF

SEQ ID NO: 15572 - protein, 9 aa, Artificial Sequence
  Adenosylhomocysteinase 2 (210-218)
KYPNVFKKI

SEQ ID NO: 15573 - protein, 9 aa, Artificial Sequence
  Zinc finger C2HC domain-containing protein 1A (306-314)
KYPVEWAKF

SEQ ID NO: 15574 - protein, 9 aa, Artificial Sequence
  T-box transcription factor TBX15 (239-247)
KYQPRVHVI

SEQ ID NO: 15575 - protein, 10 aa, Artificial Sequence
  Intron-binding protein aquarius (90-99)
KYSNMEQSLF

SEQ ID NO: 15576 - protein, 9 aa, Artificial Sequence
  Putative zinc finger protein 724 (149-157)
KYVKDFHKF

SEQ ID NO: 15577 - protein, 9 aa, Artificial Sequence
  Zinc finger protein 107 (80-88)
KYVKVFDKF

SEQ ID NO: 15578 - protein, 9 aa, Artificial Sequence
  Zinc finger protein 486 (191-199)
KYVKVFHQF

SEQ ID NO: 15579 - protein, 9 aa, Artificial Sequence
  Zinc finger protein 675 (148-156)
KYVKVFNKF

SEQ ID NO: 15580 - protein, 9 aa, Artificial Sequence
  Nuclear pore membraneoprotein 210 (17-25)
LAAGPSAAA

SEQ ID NO: 15581 - protein, 9 aa, Artificial Sequence
  Lck-interacting transmembrane adapter 1 (150-158)
LAALPGVSL

SEQ ID NO: 15582 - protein, 9 aa, Artificial Sequence
  Prolyl endopeptidase-like (376-384)
LADDSVRSL

SEQ ID NO: 15583 - protein, 9 aa, Artificial Sequence
  Helicase ARIP4 (250-258)
LAIVPVNTL

SEQ ID NO: 15584 - protein, 9 aa, Artificial Sequence
  Receptor-interacting serine/threonine-protein kinase 4 (637-645)
LAKQPGVSV

SEQ ID NO: 15585 - protein, 9 aa, Artificial Sequence
  Importin-9 (625-633)
LAQDIFKEL

SEQ ID NO: 15586 - protein, 9 aa, Artificial Sequence
  Exosome complex exonuclease RRP44 (767-775)
LASPIYTHF

SEQ ID NO: 15587 - protein, 9 aa, Artificial Sequence
  Serine/threonine-protein kinase 17B (265-273)
LATDFIQSL

SEQ ID NO: 15588 - protein, 9 aa, Artificial Sequence
  Junction plakoglobin (139-147)
LATRALPEL

SEQ ID NO: 15589 - protein, 9 aa, Artificial Sequence
  UBX domain-containing protein 8 (242-250)
LAVEGGQSL

SEQ ID NO: 15590 - protein, 9 aa, Artificial Sequence
  F-box only protein 32 (100-108)
LEDQQNIRL

SEQ ID NO: 15591 - protein, 9 aa, Artificial Sequence
  Ubiquitin carboxyl-terminal hydrolase 22 (475-483)
LESGHYTSF

SEQ ID NO: 15592 - protein, 9 aa, Artificial Sequence
  Gamma-aminobutyric acid receptor subunit pi (247-255)
LETYVPSTF

SEQ ID NO: 15593 - protein, 9 aa, Artificial Sequence
  Condensin-2 complex subunit H2 (434-442)
LFIATSQKF

SEQ ID NO: 15594 - protein, 9 aa, Artificial Sequence
  ATP-dependent RNA helicase DDX54 (153-161)
LILSPTREL

SEQ ID NO: 15595 - protein, 9 aa, Artificial Sequence
  Lysine-specific demethylase 4B (245-253)
LISPIILKK

SEQ ID NO: 15596 - protein, 9 aa, Artificial Sequence
  Protocadherin-1 (27-35)
LLAPSPGHA

SEQ ID NO: 15597 - protein, 11 aa, Artificial Sequence
  ETS translocation variant 5 (377-387)
LLDDPANAHFI

SEQ ID NO: 15598 - protein, 9 aa, Artificial Sequence
  ATP-binding cassette sub-family F member 3 (350-358)
LLDEPTNML

SEQ ID NO: 15599 - protein, 10 aa, Artificial Sequence
  Zinc finger protein 490 (73-82)
LLDPGQRNIY

SEQ ID NO: 15600 - protein, 9 aa, Artificial Sequence
  Probable global transcription activator SNF2L1 (721-729)
LLEKEILYY

SEQ ID NO: 15601 - protein, 13 aa, Artificial Sequence
  NKG2D ligand 3 (11-23)
LLFDWSGTGRADA

SEQ ID NO: 15602 - protein, 9 aa, Artificial Sequence
  Sterol regulatory element-binding protein 2 (843-851)
LLHSFVDSV

SEQ ID NO: 15603 - protein, 9 aa, Artificial Sequence
  Uncharacterized protein C18orf63 (124-132)
LLIQGRDFL

SEQ ID NO: 15604 - protein, 9 aa, Artificial Sequence
  Transmembrane emp24 domain-containing protein 3 (78-86)
LLKSFFTEK

SEQ ID NO: 15605 - protein, 11 aa, Artificial Sequence
  Protein disulfide-isomerase A3 (14-24)
LLLAAARLAAA

SEQ ID NO: 15606 - protein, 9 aa, Artificial Sequence
  Peptidyl-prolyl cis-trans isomerase B (16-24)
LLLPGPSAA

SEQ ID NO: 15607 - protein, 10 aa, Artificial Sequence
  Plasma alpha-L-fucosidase (19-28)
LLLPPPPCPA

SEQ ID NO: 15608 - protein, 9 aa, Artificial Sequence
  PRKC apoptosis WT1 regulator protein (216-224)
LLQEPPRTV

SEQ ID NO: 15609 - protein, 10 aa, Artificial Sequence
  Chromodomain-helicase-DNA-binding protein 7 (695-704)
LLVNSLFAGM

SEQ ID NO: 15610 - protein, 11 aa, Artificial Sequence
  Notchless protein homolog 1 (181-191)
LLWDPSTGKQV

SEQ ID NO: 15611 - protein, 9 aa, Artificial Sequence
  Adenosine 3'-phospho 5'-phosphosulfate transporter 1 (251-259)
LLYGHTVTV

SEQ ID NO: 15612 - protein, 9 aa, Artificial Sequence
  Activating signal cointegrator 1 complex subunit 1 (68-76)
LLYKHIVGK

SEQ ID NO: 15613 - protein, 9 aa, Artificial Sequence
  DNA-dependent protein kinase catalytic subunit (3482-3490)
LMTKEISSV

SEQ ID NO: 15614 - protein, 9 aa, Artificial Sequence
  Nucleus accumbens-associated protein 1 (343-351)
LPAELINQI

SEQ ID NO: 15615 - protein, 8 aa, Artificial Sequence
  Mothers against decapentaplegic homolog 2 (5-12)
LPFTPPVV

SEQ ID NO: 15616 - protein, 9 aa, Artificial Sequence
  Biorientation of chromosomes in cell division protein 1-like 1 (907-915)
LPISSATTI

SEQ ID NO: 15617 - protein, 9 aa, Artificial Sequence
  Catenin alpha-1 (553-561)
LPQEQKAKI

SEQ ID NO: 15618 - protein, 9 aa, Artificial Sequence
  E3 ubiquitin-protein ligase RNF213 (5003-5011)
LPSSVISAI

SEQ ID NO: 15619 - protein, 8 aa, Artificial Sequence
  Eukaryotic translation initiation factor 3 subunit C-like protein (816-823)
LPTVHSII

SEQ ID NO: 15620 - protein, 8 aa, Artificial Sequence
  Regulation of nuclear pre-mRNA domain-containing protein 1A (190-197)
LPVEVQEV

SEQ ID NO: 15621 - protein, 9 aa, Artificial Sequence
  CDK5 and ABL1 enzyme substrate 2 (40-48)
LPYGEGLRI

SEQ ID NO: 15622 - protein, 9 aa, Artificial Sequence
  Collagen alpha-1(XII) chain (105-113)
LPYKGGNTL

SEQ ID NO: 15623 - protein, 9 aa, Artificial Sequence
  A-kinase anchor protein 1, mitochondrial (646-654)
LPYTQSVQI

SEQ ID NO: 15624 - protein, 9 aa, Artificial Sequence
  Putative tRNA (cytidine(32)/guanosine(34)-2'-O)-methyltransferase (30-38)
LQLDKEFQL

SEQ ID NO: 15625 - protein, 9 aa, Artificial Sequence
  Double-stranded RNA-binding protein Staufen homolog 1 (119-127)
LQNEPLPER

SEQ ID NO: 15626 - protein, 10 aa, Artificial Sequence
  CD44 antigen (331-340)
LQNVDMKIGV

SEQ ID NO: 15627 - protein, 9 aa, Artificial Sequence
  Vimentin (44-52)
LRPSTSRSL

SEQ ID NO: 15628 - protein, 9 aa, Artificial Sequence
  Protein CASC5 (113-121)
LSAPIHTQM

SEQ ID NO: 15629 - protein, 10 aa, Artificial Sequence
  Fibronectin type III domain-containing protein 3B (320-329)
LSDKGRDGKY

SEQ ID NO: 15630 - protein, 9 aa, Artificial Sequence
  Cytoplasmic dynein 1 heavy chain 1 (69-77)
LSDPQVHTV

SEQ ID NO: 15631 - protein, 9 aa, Artificial Sequence
  Stress-induced-phosphoprotein 1 (194-202)
LSDPTYREL

SEQ ID NO: 15632 - protein, 9 aa, Artificial Sequence
  Cytochrome c oxidase subunit 4 isoform 1, mitochondrial (131-139)
LSDPVIHSL

SEQ ID NO: 15633 - protein, 11 aa, Artificial Sequence
  tRNA-splicing endonuclease subunit Sen54 (146-156)
LTDHTVTFLQY

SEQ ID NO: 15634 - protein, 11 aa, Artificial Sequence
  Beta-galactosidase-1-like protein 2 (348-358)
LTEAGDYTAKY

SEQ ID NO: 15635 - protein, 8 aa, Artificial Sequence
  Serine/threonine-protein kinase 24 (284-291)
LTELIDRY

SEQ ID NO: 15636 - protein, 9 aa, Artificial Sequence
  Endoplasmic reticulum-Golgi intermediate compartment protein 3 (39-47)
LTTEVHPEL

SEQ ID NO: 15637 - protein, 8 aa, Artificial Sequence
  POTE ankyrin domain family member F (708-715)
LVIDNGSG

SEQ ID NO: 15638 - protein, 12 aa, Artificial Sequence
  CD44 antigen (399-410)
LVNKESSETPDQ

SEQ ID NO: 15639 - protein, 9 aa, Artificial Sequence
  Structural maintenance of chromosomes flexible hinge domain-containing protein 1 (857-865)
LVTDIQPVL

SEQ ID NO: 15640 - protein, 9 aa, Artificial Sequence
  Cytoplasmic dynein 1 light intermediate chain 1 (179-187)
LVYKYIVQK

SEQ ID NO: 15641 - protein, 9 aa, Artificial Sequence
  Protein archease (109-117)
LYKFSADEF

SEQ ID NO: 15642 - protein, 9 aa, Artificial Sequence
  Tumor protein D54 (125-133)
LYKKTQETL

SEQ ID NO: 15643 - protein, 10 aa, Artificial Sequence
  CD109 antigen (139-148)
LYKPKQEVKF

SEQ ID NO: 15644 - protein, 9 aa, Artificial Sequence
  Ras-related GTP-binding protein C (292-300)
LYLKEVTKF

SEQ ID NO: 15645 - protein, 9 aa, Artificial Sequence
  Exportin-5 (626-634)
LYNHVKQLL

SEQ ID NO: 15646 - protein, 9 aa, Artificial Sequence
  Interferon-induced GTP-binding protein Mx2 (422-430)
LYNKIREDF

SEQ ID NO: 15647 - protein, 9 aa, Artificial Sequence
  ATPase family AAA domain-containing protein 2 (447-455)
LYPEVFEKF

SEQ ID NO: 15648 - protein, 9 aa, Artificial Sequence
  TELO2-interacting protein 2 (300-308)
LYTPEHHLI

SEQ ID NO: 15649 - protein, 9 aa, Artificial Sequence
  Formin-binding protein 1-like (181-189)
MADENKNEY

SEQ ID NO: 15650 - protein, 10 aa, Artificial Sequence
  Condensin complex subunit 1 (1002-1011)
MELLDGKQTL

SEQ ID NO: 15651 - protein, 10 aa, Artificial Sequence
  Nucleoprotein TPR (1009-1018)
MEVEKEKQEL

SEQ ID NO: 15652 - protein, 11 aa, Artificial Sequence
  Eukaryotic translation initiation factor 2 subunit 2 (6-16)
MIFDPTMSKKK

SEQ ID NO: 15653 - protein, 9 aa, Artificial Sequence
  Melanoma-associated antigen D1 (497-505)
MLRDIIREY

SEQ ID NO: 15654 - protein, 10 aa, Artificial Sequence
  Cytochrome c oxidase subunit NDUFA4 (1-10)
MLRQIIGQAK

SEQ ID NO: 15655 - protein, 9 aa, Artificial Sequence
  Tetratricopeptide repeat protein 17 (580-588)
MPDDHARKI

SEQ ID NO: 15656 - protein, 8 aa, Artificial Sequence
  Protein polybromo-1 (426-433)
MPISLQQI

SEQ ID NO: 15657 - protein, 10 aa, Artificial Sequence
  Cell division cycle protein 27 homolog (515-524)
MQAERIFSEV

SEQ ID NO: 15658 - protein, 11 aa, Artificial Sequence
  CD44 antigen (412-422)
MTADETRNLQN

SEQ ID NO: 15659 - protein, 11 aa, Artificial Sequence
  14-3-3 protein beta/alpha (1-11)
MTMDKSELVQK

SEQ ID NO: 15660 - protein, 9 aa, Artificial Sequence
  Centromere/kinetochore protein zw10 homolog (415-423)
MTSEIHNTV

SEQ ID NO: 15661 - protein, 9 aa, Artificial Sequence
  Pyridoxal kinase (93-101)
MVVDIVQEL

SEQ ID NO: 15662 - protein, 9 aa, Artificial Sequence
  Nucleoside diphosphate kinase (76-84)
MVWEGLNVV

SEQ ID NO: 15663 - protein, 9 aa, Artificial Sequence
  Tyrosine-protein phosphatase non-receptor type 14 (204-212)
MYINEVERL

SEQ ID NO: 15664 - protein, 9 aa, Artificial Sequence
  Phosphatidate cytidylyltransferase 2 (308-316)
MYPFQIHSI

SEQ ID NO: 15665 - protein, 9 aa, Artificial Sequence
  M-phase phosphoprotein 8 (351-359)
NAFLEKKTV

SEQ ID NO: 15666 - protein, 9 aa, Artificial Sequence
  E3 ubiquitin-protein ligase RNF213 (2663-2671)
NAFLSKSSV

SEQ ID NO: 15667 - protein, 9 aa, Artificial Sequence
  H/ACA ribonucleoprotein complex subunit 4 (161-169)
NAIEGGTQL

SEQ ID NO: 15668 - protein, 9 aa, Artificial Sequence
  Protein transport protein Sec31A (866-874)
NAYPNTPYI

SEQ ID NO: 15669 - protein, 9 aa, Artificial Sequence
  Ribonuclease P/MRP protein subunit POP5 (58-66)
NAYTGIVLL

SEQ ID NO: 15670 - protein, 9 aa, Artificial Sequence
  Cytoplasmic dynein 1 heavy chain 1 (1442-1450)
NEAIVKDVL

SEQ ID NO: 15671 - protein, 10 aa, Artificial Sequence
  Hsc70-interacting protein (314-323)
NEILSDPEVL

SEQ ID NO: 15672 - protein, 8 aa, Artificial Sequence
  DENN domain-containing protein 5A (694-701)
NEITGHTY

SEQ ID NO: 15673 - protein, 9 aa, Artificial Sequence
  Nucleoprotein TPR (857-865)
NEVEQRHTL

SEQ ID NO: 15674 - protein, 9 aa, Artificial Sequence
  Serine/arginine repetitive matrix protein 2 (2175-2183)
NHAQSRIAL

SEQ ID NO: 15675 - protein, 9 aa, Artificial Sequence
  EH domain-containing protein 1 (209-217)
NHEDKIRVV

SEQ ID NO: 15676 - protein, 10 aa, Artificial Sequence
  Nuclear receptor coactivator 6 (844-853)
NHFSGHGMSF

SEQ ID NO: 15677 - protein, 9 aa, Artificial Sequence
  UDP-N-acetylhexosamine pyrophosphorylase (327-335)
NIANHFFTV

SEQ ID NO: 15678 - protein, 9 aa, Artificial Sequence
  Mediator of RNA polymerase II transcription subunit 22 (67-75)
NIVRAGESL

SEQ ID NO: 15679 - protein, 9 aa, Artificial Sequence
  Peroxisomal acyl-coenzyme A oxidase 1 (642-650)
NKAEVHESY

SEQ ID NO: 15680 - protein, 10 aa, Artificial Sequence
  FERM domain-containing protein 6 (261-270)
NLDEEKQLLY

SEQ ID NO: 15681 - protein, 8 aa, Artificial Sequence
  WD repeat-containing protein 43 (333-340)
NLIKKTVL

SEQ ID NO: 15682 - protein, 9 aa, Artificial Sequence
  C-terminal-binding protein 2 (784-792)
NLNEHNHHL

SEQ ID NO: 15683 - protein, 11 aa, Artificial Sequence
  CD44 antigen (330-340)
NLQNVDMKIGV

SEQ ID NO: 15684 - protein, 10 aa, Artificial Sequence
  E3 ubiquitin-protein ligase makorin-1 (292-301)
NPSERRFGIL

SEQ ID NO: 15685 - protein, 11 aa, Artificial Sequence
  Transcription factor COE2 (207-217)
NQGYIRNTSSI

SEQ ID NO: 15686 - protein, 9 aa, Artificial Sequence
  Interferon-induced GTP-binding protein Mx2 (643-651)
NQIPFIIQY

SEQ ID NO: 15687 - protein, 9 aa, Artificial Sequence
  Transportin-1 (49-57)
NQYPDFNNY

SEQ ID NO: 15688 - protein, 9 aa, Artificial Sequence
  Dolichyl-diphosphooligosaccharide-proteinosyltransferase 48 kDa subunit (395-403)
NRLGYTHLY

SEQ ID NO: 15689 - protein, 9 aa, Artificial Sequence
  TATA-binding protein-associated factor 2N (227-235)
NSDNNTIFV

SEQ ID NO: 15690 - protein, 9 aa, Artificial Sequence
  Niban-like protein 1 (154-162)
NSDPNLHLL

SEQ ID NO: 15691 - protein, 9 aa, Artificial Sequence
  Serine/threonine-protein kinase TBK1 (330-338)
NTATIFHEL

SEQ ID NO: 15692 - protein, 10 aa, Artificial Sequence
  GREB1-like protein (1697-1706)
NTDLTQNVQY

SEQ ID NO: 15693 - protein, 10 aa, Artificial Sequence
  Eukaryotic translation initiation factor 3 subunit C-like protein (462-471)
NTDPHSQEYV

SEQ ID NO: 15694 - protein, 10 aa, Artificial Sequence
  Guanine deaminase (328-337)
NTDRPGGYSY

SEQ ID NO: 15695 - protein, 10 aa, Artificial Sequence
  26S proteasome non-ATPase regulatory subunit 13 (227-236)
NTDRQWLIDT

SEQ ID NO: 15696 - protein, 11 aa, Artificial Sequence
  Polypyrimidine tract-binding protein 1 (102-112)
NTEEAANTMVN

SEQ ID NO: 15697 - protein, 9 aa, Artificial Sequence
  MOB kinase activator 1A (60-68)
NTVDFFNQI

SEQ ID NO: 15698 - protein, 9 aa, Artificial Sequence
  Vesicular integral-membrane protein VIP36 (305-313)
NVDDPTGNF

SEQ ID NO: 15699 - protein, 11 aa, Artificial Sequence
  Dynactin subunit 6 (105-115)
NVIESKAYVGR

SEQ ID NO: 15700 - protein, 9 aa, Artificial Sequence
  Sperm-associated antigen 16 protein (89-97)
NVPDVYTQI

SEQ ID NO: 15701 - protein, 9 aa, Artificial Sequence
  Activity-dependent neuroprotector homeobox protein (450-458)
NYIMKIHNF

SEQ ID NO: 15702 - protein, 9 aa, Artificial Sequence
  Abelson tyrosine-protein kinase 2 (124-132)
NYITPVNSL

SEQ ID NO: 15703 - protein, 9 aa, Artificial Sequence
  Opioid growth factor receptor (195-203)
NYQKRFQNL

SEQ ID NO: 15704 - protein, 9 aa, Artificial Sequence
  DNA-directed RNA polymerase II subunit RPB4 (66-74)
NYTARFSRF

SEQ ID NO: 15705 - protein, 10 aa, Artificial Sequence
  BTB/POZ domain-containing adapter for CUL3-mediated RhoA degradation protein 3 (245-254)
PEARIYEETL

SEQ ID NO: 15706 - protein, 9 aa, Artificial Sequence
  Ubiquitin-like modifier-activating enzyme 7 (898-906)
PFAPAIQTF

SEQ ID NO: 15707 - protein, 9 aa, Artificial Sequence
  Short-chain dehydrogenase/reductase 3 (219-227)
PFHTSTEMF

SEQ ID NO: 15708 - protein, 10 aa, Artificial Sequence
  Nodal modulator 2 (293-302)
PFYRGERITF

SEQ ID NO: 15709 - protein, 10 aa, Artificial Sequence
  Beta-2-microglobulin (110-119)
PKIVKWDRDM

SEQ ID NO: 15710 - protein, 9 aa, Artificial Sequence
  Proteasomal ubiquitin receptor ADRM1 (86-94)
PQCPSGRVY

SEQ ID NO: 15711 - protein, 12 aa, Artificial Sequence
  NADH dehydrogenase (ubiquinone) 1 alpha subcomplex subunit 3 (73-84)
PQGPSLEWLKKL

SEQ ID NO: 15712 - protein, 9 aa, Artificial Sequence
  Signal recognition particle 9 kDa protein (2-10)
PQYQTWEEF

SEQ ID NO: 15713 - protein, 10 aa, Artificial Sequence
  Gamma-aminobutyric acid receptor-associated protein (52-61)
PSDLTVGQFY

SEQ ID NO: 15714 - protein, 11 aa, Artificial Sequence
  B-cell CLL/lymphoma 9-like protein (1331-1341)
PSEKPSSTLQY

SEQ ID NO: 15715 - protein, 9 aa, Artificial Sequence
  Retroviral-like aspartic protease 1 (314-322)
PVGGSLEDE

SEQ ID NO: 15716 - protein, 9 aa, Artificial Sequence
  Procollagen-lysine,2-oxoglutarate 5-dioxygenase 3 (459-467)
PYISQAYVI

SEQ ID NO: 15717 - protein, 9 aa, Artificial Sequence
  Telomerase protein component 1 (1087-1095)
PYVGGLEEF

SEQ ID NO: 15718 - protein, 9 aa, Artificial Sequence
  U5 small nuclear ribonucleoprotein 200 kDa helicase (643-651)
QEDVRLIGL

SEQ ID NO: 15719 - protein, 9 aa, Artificial Sequence
  Ras GTPase-activating protein-binding protein 1 (211-219)
QEEKPEPVL

SEQ ID NO: 15720 - protein, 9 aa, Artificial Sequence
  Threonylcarbamoyladenosine tRNA methylthiotransferase (57-65)
QEENKKIVL

SEQ ID NO: 15721 - protein, 10 aa, Artificial Sequence
  Eukaryotic translation initiation factor 3 subunit K (94-103)
QEERPIRQIL

SEQ ID NO: 15722 - protein, 12 aa, Artificial Sequence
  RNA polymerase II subunit A C-terminal domain phosphatase SSU72 (177-188)
QEFEEKSGRTFL

SEQ ID NO: 15723 - protein, 9 aa, Artificial Sequence
  Clathrin heavy chain 1 (10-18)
QEHLQLQNL

SEQ ID NO: 15724 - protein, 9 aa, Artificial Sequence
  Bifunctional arginine demethylase and lysyl-hydroxylase JMJD6 (356-364)
QEHPELAVL

SEQ ID NO: 15725 - protein, 10 aa, Artificial Sequence
  F-box only protein 11 (141-150)
QEKLPDEVVL

SEQ ID NO: 15726 - protein, 10 aa, Artificial Sequence
  protein PET100 homolog, mitochondrial (48-57)
QELEEFKERL

SEQ ID NO: 15727 - protein, 10 aa, Artificial Sequence
  Protein SHQ1 homolog (236-245)
QENHATLVSF

SEQ ID NO: 15728 - protein, 10 aa, Artificial Sequence
  Histone-lysine N-methyltransferase SETD7 (253-262)
QEVDSRDWAL

SEQ ID NO: 15729 - protein, 9 aa, Artificial Sequence
  Neutral amino acid transporter B(0) (224-232)
QEVEGMNIL

SEQ ID NO: 15730 - protein, 9 aa, Artificial Sequence
  Uridine-cytidine kinase 2 (143-151)
QEVRDLFQM

SEQ ID NO: 15731 - protein, 9 aa, Artificial Sequence
  WD repeat-containing protein 3 (640-648)
QFVPKSHLF

SEQ ID NO: 15732 - protein, 9 aa, Artificial Sequence
  Niban-like protein 1 (79-87)
QISIPFLLK

SEQ ID NO: 15733 - protein, 9 aa, Artificial Sequence
  Rho-associated protein kinase 2 (563-571)
QLDETNALL

SEQ ID NO: 15734 - protein, 9 aa, Artificial Sequence
  Ras-associated and pleckstrin homology domains-containing protein 1 (496-504)
QLDHVNVYY

SEQ ID NO: 15735 - protein, 9 aa, Artificial Sequence
  Disco-interacting protein 2 homolog A (1561-1569)
QLDPIYVAY

SEQ ID NO: 15736 - protein, 9 aa, Artificial Sequence
  Transcription elongation factor SPT5 (537-545)
QLDPQTVGV

SEQ ID NO: 15737 - protein, 9 aa, Artificial Sequence
  Transcriptional repressor CTCF (65-73)
QLDPTLLQM

SEQ ID NO: 15738 - protein, 9 aa, Artificial Sequence
  Ubiquitin-40S ribosomal protein S27a (69-77)
QLEDGRTLS

SEQ ID NO: 15739 - protein, 9 aa, Artificial Sequence
  Mortality factor 4-like protein 2 (145-153)
QLFQLPAKK

SEQ ID NO: 15740 - protein, 10 aa, Artificial Sequence
  Transitional endoplasmic reticulum ATPase (50-59)
QLFRGDTVLL

SEQ ID NO: 15741 - protein, 11 aa, Artificial Sequence
  Transitional endoplasmic reticulum ATPase (50-60)
QLFRGDTVLLK

SEQ ID NO: 15742 - protein, 10 aa, Artificial Sequence
  Mitofusin-2 (172-181)
QLHAGSLVSV

SEQ ID NO: 15743 - protein, 9 aa, Artificial Sequence
  Kinesin-like protein KIF15 (1210-1218)
QLIEKNWLL

SEQ ID NO: 15744 - protein, 9 aa, Artificial Sequence
  Cleavage and polyadenylation specificity factor subunit 2 (95-103)
QLLDQIWRT

SEQ ID NO: 15745 - protein, 9 aa, Artificial Sequence
  Eukaryotic translation initiation factor 4 gamma 1 (739-747)
QLMKQVTQL

SEQ ID NO: 15746 - protein, 9 aa, Artificial Sequence
  Lanosterol 14-alpha demethylase (218-226)
QLNEKVAQL

SEQ ID NO: 15747 - protein, 9 aa, Artificial Sequence
  Pleckstrin homology-like domain family B member 1 (775-783)
QLQEKLVAL

SEQ ID NO: 15748 - protein, 9 aa, Artificial Sequence
  WD and tetratricopeptide repeats protein 1 (274-282)
QLYSKAVQR

SEQ ID NO: 15749 - protein, 9 aa, Artificial Sequence
  Zinc finger protein ubi-d4 (70-78)
QLYSYPARR

SEQ ID NO: 15750 - protein, 9 aa, Artificial Sequence
  KxDL motif-containing protein 1 (65-73)
QMSERFLHH

SEQ ID NO: 15751 - protein, 9 aa, Artificial Sequence
  Helicase with zinc finger domain 2 (1555-1563)
QPAPRSQQL

SEQ ID NO: 15752 - protein, 9 aa, Artificial Sequence
  V-type proton ATPase subunit B, brain isoform (42-50)
QPRLTYKTV

SEQ ID NO: 15753 - protein, 10 aa, Artificial Sequence
  Transmembrane protein 160 (91-100)
QSDMGREAAY

SEQ ID NO: 15754 - protein, 9 aa, Artificial Sequence
  Synaptotagmin-like protein 2 (379-387)
QSDPKPSQY

SEQ ID NO: 15755 - protein, 10 aa, Artificial Sequence
  Very long-chain specific acyl-CoA dehydrogenase, mitochondrial (600-609)
QSDPWQQELY

SEQ ID NO: 15756 - protein, 9 aa, Artificial Sequence
  E3 ubiquitin-protein ligase TRAF7 (293-301)
QTDDRFHEM

SEQ ID NO: 15757 - protein, 9 aa, Artificial Sequence
  WD repeat and FYVE domain-containing protein 3 (796-804)
QTDERLAQY

SEQ ID NO: 15758 - protein, 10 aa, Artificial Sequence
  Tetratricopeptide repeat protein 19, mitochondrial (128-137)
QTDNKKAITY

SEQ ID NO: 15759 - protein, 11 aa, Artificial Sequence
  Nuclear pore complex protein Nup133 (878-888)
QTDNQSRLQRY

SEQ ID NO: 15760 - protein, 9 aa, Artificial Sequence
  Signal recognition particle receptor subunit beta (32-40)
QTDPTLLSV

SEQ ID NO: 15761 - protein, 9 aa, Artificial Sequence
  Helicase with zinc finger domain 2 (612-620)
QTDPVTLQY

SEQ ID NO: 15762 - protein, 9 aa, Artificial Sequence
  Small G protein signaling modulator 3 (245-253)
QTDQRVLRH

SEQ ID NO: 15763 - protein, 10 aa, Artificial Sequence
  SWI/SNF-related matrix-associated actin-dependent regulator of chromatin subfamily A member 5 (85-94)
QTDRANRFEY

SEQ ID NO: 15764 - protein, 10 aa, Artificial Sequence
  Sodium-dependent lysophosphatidylcholine symporter 1 (104-113)
QTERDSATAY

SEQ ID NO: 15765 - protein, 9 aa, Artificial Sequence
  Ras GTPase-activating-like protein IQGAP1 (980-988)
QTNPTYLAK

SEQ ID NO: 15766 - protein, 9 aa, Artificial Sequence
  Mitochondrial-processing peptidase subunit alpha (144-152)
QTSRDTTMY

SEQ ID NO: 15767 - protein, 9 aa, Artificial Sequence
  DNA-directed RNA polymerase III subunit RPC5 (106-114)
QTTSNTSRY

SEQ ID NO: 15768 - protein, 9 aa, Artificial Sequence
  Catenin beta-1 (78-86)
QVADIDGQY

SEQ ID NO: 15769 - protein, 9 aa, Artificial Sequence
  Regulator of microtubule dynamics protein 1 (253-261)
QVDPNFYSK

SEQ ID NO: 15770 - protein, 10 aa, Artificial Sequence
  Cell division cycle protein 27 homolog (594-603)
QVDPNYAYAY

SEQ ID NO: 15771 - protein, 14 aa, Artificial Sequence
  Protein Tob2 (303-316)
QVFGGGANSLFLEK

SEQ ID NO: 15772 - protein, 11 aa, Artificial Sequence
  UPF0488 protein C8orf33 (189-199)
QVQPVDGATRK

SEQ ID NO: 15773 - protein, 9 aa, Artificial Sequence
  Dynamin-like 120 kDa protein, mitochondrial (858-866)
QVYRRHFLK

SEQ ID NO: 15774 - protein, 9 aa, Artificial Sequence
  Zinc finger MIZ domain-containing protein 2 (283-291)
QYAPSTAQF

SEQ ID NO: 15775 - protein, 9 aa, Artificial Sequence
  HEAT repeat-containing protein 6 (870-878)
QYARIWNAL

SEQ ID NO: 15776 - protein, 9 aa, Artificial Sequence
  Ubiquitin carboxyl-terminal hydrolase 48 (677-685)
QYFPKAPEF

SEQ ID NO: 15777 - protein, 9 aa, Artificial Sequence
  DNA-directed RNA polymerase III subunit RPC2 (60-68)
QYKDVPITY

SEQ ID NO: 15778 - protein, 11 aa, Artificial Sequence
  Negative elongation factor A (142-152)
QYLNKNALTTL

SEQ ID NO: 15779 - protein, 9 aa, Artificial Sequence
  Laminin subunit alpha-4 (1299-1307)
QYNDGLSHF

SEQ ID NO: 15780 - protein, 9 aa, Artificial Sequence
  Protein spire homolog 1 (293-301)
QYNPLPIEY

SEQ ID NO: 15781 - protein, 9 aa, Artificial Sequence
  Protein transport protein Sec61 subunit alpha isoform 1 (275-283)
QYNTYPIKL

SEQ ID NO: 15782 - protein, 10 aa, Artificial Sequence
  Protein transport protein Sec61 subunit alpha isoform 1 (275-284)
QYNTYPIKLF

SEQ ID NO: 15783 - protein, 9 aa, Artificial Sequence
  Gem-associated protein 5 (1174-1182)
QYQEAFQKL

SEQ ID NO: 15784 - protein, 9 aa, Artificial Sequence
  E3 ubiquitin-protein ligase RNF213 (2046-2054)
QYQKVPVLF

SEQ ID NO: 15785 - protein, 9 aa, Artificial Sequence
  Spectrin beta chain, non-erythrocytic 2 (18-26)
QYSDINNRW

SEQ ID NO: 15786 - protein, 9 aa, Artificial Sequence
  Ubiquitin-like modifier-activating enzyme 1 (717-725)
QYSNNIRQL

SEQ ID NO: 15787 - protein, 9 aa, Artificial Sequence
  Phosphatidylinositol transfer protein beta isoform (56-64)
QYTHKIYHL

SEQ ID NO: 15788 - protein, 9 aa, Artificial Sequence
  Laminin subunit gamma-1 (6-14)
RAAPALRPR

SEQ ID NO: 15789 - protein, 9 aa, Artificial Sequence
  CCAAT/enhancer-binding protein beta (62-70)
RAIDFSPYL

SEQ ID NO: 15790 - protein, 11 aa, Artificial Sequence
  X-ray repair cross-complementing protein 6 (586-596)
RAYGLKSGLKK

SEQ ID NO: 15791 - protein, 9 aa, Artificial Sequence
  Filamin-B (649-657)
RAYGPGLEK

SEQ ID NO: 15792 - protein, 9 aa, Artificial Sequence
  Ras and Rab interactor 2 (179-187)
RDVLPFTLK

SEQ ID NO: 15793 - protein, 11 aa, Artificial Sequence
  Glutamine-tRNA ligase (34-44)
REAATQAQQTL

SEQ ID NO: 15794 - protein, 11 aa, Artificial Sequence
  Pre-mRNA-processing-splicing factor 8 (1275-1285)
REAVVNTQELL

SEQ ID NO: 15795 - protein, 9 aa, Artificial Sequence
  TFIIH basal transcription factor complex helicase XPB subunit (472-480)
REDDKIVDL

SEQ ID NO: 15796 - protein, 11 aa, Artificial Sequence
  Nuclear pore complex protein Nup107 (142-152)
REDDPGEAASM

SEQ ID NO: 15797 - protein, 10 aa, Artificial Sequence
  Translationally-controlled tumor protein (152-161)
REDGVTPYMI

SEQ ID NO: 15798 - protein, 9 aa, Artificial Sequence
  Catenin beta-1 (457-465)
REDITEPAI

SEQ ID NO: 15799 - protein, 12 aa, Artificial Sequence
  Histone-lysine N-methyltransferase 2D (2065-2076)
REDPGTGMGSSL

SEQ ID NO: 15800 - protein, 11 aa, Artificial Sequence
  Protein ELYS (1949-1959)
REDSNLESSQL

SEQ ID NO: 15801 - protein, 11 aa, Artificial Sequence
  DNA damage-inducible transcript 4 protein (39-49)
REEGFDRSTSL

SEQ ID NO: 15802 - protein, 10 aa, Artificial Sequence
  Protein THEMIS2 (210-219)
REENPEFTSL

SEQ ID NO: 15803 - protein, 10 aa, Artificial Sequence
  Serine/threonine-protein phosphatase 2B catalytic subunit beta isoform (441-450)
REESESVLTL

SEQ ID NO: 15804 - protein, 10 aa, Artificial Sequence
  Poly(rC)-binding protein 2 (40-49)
REESGARINI

SEQ ID NO: 15805 - protein, 10 aa, Artificial Sequence
  Vigilin (608-617)
REESNTKIDL

SEQ ID NO: 15806 - protein, 9 aa, Artificial Sequence
  Double-strand-break repair protein rad21 homolog (146-154)
REEVGNISI

SEQ ID NO: 15807 - protein, 9 aa, Artificial Sequence
  U3 small nucleolar RNA-associated protein 14 homolog A (370-378)
REFEERRSL

SEQ ID NO: 15808 - protein, 11 aa, Artificial Sequence
  ADP-ribose pyrophosphatase, mitochondrial (229-239)
REFGEEALNSL

SEQ ID NO: 15809 - protein, 9 aa, Artificial Sequence
  Procollagen-lysine,2-oxoglutarate 5-dioxygenase 2 (100-108)
REFIAPVTL

SEQ ID NO: 15810 - protein, 10 aa, Artificial Sequence
  Peptidyl-prolyl cis-trans isomerase FKBP14 (202-211)
REFTYKHDEL

SEQ ID NO: 15811 - protein, 9 aa, Artificial Sequence
  Splicing factor 3B subunit 1 (390-398)
REIDERNRP

SEQ ID NO: 15812 - protein, 10 aa, Artificial Sequence
  Nucleolin (546-555)
REIEGRAIRL

SEQ ID NO: 15813 - protein, 9 aa, Artificial Sequence
  Cytoplasmic dynein 1 heavy chain 1 (254-262)
REIQKVTKL

SEQ ID NO: 15814 - protein, 11 aa, Artificial Sequence
  Death-associated protein kinase 3 (69-79)
REIRHPNIITL

SEQ ID NO: 15815 - protein, 10 aa, Artificial Sequence
  E3 ubiquitin-protein ligase BRE1B (440-449)
REKDDANFKL

SEQ ID NO: 15816 - protein, 9 aa, Artificial Sequence
  Transcription factor AP-2 alpha (Activating enhancer binding protein 2 alpha), isoform CRA_c (266-274)
REKLDKIGL

SEQ ID NO: 15817 - protein, 9 aa, Artificial Sequence
  Putative pituitary tumor-transforming gene 3 protein (153-161)
RELEKLFQL

SEQ ID NO: 15818 - protein, 10 aa, Artificial Sequence
  Guanine nucleotide-binding protein G(I)/G(S)/G(T) subunit beta-2 (137-146)
RELPGHTGYL

SEQ ID NO: 15819 - protein, 10 aa, Artificial Sequence
  Glycosylphosphatidylinositol anchor attachment 1 protein (565-574)
RELQEAPLSL

SEQ ID NO: 15820 - protein, 10 aa, Artificial Sequence
  Ataxin-10 (119-128)
RELRVEQESL

SEQ ID NO: 15821 - protein, 10 aa, Artificial Sequence
  TSC22 domain family protein 3 (77-86)
RELVEKNSQL

SEQ ID NO: 15822 - protein, 11 aa, Artificial Sequence
  Src substrate cortactin (59-69)
RENVFQEHQTL

SEQ ID NO: 15823 - protein, 11 aa, Artificial Sequence
  WW domain-containing transcription regulator protein 1 (308-318)
REQSTDSGLGL

SEQ ID NO: 15824 - protein, 9 aa, Artificial Sequence
  Endoplasmin (427-435)
RETLQQHKL

SEQ ID NO: 15825 - protein, 10 aa, Artificial Sequence
  Rho guanine nucleotide exchange factor 2 (633-642)
REVEGLKDLL

SEQ ID NO: 15826 - protein, 9 aa, Artificial Sequence
  Bifunctional methylenetetrahydrofolate dehydrogenase/cyclohydrolase, mitochondrial (337-345)
REVLKSKEL

SEQ ID NO: 15827 - protein, 9 aa, Artificial Sequence
  Phosphoserine aminotransferase (319-327)
RFLDKALEL

SEQ ID NO: 15828 - protein, 10 aa, Artificial Sequence
  AP-5 complex subunit sigma-1 (172-181)
RFLPHGQLLF

SEQ ID NO: 15829 - protein, 9 aa, Artificial Sequence
  Arf-GAP with coiled-coil, ANK repeat and PH domain-containing protein 2 (770-778)
RFQQDSQKF

SEQ ID NO: 15830 - protein, 9 aa, Artificial Sequence
  NADH dehydrogenase (ubiquinone) 1 beta subcomplex subunit 5, mitochondrial (61-69)
RFYDRRFLK

SEQ ID NO: 15831 - protein, 11 aa, Artificial Sequence
  Putative helicase MOV-10 (450-460)
RGLDDIKDLKV

SEQ ID NO: 15832 - protein, 11 aa, Artificial Sequence
  Protein EFR3 homolog A (165-175)
RIAGIRGIQGV

SEQ ID NO: 15833 - protein, 11 aa, Artificial Sequence
  Nuclear cap-binding protein subunit 1 (194-204)
RIFANTESYLK

SEQ ID NO: 15834 - protein, 9 aa, Artificial Sequence
  Transcription cofactor vestigial-like protein 4 (79-87)
RIFNPHLNK

SEQ ID NO: 15835 - protein, 9 aa, Artificial Sequence
  Tubulin polyglutamylase TTLL7 (765-773)
RIFNRVFNR

SEQ ID NO: 15836 - protein, 10 aa, Artificial Sequence
  Centrosomal protein of 192 kDa (1349-1358)
RIFPDKFVLK

SEQ ID NO: 15837 - protein, 9 aa, Artificial Sequence
  V-type proton ATPase subunit B, brain isoform (380-388)
RIFPKEMLK

SEQ ID NO: 15838 - protein, 9 aa, Artificial Sequence
  COUP transcription factor 2 (293-301)
RIFQEQVEK

SEQ ID NO: 15839 - protein, 9 aa, Artificial Sequence
  BolA-like protein 3 (99-107)
RIFTSVPKR

SEQ ID NO: 15840 - protein, 10 aa, Artificial Sequence
  Serine/threonine-protein kinase PLK2 (71-80)
RIIVDPTTGK

SEQ ID NO: 15841 - protein, 9 aa, Artificial Sequence
  Exostosin-2 (166-174)
RIKETAQAM

SEQ ID NO: 15842 - protein, 11 aa, Artificial Sequence
  Calcium-independent phospholipase A2-gamma (131-141)
RIKSTLNSVSK

SEQ ID NO: 15843 - protein, 11 aa, Artificial Sequence
  Inactive tyrosine-protein kinase 7 (630-640)
RILDPTKLGPR

SEQ ID NO: 15844 - protein, 11 aa, Artificial Sequence
  MORC family CW-type zinc finger protein 3 (659-669)
RILEMNDKYVK

SEQ ID NO: 15845 - protein, 9 aa, Artificial Sequence
  Eukaryotic translation initiation factor 3 subunit C-like protein (507-515)
RILHTYYKF

SEQ ID NO: 15846 - protein, 10 aa, Artificial Sequence
  DNA polymerase alpha subunit B (497-506)
RILKHILTQR

SEQ ID NO: 15847 - protein, 9 aa, Artificial Sequence
  Chromodomain-helicase-DNA-binding protein 4 (623-631)
RILNHSVDK

SEQ ID NO: 15848 - protein, 9 aa, Artificial Sequence
  Catechol O-methyltransferase (58-66)
RILNHVLQH

SEQ ID NO: 15849 - protein, 10 aa, Artificial Sequence
  Cleavage stimulation factor subunit 2 tau variant (180-189)
RIMDPEIALK

SEQ ID NO: 15850 - protein, 9 aa, Artificial Sequence
  Rho GTPase-activating protein 7 (278-286)
RINVPMVRK

SEQ ID NO: 15851 - protein, 11 aa, Artificial Sequence
  Pleckstrin homology domain-containing family A member 5 (177-187)
RIQDVMEGLSK

SEQ ID NO: 15852 - protein, 9 aa, Artificial Sequence
  ATP-dependent RNA helicase DDX19B (454-462)
RIQEHFNKK

SEQ ID NO: 15853 - protein, 9 aa, Artificial Sequence
  Dolichyl-diphosphooligosaccharide-proteinosyltransferase subunit DAD1 (74-82)
RIQINPQNK

SEQ ID NO: 15854 - protein, 9 aa, Artificial Sequence
  Dynamin-like 120 kDa protein, mitochondrial (500-508)
RIQQIIEGK

SEQ ID NO: 15855 - protein, 11 aa, Artificial Sequence
  Coronin-2B (108-118)
RIWEIPEGGLK

SEQ ID NO: 15856 - protein, 12 aa, Artificial Sequence
  Coronin-2B (113-124)
RIWEIPEGGLKR

SEQ ID NO: 15857 - protein, 9 aa, Artificial Sequence
  E3 ubiquitin-protein ligase HECTD1 (480-488)
RIWEPTYTI

SEQ ID NO: 15858 - protein, 10 aa, Artificial Sequence
  Protein kinase C iota type (269-278)
RIYAMKVVKK

SEQ ID NO: 15859 - protein, 10 aa, Artificial Sequence
  DNA dC-dU-editing enzyme APOBEC-3B (119-128)
RIYDYDPLYK

SEQ ID NO: 15860 - protein, 12 aa, Artificial Sequence
  Fragile X mental retardation syndrome-related protein 1 (263-274)
RIYGESADAVKK

SEQ ID NO: 15861 - protein, 11 aa, Artificial Sequence
  Arpin (3-13)
RIYHDGALRNK

SEQ ID NO: 15862 - protein, 9 aa, Artificial Sequence
  Long-chain-fatty-acid-CoA ligase 3 (389-397)
RIYKNVMNK

SEQ ID NO: 15863 - protein, 12 aa, Artificial Sequence
  Reticulon-1 (565-576)
RIYKSVLQAVQK

SEQ ID NO: 15864 - protein, 9 aa, Artificial Sequence
  Protein MMS22-like (284-292)
RIYSKFHQK

SEQ ID NO: 15865 - protein, 11 aa, Artificial Sequence
  Cytoplasmic dynein 1 heavy chain 1 (1603-1613)
RLADLLGKIQK

SEQ ID NO: 15866 - protein, 9 aa, Artificial Sequence
  NADH dehydrogenase (ubiquinone) 1 beta subcomplex subunit 4 (36-44)
RLAIRAQLK

SEQ ID NO: 15867 - protein, 9 aa, Artificial Sequence
  Vacuolar protein sorting-associated protein 51 homolog (159-167)
RLAQQLRQR

SEQ ID NO: 15868 - protein, 9 aa, Artificial Sequence
  Replication initiator 1 (39-47)
RLASLQSEV

SEQ ID NO: 15869 - protein, 9 aa, Artificial Sequence
  HEAT repeat-containing protein 2 (751-759)
RLDDVSNDV

SEQ ID NO: 15870 - protein, 9 aa, Artificial Sequence
  Arf-GAP with Rho-GAP domain, ANK repeat and PH domain-containing protein 1 (106-114)
RLDTDHLRY

SEQ ID NO: 15871 - protein, 10 aa, Artificial Sequence
  Centrosomal protein of 41 kDa (29-38)
RLDTGNSMTK

SEQ ID NO: 15872 - protein, 9 aa, Artificial Sequence
  Protein flightless-1 homolog (672-680)
RLFAEKINK

SEQ ID NO: 15873 - protein, 9 aa, Artificial Sequence
  Elongator complex protein 2 (264-272)
RLFAPWKRK

SEQ ID NO: 15874 - protein, 9 aa, Artificial Sequence
  NEDD8-conjugating enzyme Ubc12 (158-166)
RLFEQNVQR

SEQ ID NO: 15875 - protein, 9 aa, Artificial Sequence
  Synaptonemal complex protein SC65 (104-112)
RLFGRVLER

SEQ ID NO: 15876 - protein, 9 aa, Artificial Sequence
  Plectin (177-185)
RLFNAIIHR

SEQ ID NO: 15877 - protein, 10 aa, Artificial Sequence
  Transformation/transcription domain-associated protein (1453-1462)
RLFPNSFNDK

SEQ ID NO: 15878 - protein, 10 aa, Artificial Sequence
  Zinc finger protein ZXDC (460-469)
RLFTSKHSMK

SEQ ID NO: 15879 - protein, 9 aa, Artificial Sequence
  Insulin-degrading enzyme (683-691)
RLHIEALLH

SEQ ID NO: 15880 - protein, 11 aa, Artificial Sequence
  Proteasome subunit alpha type-4 (20-30)
RLIAQRYLLQY

SEQ ID NO: 15881 - protein, 10 aa, Artificial Sequence
  Probable ATP-dependent RNA helicase DDX17 (304-313)
RLIDFLESGK

SEQ ID NO: 15882 - protein, 11 aa, Artificial Sequence
  General transcription factor 3C polypeptide 1 (377-387)
RLIESLFTIQK

SEQ ID NO: 15883 - protein, 12 aa, Artificial Sequence
  Protein S100-A13 (77-88)
RLIGELAKEIRK

SEQ ID NO: 15884 - protein, 11 aa, Artificial Sequence
  ATP synthase subunit a (41-51)
RLITTQQWLIK

SEQ ID NO: 15885 - protein, 11 aa, Artificial Sequence
  Peroxisomal multifunctional enzyme type 2 (634-644)
RLKDIGPEVVK

SEQ ID NO: 15886 - protein, 9 aa, Artificial Sequence
  Cardiolipin synthase (CMP-forming) (235-243)
RLKPTFISK

SEQ ID NO: 15887 - protein, 12 aa, Artificial Sequence
  Eukaryotic translation initiation factor 3 subunit A (340-351)
RLLDMDGIIVEK

SEQ ID NO: 15888 - protein, 9 aa, Artificial Sequence
  Oxidation resistance protein 1 (21-37)
RLLDSEIKL

SEQ ID NO: 15889 - protein, 10 aa, Artificial Sequence
  Mucosa-associated lymphoid tissue lymphoma translocation protein 1 (834-843)
RLLEDKKITV

SEQ ID NO: 15890 - protein, 11 aa, Artificial Sequence
  Condensin-2 complex subunit D3 (225-235)
RLLPKFSLKEK

SEQ ID NO: 15891 - protein, 10 aa, Artificial Sequence
  Uridine-cytidine kinase-like 1 (31-40)
RLLPPVGTGR

SEQ ID NO: 15892 - protein, 10 aa, Artificial Sequence
  Lymphokine-activated killer T-cell-originated protein kinase (81-90)
RLMDEAKILK

SEQ ID NO: 15893 - protein, 9 aa, Artificial Sequence
  GCN1 general control of amino-acid synthesis 1-like 1 (961-969)
RLMEIYQEK

SEQ ID NO: 15894 - protein, 9 aa, Artificial Sequence
  RILP-like protein 1 (200-208)
RLMKINHDL

SEQ ID NO: 15895 - protein, 9 aa, Artificial Sequence
  Sperm-specific antigen 2 (294-302)
RLMKTLSKL

SEQ ID NO: 15896 - protein, 9 aa, Artificial Sequence
  Glyoxylate reductase/hydroxypyruvate reductase (5-13)
RLMKVFVTR

SEQ ID NO: 15897 - protein, 9 aa, Artificial Sequence
  Bombesin receptor-activated protein C6orf89 (119-127)
RLMSLPIAK

SEQ ID NO: 15898 - protein, 10 aa, Artificial Sequence
  Fibronectin type-III domain-containing protein 3A (948-957)
RLNESTSYKF

SEQ ID NO: 15899 - protein, 9 aa, Artificial Sequence
  DNA damage-binding protein 1 (1057-1065)
RLNKVIKSV

SEQ ID NO: 15900 - protein, 10 aa, Artificial Sequence
  Serine/threonine-protein phosphatase 2A 56 kDa regulatory subunit delta isoform (408-417)
RLNPQYPMFR

SEQ ID NO: 15901 - protein, 9 aa, Artificial Sequence
  Tuberin (712-720)
RLPESLRYK

SEQ ID NO: 15902 - protein, 9 aa, Artificial Sequence
  Poly (ADP-ribose) polymerase 10 (221-229)
RLPGPLGTV

SEQ ID NO: 15903 - protein, 10 aa, Artificial Sequence
  Lipase maturation factor 1 (191-200)
RLPQHTPTSR

SEQ ID NO: 15904 - protein, 9 aa, Artificial Sequence
  ER membrane protein complex subunit 7 (133-141)
RLPYPLQMK

SEQ ID NO: 15905 - protein, 10 aa, Artificial Sequence
  Guanine nucleotide-binding protein G(s) subunit alpha isoforms short (255-264)
RLQEALNLFK

SEQ ID NO: 15906 - protein, 9 aa, Artificial Sequence
  Syntaxin-18 (265-273)
RLQEIFTEK

SEQ ID NO: 15907 - protein, 9 aa, Artificial Sequence
  Pyridoxal-dependent decarboxylase domain-containing protein 1 (365-373)
RLQESLKKV

SEQ ID NO: 15908 - protein, 10 aa, Artificial Sequence
  Serine/threonine-protein kinase SIK2 (468-477)
RLQKPSLLSK

SEQ ID NO: 15909 - protein, 9 aa, Artificial Sequence
  ELAV-like protein 1 (85-93)
RLQSKTIKV

SEQ ID NO: 15910 - protein, 9 aa, Artificial Sequence
  E3 ubiquitin-protein ligase UBR5 (21-29)
RLREVSEKL

SEQ ID NO: 15911 - protein, 9 aa, Artificial Sequence
  Pituitary tumor-transforming gene 1 protein-interacting protein (14-22)
RLRLGGAAL

SEQ ID NO: 15912 - protein, 9 aa, Artificial Sequence
  Serine/arginine-rich splicing factor 6 (8-16)
RLSYNVREK

SEQ ID NO: 15913 - protein, 10 aa, Artificial Sequence
  DNA mismatch repair protein Mlh1 (265-274)
RLVESTSLRK

SEQ ID NO: 15914 - protein, 10 aa, Artificial Sequence
  E3 SUMO-protein ligase RanBP2 (170-179)
RLVEVYRSTK

SEQ ID NO: 15915 - protein, 9 aa, Artificial Sequence
  V-type proton ATPase subunit E 2 (44-52)
RLVQTQRLK

SEQ ID NO: 15916 - protein, 9 aa, Artificial Sequence
  Sterol regulatory element-binding protein 2 (632-640)
RLVRWLLKK

SEQ ID NO: 15917 - protein, 9 aa, Artificial Sequence
  Protein disulfide-isomerase A3 (115-123)
RLWHIQSKK

SEQ ID NO: 15918 - protein, 9 aa, Artificial Sequence
  Transducin beta-like protein 3 (102-110)
RLWKAIHTA

SEQ ID NO: 15919 - protein, 10 aa, Artificial Sequence
  GRAM domain-containing protein 1B (198-207)
RLWQNALLEK

SEQ ID NO: 15920 - protein, 10 aa, Artificial Sequence
  Inositol 1,4,5-trisphosphate receptor type 3 (801-810)
RLWTEIPTAI

SEQ ID NO: 15921 - protein, 9 aa, Artificial Sequence
  Annexin A5 (89-97)
RLYDAYELK

SEQ ID NO: 15922 - protein, 10 aa, Artificial Sequence
  DNA damage-binding protein 1 (134-143)
RLYDGLFKVI

SEQ ID NO: 15923 - protein, 9 aa, Artificial Sequence
  Nesprin-1 (318-326)
RLYDLPAKR

SEQ ID NO: 15924 - protein, 9 aa, Artificial Sequence
  Annexin A2 (273-281)
RLYDSMKGK

SEQ ID NO: 15925 - protein, 9 aa, Artificial Sequence
  DNA topoisomerase 3-alpha (407-415)
RLYEFIVRH

SEQ ID NO: 15926 - protein, 9 aa, Artificial Sequence
  Glutamine-tRNA ligase (679-687)
RLYERLFQH

SEQ ID NO: 15927 - protein, 12 aa, Artificial Sequence
  Eukaryotic translation initiation factor 3 subunit A (172-183)
RLYHDIAQQAFK

SEQ ID NO: 15928 - protein, 9 aa, Artificial Sequence
  GPI transamidase component PIG-T (503-511)
RLYTEPLLV

SEQ ID NO: 15929 - protein, 9 aa, Artificial Sequence
  2-hydroxyacyl-CoA lyase 1 (135-143)
RLYTKFSAR

SEQ ID NO: 15930 - protein, 8 aa, Artificial Sequence
  Uncharacterized protein (677-684)
RLYVGREK

SEQ ID NO: 15931 - protein, 9 aa, Artificial Sequence
  Protein sel-1 homolog 3 (282-290)
RMDYPVFTV

SEQ ID NO: 15932 - protein, 11 aa, Artificial Sequence
  Vimentin (13-23)
RMFGGPGTASR

SEQ ID NO: 15933 - protein, 9 aa, Artificial Sequence
  Dynamin-1 (271-279)
RMGTPYLQK

SEQ ID NO: 15934 - protein, 9 aa, Artificial Sequence
  Eukaryotic translation initiation factor 3 subunit C-like protein (709-717)
RMISKQFHH

SEQ ID NO: 15935 - protein, 10 aa, Artificial Sequence
  Protein FAM208B (229-238)
RMKDPTFLGK

SEQ ID NO: 15936 - protein, 10 aa, Artificial Sequence
  UPF0585 protein C16orf13 (168-177)
RMVDMPANNK

SEQ ID NO: 15937 - protein, 9 aa, Artificial Sequence
  60S ribosomal protein L13a (117-125)
RMVVPAALK

SEQ ID NO: 15938 - protein, 9 aa, Artificial Sequence
  Cytoplasmic FMR1-interacting protein 1 (286-294)
RMYLTPSEK

SEQ ID NO: 15939 - protein, 10 aa, Artificial Sequence
  Phosphatidate cytidylyltransferase 2 (307-316)
RMYPFQIHSI

SEQ ID NO: 15940 - protein, 9 aa, Artificial Sequence
  RNA cytidine acetyltransferase (629-637)
RPAERLDYL

SEQ ID NO: 15941 - protein, 9 aa, Artificial Sequence
  Cell division cycle protein 23 homolog (423-431)
RPNDSRMLV

SEQ ID NO: 15942 - protein, 9 aa, Artificial Sequence
  Transgelin-2 (44-52)
RPQPGRENF

SEQ ID NO: 15943 - protein, 10 aa, Artificial Sequence
  Myosin regulatory light polypeptide 9 (14-23)
RPQRATSNVF

SEQ ID NO: 15944 - protein, 9 aa, Artificial Sequence
  Pre-mRNA-splicing factor SYF1 (370-378)
RPREIINTY

SEQ ID NO: 15945 - protein, 10 aa, Artificial Sequence
  Trafficking protein particle complex subunit 4 (100-109)
RPRLTSNEKL

SEQ ID NO: 15946 - protein, 10 aa, Artificial Sequence
  Cytochrome c oxidase assembly factor 3 homolog, mitochondrial (39-48)
RQAELAQWQK

SEQ ID NO: 15947 - protein, 9 aa, Artificial Sequence
  Focal adhesion kinase 1 (476-484)
RQFDHPHIV

SEQ ID NO: 15948 - protein, 11 aa, Artificial Sequence
  Acidic fibroblast growth factor intracellular-binding protein (136-146)
RQFDNFKRVFK

SEQ ID NO: 15949 - protein, 11 aa, Artificial Sequence
  MICOS complex subunit MIC19 (130-140)
RQLEEKDRVLK

SEQ ID NO: 15950 - protein, 11 aa, Artificial Sequence
  40S ribosomal protein S29 (44-54)
RQYAKDIGFIK

SEQ ID NO: 15951 - protein, 10 aa, Artificial Sequence
  F-box only protein 33 (21-30)
RQYDKFLTHF

SEQ ID NO: 15952 - protein, 9 aa, Artificial Sequence
  SH2B adapter protein 1 (560-568)
RRGEYVLTF

SEQ ID NO: 15953 - protein, 9 aa, Artificial Sequence
  Multivesicular body subunit 12A (198-206)
RRNDSIYEA

SEQ ID NO: 15954 - protein, 9 aa, Artificial Sequence
  Chloride intracellular channel protein 1 (50-58)
RRTETVQKL

SEQ ID NO: 15955 - protein, 9 aa, Artificial Sequence
  Eukaryotic translation initiation factor 3 subunit L (327-335)
RRYQDAIRV

SEQ ID NO: 15956 - protein, 9 aa, Artificial Sequence
  Breast cancer metastasis-suppressor 1-like protein (255-263)
RSEEGRLYY

SEQ ID NO: 15957 - protein, 11 aa, Artificial Sequence
  Putative protein N-methyltransferase FAM86B1 (27-37)
RSFPWQSLEAK

SEQ ID NO: 15958 - protein, 11 aa, Artificial Sequence
  Dual specificity protein kinase CLK1 (60-70)
RSINEKDYHSR

SEQ ID NO: 15959 - protein, 11 aa, Artificial Sequence
  Transmembrane protein 209 (277-287)
RSMGDYAQTLK

SEQ ID NO: 15960 - protein, 9 aa, Artificial Sequence
  Annexin A11 (302-310)
RSNEHIREL

SEQ ID NO: 15961 - protein, 9 aa, Artificial Sequence
  Cullin-associated NEDD8-dissociated protein 1 (758-766)
RSTDSIRLL

SEQ ID NO: 15962 - protein, 9 aa, Artificial Sequence
  Non-structural maintenance of chromosomes element 4 homolog A (203-211)
RTAENTFNK

SEQ ID NO: 15963 - protein, 11 aa, Artificial Sequence
  Nephrocystin-1 (181-191)
RTDPHWSAVQK

SEQ ID NO: 15964 - protein, 10 aa, Artificial Sequence
  Arginine-glutamic acid dipeptide repeats protein (74-83)
RTDTGEITSY

SEQ ID NO: 15965 - protein, 11 aa, Artificial Sequence
  Ectonucleoside triphosphate diphosphohydrolase 6 (319-329)
RTEEVKHVDFY

SEQ ID NO: 15966 - protein, 12 aa, Artificial Sequence
  Protein LSM12 homolog (95-106)
RTEKEEKLSQAY

SEQ ID NO: 15967 - protein, 10 aa, Artificial Sequence
  Tubulin-tyrosine ligase-like protein 12 (394-403)
RTELPQFVSY

SEQ ID NO: 15968 - protein, 9 aa, Artificial Sequence
  A-kinase anchor protein 13 (994-1002)
RTFSYIKNK

SEQ ID NO: 15969 - protein, 12 aa, Artificial Sequence
  Biogenesis of lysosome-related organelles complex 1 subunit 1 (106-117)
RTIATALEYVYK

SEQ ID NO: 15970 - protein, 9 aa, Artificial Sequence
  WASH complex subunit 7 (330-338)
RTIDKKFYK

SEQ ID NO: 15971 - protein, 9 aa, Artificial Sequence
  Leucine-rich repeat-containing protein 57 (41-49)
RTIDLSNNK

SEQ ID NO: 15972 - protein, 12 aa, Artificial Sequence
  DNA damage-binding protein 2 (181-192)
RTIDVFDGNSGK

SEQ ID NO: 15973 - protein, 11 aa, Artificial Sequence
  F-box only protein 25 (19-29)
RTILEMTQILK

SEQ ID NO: 15974 - protein, 11 aa, Artificial Sequence
  DDB1- and CUL4-associated factor 4 (390-400)
RTIPSPYPASK

SEQ ID NO: 15975 - protein, 9 aa, Artificial Sequence
  Protein CEBPZOS (3-11)
RTLEPLAKK

SEQ ID NO: 15976 - protein, 12 aa, Artificial Sequence
  Solute carrier family 22 member 18 (377-388)
RTLGPTVGGLLY

SEQ ID NO: 15977 - protein, 9 aa, Artificial Sequence
  Coatomer subunit gamma-2 (309-317)
RTLNKVAMK

SEQ ID NO: 15978 - protein, 12 aa, Artificial Sequence
  Nuclear factor 1 C-type (82-93)
RTLPSTSSSGSK

SEQ ID NO: 15979 - protein, 9 aa, Artificial Sequence
  Pinin (6-14)
RTLQEQLEK

SEQ ID NO: 15980 - protein, 11 aa, Artificial Sequence
  Ornithine decarboxylase antizyme 1 (32-42)
RTMPLLSLHSR

SEQ ID NO: 15981 - protein, 9 aa, Artificial Sequence
  2,4-dienoyl-CoA reductase, mitochondrial (33-41)
RTNFFSNWK

SEQ ID NO: 15982 - protein, 9 aa, Artificial Sequence
  Endoplasmic reticulum-Golgi intermediate compartment protein 3 (297-305)
RTNQFSVTR

SEQ ID NO: 15983 - protein, 9 aa, Artificial Sequence
  RNA-binding protein 26 (515-523)
RTNSPGFQK

SEQ ID NO: 15984 - protein, 10 aa, Artificial Sequence
  Breast cancer type 2 susceptibility protein (2034-2043)
RTPEHLISQK

SEQ ID NO: 15985 - protein, 9 aa, Artificial Sequence
  Short transient receptor potential channel 4-associated protein (364-372)
RTQLPQSMK

SEQ ID NO: 15986 - protein, 11 aa, Artificial Sequence
  Signal recognition particle 14 kDa protein (21-31)
RTSGSVYITLK

SEQ ID NO: 15987 - protein, 9 aa, Artificial Sequence
  Histone-lysine N-methyltransferase 2A (1655-1663)
RTTSHLLRY

SEQ ID NO: 15988 - protein, 10 aa, Artificial Sequence
  Diphosphoinositol polyphosphate phosphohydrolase 3-alpha (9-18)
RTYDPEGFKK

SEQ ID NO: 15989 - protein, 11 aa, Artificial Sequence
  Transcription factor p65 (287-297)
RTYETFKSIMK

SEQ ID NO: 15990 - protein, 10 aa, Artificial Sequence
  Ras and Rab interactor 1 (442-451)
RTYSPSAQVK

SEQ ID NO: 15991 - protein, 11 aa, Artificial Sequence
  Ras and Rab interactor 1 (442-452)
RTYSPSAQVKR

SEQ ID NO: 15992 - protein, 11 aa, Artificial Sequence
  Acyl-CoA dehydrogenase family member 10 (557-567)
RVAAILQGVYK

SEQ ID NO: 15993 - protein, 11 aa, Artificial Sequence
  Cytochrome c oxidase subunit 7A-related protein, mitochondrial (26-36)
RVAPGQLGHEK

SEQ ID NO: 15994 - protein, 9 aa, Artificial Sequence
  E3 ubiquitin-protein ligase TRIP12 (1581-1589)
RVAPRLDRK

SEQ ID NO: 15995 - protein, 11 aa, Artificial Sequence
  Coiled-coil domain-containing protein 115 (34-44)
RVEEGWLSLAK

SEQ ID NO: 15996 - protein, 9 aa, Artificial Sequence
  Serine/threonine-protein kinase B-raf (158-166)
RVFLPNKQR

SEQ ID NO: 15997 - protein, 11 aa, Artificial Sequence
  Coatomer subunit gamma-1 (32-42)
RVFNETPINPR

SEQ ID NO: 15998 - protein, 9 aa, Artificial Sequence
  Arf-GAP with GTPase, ANK repeat and PH domain-containing protein 3 (240-248)
RVFQDVAQK

SEQ ID NO: 15999 - protein, 10 aa, Artificial Sequence
  28S ribosomal protein S15, mitochondrial (238-247)
RVFQETQKLK

SEQ ID NO: 16000 - protein, 11 aa, Artificial Sequence
  28S ribosomal protein S15, mitochondrial (238-248)
RVFQETQKLKK

SEQ ID NO: 16001 - protein, 9 aa, Artificial Sequence
  EH domain-containing protein 2 (305-313)
RVHAYIISY

SEQ ID NO: 16002 - protein, 10 aa, Artificial Sequence
  L-lactate dehydrogenase A chain (269-278)
RVHPVSTMIK

SEQ ID NO: 16003 - protein, 10 aa, Artificial Sequence
  E3 ubiquitin-protein ligase NEDD4 (24-33)
RVIAGIGLAK

SEQ ID NO: 16004 - protein, 9 aa, Artificial Sequence
  60S ribosomal protein L3 (156-164)
RVIAHTQMR

SEQ ID NO: 16005 - protein, 9 aa, Artificial Sequence
  Lon protease homolog 2, peroxisomal (241-249)
RVIAIRPIR

SEQ ID NO: 16006 - protein, 9 aa, Artificial Sequence
  Ran GTPase-activating protein 1 (67-75)
RVIAKALEK

SEQ ID NO: 16007 - protein, 10 aa, Artificial Sequence
  SAFB-like transcription modulator (26-35)
RVIDLKSELK

SEQ ID NO: 16008 - protein, 11 aa, Artificial Sequence
  Histone-binding protein RBBP7 (58-68)
RVINEEYKIWK

SEQ ID NO: 16009 - protein, 9 aa, Artificial Sequence
  Pumilio homolog 2 (311-319)
RVIQRILEH

SEQ ID NO: 16010 - protein, 11 aa, Artificial Sequence
  60S ribosomal protein L13 (167-177)
RVITEEEKNFK

SEQ ID NO: 16011 - protein, 12 aa, Artificial Sequence
  Cullin-4A (273-284)
RVITYLDHSTQK

SEQ ID NO: 16012 - protein, 10 aa, Artificial Sequence
  COX assembly mitochondrial protein 2 homolog (63-72)
RVIVTHGSLK

SEQ ID NO: 16013 - protein, 12 aa, Artificial Sequence
  Guanine nucleotide-binding protein G(I)/G(S)/G(O) subunit gamma-5 (25-36)
RVKVSQAAADLK

SEQ ID NO: 16014 - protein, 11 aa, Artificial Sequence
  Monofunctional C1-tetrahydrofolate synthase, mitochondrial (497-507)
RVLDTNDRFLR

SEQ ID NO: 16015 - protein, 9 aa, Artificial Sequence
  3-hydroxybutyrate dehydrogenase type 2 (55-63)
RVLDVTKKK

SEQ ID NO: 16016 - protein, 10 aa, Artificial Sequence
  Cysteine-rich with EGF-like domain protein 1 (411-420)
RVLEGFIKGR

SEQ ID NO: 16017 - protein, 12 aa, Artificial Sequence
  Serine hydroxymethyltransferase, mitochondrial (374-385)
RVLELVSITANK

SEQ ID NO: 16018 - protein, 12 aa, Artificial Sequence
  Lon protease homolog 2, peroxisomal (308-319)
RVLEYLAVRQLK

SEQ ID NO: 16019 - protein, 9 aa, Artificial Sequence
  Focadhesin (1784-1792)
RVLPEFKKK

SEQ ID NO: 16020 - protein, 11 aa, Artificial Sequence
  Zinc finger MYM-type protein 1 (867-877)
RVLSVTGILSK

SEQ ID NO: 16021 - protein, 9 aa, Artificial Sequence
  Exostosin-like 2 (12-20)
RVMGIRVLR

SEQ ID NO: 16022 - protein, 11 aa, Artificial Sequence
  Inner centromere protein (907-917)
RVPSSLAYSLK

SEQ ID NO: 16023 - protein, 10 aa, Artificial Sequence
  DNA topoisomerase I, mitochondrial (376-385)
RVPVEKPVYK

SEQ ID NO: 16024 - protein, 9 aa, Artificial Sequence
  6-phosphofructo-2-kinase/fructose-2,6-bisphosphatase 3 (43-51)
RVQDHIQSR

SEQ ID NO: 16025 - protein, 10 aa, Artificial Sequence
  Melanoma inhibitory activity protein 3 (1184-1193)
RVQEENARLK

SEQ ID NO: 16026 - protein, 9 aa, Artificial Sequence
  DNA replication licensing factor MCM3 (234-242)
RVQVVGTYR

SEQ ID NO: 16027 - protein, 14 aa, Artificial Sequence
  LysM and putative peptidoglycan-binding domain-containing protein 2 (74-87)
RVRAGDTLQGIALK

SEQ ID NO: 16028 - protein, 11 aa, Artificial Sequence
  Galectin-1 (11-21)
RVRGEVAPDAK

SEQ ID NO: 16029 - protein, 9 aa, Artificial Sequence
  Protein phosphatase methylesterase 1 (228-236)
RVSMVGQVK

SEQ ID NO: 16030 - protein, 10 aa, Artificial Sequence
  SLAIN motif-containing protein 2 (375-384)
RVSPQPMISR

SEQ ID NO: 16031 - protein, 9 aa, Artificial Sequence
  RNA-binding protein Raly (133-141)
RVTVPLVRR

SEQ ID NO: 16032 - protein, 9 aa, Artificial Sequence
  5'-AMP-activated protein kinase subunit gamma-1 (236-244)
RVVDIYSKF

SEQ ID NO: 16033 - protein, 9 aa, Artificial Sequence
  Clathrin heavy chain 1 (903-911)
RVVGKYCEK

SEQ ID NO: 16034 - protein, 10 aa, Artificial Sequence
  Coatomer subunit alpha (160-169)
RVWDISGLRK

SEQ ID NO: 16035 - protein, 9 aa, Artificial Sequence
  SWI/SNF complex subunit SMARCC1 (56-64)
RVWLGKHYK

SEQ ID NO: 16036 - protein, 11 aa, Artificial Sequence
  Charged multivesicular body protein 1a (46-56)
RVYAENAIRKK

SEQ ID NO: 16037 - protein, 10 aa, Artificial Sequence
  WD repeat-containing protein 74 (208-217)
RVYDPASPQR

SEQ ID NO: 16038 - protein, 10 aa, Artificial Sequence
  Protein Churchill (86-95)
RVYHAVSVMR

SEQ ID NO: 16039 - protein, 9 aa, Artificial Sequence
  Cytochrome c oxidase assembly protein COX14 (33-41)
RVYHYFQWR

SEQ ID NO: 16040 - protein, 11 aa, Artificial Sequence
  Uncharacterized protein KIAA1522 (239-249)
RVYRDDTFVGR

SEQ ID NO: 16041 - protein, 9 aa, Artificial Sequence
  Poly(U)-binding-splicing factor PUF60 (112-120)
RVYVGSIYY

SEQ ID NO: 16042 - protein, 9 aa, Artificial Sequence
  Adipocyte plasma membrane-associated protein (296-304)
RVYVSGLMK

SEQ ID NO: 16043 - protein, 11 aa, Artificial Sequence
  Histone-lysine N-methyltransferase 2A (2053-2063)
RVYWSTTDARK

SEQ ID NO: 16044 - protein, 11 aa, Artificial Sequence
  60S ribosome subunit biogenesis protein NIP7 homolog (43-53)
RVYYVSEKIMK

SEQ ID NO: 16045 - protein, 9 aa, Artificial Sequence
  Kinesin-like protein KIF2C (467-475)
RYADRVKEL

SEQ ID NO: 16046 - protein, 10 aa, Artificial Sequence
  Protein-cysteine N-palmitoyltransferase HHAT (337-346)
RYFDVGLHNF

SEQ ID NO: 16047 - protein, 9 aa, Artificial Sequence
  von Willebrand factor A domain-containing protein 8 (1836-1844)
RYGIHPAKF

SEQ ID NO: 16048 - protein, 9 aa, Artificial Sequence
  Serine/threonine-protein kinase PLK2 (271-279)
RYIDTHNRV

SEQ ID NO: 16049 - protein, 9 aa, Artificial Sequence
  Deoxyguanosine kinase, mitochondrial (148-156)
RYIFAKNLF

SEQ ID NO: 16050 - protein, 9 aa, Artificial Sequence
  Rho GTPase-activating protein 35 (208-216)
RYIRDAHTF

SEQ ID NO: 16051 - protein, 9 aa, Artificial Sequence
  Structural maintenance of chromosomes protein 5 (245-253)
RYKQDVERF

SEQ ID NO: 16052 - protein, 11 aa, Artificial Sequence
  Tumor suppressor candidate 3 (18-28)
RYLPTGSFPFL

SEQ ID NO: 16053 - protein, 9 aa, Artificial Sequence
  Potassium voltage-gated channel subfamily G member 1 (168-176)
RYLQKIEEF

SEQ ID NO: 16054 - protein, 9 aa, Artificial Sequence
  Cell division cycle protein 16 homolog (320-328)
RYLSKATTL

SEQ ID NO: 16055 - protein, 9 aa, Artificial Sequence
  Histone-binding protein RBBP7 (130-138)
RYMPQNPHI

SEQ ID NO: 16056 - protein, 9 aa, Artificial Sequence
  Kelch-like protein 24 (592-600)
RYNEKCFKL

SEQ ID NO: 16057 - protein, 9 aa, Artificial Sequence
  Kelch-like protein 20 (478-486)
RYNPRTNQW

SEQ ID NO: 16058 - protein, 9 aa, Artificial Sequence
  Thyroid transcription factor 1-associated protein 26 (88-96)
RYPDNLKHL

SEQ ID NO: 16059 - protein, 10 aa, Artificial Sequence
  Thyroid transcription factor 1-associated protein 26 (88-97)
RYPDNLKHLY

SEQ ID NO: 16060 - protein, 9 aa, Artificial Sequence
  Serine/threonine-protein phosphatase 4 catalytic subunit (103-111)
RYPDRITLI

SEQ ID NO: 16061 - protein, 9 aa, Artificial Sequence
  Lysophosphatidylcholine acyltransferase 1 (98-106)
RYPNKLDTI

SEQ ID NO: 16062 - protein, 10 aa, Artificial Sequence
  CCR4-NOT transcription complex subunit 1 (438-447)
RYPNSHTHYF

SEQ ID NO: 16063 - protein, 9 aa, Artificial Sequence
  Uncharacterized protein C1orf43 (178-186)
RYQEALSEL

SEQ ID NO: 16064 - protein, 9 aa, Artificial Sequence
  YTH domain-containing protein 1 (550-558)
RYQEVDRRF

SEQ ID NO: 16065 - protein, 9 aa, Artificial Sequence
  High affinity cationic amino acid transporter 1 (419-427)
RYQPEQPNL

SEQ ID NO: 16066 - protein, 9 aa, Artificial Sequence
  Centrosomal protein of 89 kDa (331-339)
RYQTKFRHL

SEQ ID NO: 16067 - protein, 9 aa, Artificial Sequence
  Leucine zipper putative tumor suppressor 1 (36-44)
RYSDGLLRF

SEQ ID NO: 16068 - protein, 9 aa, Artificial Sequence
  Myotubularin related protein 6 (594-602)
RYSEYAEEF

SEQ ID NO: 16069 - protein, 9 aa, Artificial Sequence
  Rap guanine nucleotide exchange factor 6 (57-65)
RYSGNQVLF

SEQ ID NO: 16070 - protein, 9 aa, Artificial Sequence
  Cation-independent mannose-6-phosphate receptor (1582-1590)
RYVDQVLQL

SEQ ID NO: 16071 - protein, 9 aa, Artificial Sequence
  Calpain-5 (466-474)
RYVIIPTTF

SEQ ID NO: 16072 - protein, 9 aa, Artificial Sequence
  Histone-lysine N-methyltransferase EHMT2 (935-943)
RYYGNISRF

SEQ ID NO: 16073 - protein, 10 aa, Artificial Sequence
  Myosin-9 (104-113)
RYYSGLIYTY

SEQ ID NO: 16074 - protein, 9 aa, Artificial Sequence
  Fanconi anemia group C protein (413-421)
SAAEPPTAL

SEQ ID NO: 16075 - protein, 9 aa, Artificial Sequence
  V-type proton ATPase 16 kDa proteolipid subunit (20-28)
SAAMVFSAL

SEQ ID NO: 16076 - protein, 9 aa, Artificial Sequence
  Factor VIII intron 22 protein (251-259)
SAAPSPAAL

SEQ ID NO: 16077 - protein, 9 aa, Artificial Sequence
  Phosphoacetylglucosamine mutase (515-523)
SADHLAHEV

SEQ ID NO: 16078 - protein, 9 aa, Artificial Sequence
  Melanoma-associated antigen 1 (62-70)
SAFPTTINF

SEQ ID NO: 16079 - protein, 9 aa, Artificial Sequence
  Multiple epidermal growth factor-like domains protein 8 (745-753)
SAGPGHSEL

SEQ ID NO: 16080 - protein, 9 aa, Artificial Sequence
  AT-rich interactive domain-containing protein 2 (319-327)
SAHSHFISL

SEQ ID NO: 16081 - protein, 9 aa, Artificial Sequence
  ADP-ribosylation factor GTPase-activating protein 3 (167-175)
SAIAEPSSL

SEQ ID NO: 16082 - protein, 9 aa, Artificial Sequence
  Catenin alpha-1 (366-374)
SAIDKMTKK

SEQ ID NO: 16083 - protein, 9 aa, Artificial Sequence
  COBW domain-containing protein 5 (82-90)
SALEKSLAV

SEQ ID NO: 16084 - protein, 12 aa, Artificial Sequence
  Vimentin (42-53)
SALRPSTSRSLY

SEQ ID NO: 16085 - protein, 10 aa, Artificial Sequence
  Putative annexin A2-like protein (89-98)
SALSGHLETV

SEQ ID NO: 16086 - protein, 9 aa, Artificial Sequence
  Ran GTPase-activating protein 1 (174-182)
SAQGKPLAL

SEQ ID NO: 16087 - protein, 9 aa, Artificial Sequence
  Protein virilizer homolog (804-812)
SAVGHVFSL

SEQ ID NO: 16088 - protein, 9 aa, Artificial Sequence
  MICAL-like protein 2 (424-432)
SAVPPGTSL

SEQ ID NO: 16089 - protein, 10 aa, Artificial Sequence
  Eukaryotic peptide chain release factor GTP-binding subunit ERF3A (27-36)
SEAEPGGGSL

SEQ ID NO: 16090 - protein, 9 aa, Artificial Sequence
  Neuron navigator 2 (1899-1907)
SEAETVMQL

SEQ ID NO: 16091 - protein, 9 aa, Artificial Sequence
  Transportin-1 (59-67)
SEDEPTRSL

SEQ ID NO: 16092 - protein, 9 aa, Artificial Sequence
  Zinc finger protein 217 (77-85)
SEDLNKHVL

SEQ ID NO: 16093 - protein, 9 aa, Artificial Sequence
  Vacuolar protein sorting-associated protein 35 (500-508)
SEDPDQQYL

SEQ ID NO: 16094 - protein, 10 aa, Artificial Sequence
  Protein CASC3 (106-115)
SEEENSKVEL

SEQ ID NO: 16095 - protein, 9 aa, Artificial Sequence
  Ribosome biogenesis protein BOP1 (459-467)
SEEERQVGL

SEQ ID NO: 16096 - protein, 9 aa, Artificial Sequence
  GPI-anchor transamidase (176-184)
SEEITNIEL

SEQ ID NO: 16097 - protein, 10 aa, Artificial Sequence
  Tyrosine-protein kinase JAK1 (600-609)
SEEKKIKVIL

SEQ ID NO: 16098 - protein, 9 aa, Artificial Sequence
  DNA mismatch repair protein Msh2 (900-908)
SEENITIKL

SEQ ID NO: 16099 - protein, 9 aa, Artificial Sequence
  Selenocysteine insertion sequence-binding protein 2 (597-605)
SEEPPGTEL

SEQ ID NO: 16100 - protein, 11 aa, Artificial Sequence
  Rac GTPase-activating protein 1 (44-54)
SEEQKSALAFL

SEQ ID NO: 16101 - protein, 10 aa, Artificial Sequence
  X-ray repair cross-complementing protein 5 (546-555)
SEEQRFNNFL

SEQ ID NO: 16102 - protein, 9 aa, Artificial Sequence
  Caspase-8 (168-176)
SEEVSRSEL

SEQ ID NO: 16103 - protein, 9 aa, Artificial Sequence
  E3 ubiquitin-protein ligase UBR5 (2161-2169)
SEGPPLTSF

SEQ ID NO: 16104 - protein, 12 aa, Artificial Sequence
  Basigin (49-60)
SEHINEGETAML

SEQ ID NO: 16105 - protein, 11 aa, Artificial Sequence
  Kinesin-like protein KIF20A (608-618)
SEHLDTQKELL

SEQ ID NO: 16106 - protein, 11 aa, Artificial Sequence
  La-related protein 4 (384-394)
SEHSTEGSVSL

SEQ ID NO: 16107 - protein, 13 aa, Artificial Sequence
  AP-1 complex subunit beta-1 (185-197)
SEIAESHPSSNLL

SEQ ID NO: 16108 - protein, 10 aa, Artificial Sequence
  Endothelial PAS domain-containing protein 1 (345-354)
SEIEKNDVVF

SEQ ID NO: 16109 - protein, 11 aa, Artificial Sequence
  Centrosomal protein of 170 kDa (569-579)
SEIGEKQDTEL

SEQ ID NO: 16110 - protein, 10 aa, Artificial Sequence
  Protein OS-9 (136-145)
SEIKGEVLYL

SEQ ID NO: 16111 - protein, 11 aa, Artificial Sequence
  BCL-6 corepressor (765-775)
SEILETSSTKL

SEQ ID NO: 16112 - protein, 13 aa, Artificial Sequence
  AP-2 complex subunit beta (185-197)
SEISESHPNSNLL

SEQ ID NO: 16113 - protein, 10 aa, Artificial Sequence
  E3 ubiquitin-protein ligase UBR4 (365-374)
SEITDPESFL

SEQ ID NO: 16114 - protein, 10 aa, Artificial Sequence
  Centrin-1 (98-107)
SEKDTKEEIL

SEQ ID NO: 16115 - protein, 10 aa, Artificial Sequence
  Ubiquitin carboxyl-terminal hydrolase 43 (210-219)
SEKLPPEATK

SEQ ID NO: 16116 - protein, 9 aa, Artificial Sequence
  Spatacsin (742-750)
SELLKNMGF

SEQ ID NO: 16117 - protein, 9 aa, Artificial Sequence
  Nuclear pore complex protein Nup155 (1180-1188)
SELMDITKL

SEQ ID NO: 16118 - protein, 10 aa, Artificial Sequence
  WD repeat-containing protein 43 (123-132)
SENKEEPVKL

SEQ ID NO: 16119 - protein, 10 aa, Artificial Sequence
  Caspase recruitment domain-containing protein 19 (24-33)
SEQQVDRIIL

SEQ ID NO: 16120 - protein, 10 aa, Artificial Sequence
  Protein deglycase DJ-1 (83-92)
SESAAVKEIL

SEQ ID NO: 16121 - protein, 11 aa, Artificial Sequence
  Coatomer subunit gamma-1 (429-439)
SESKETGLSHL

SEQ ID NO: 16122 - protein, 9 aa, Artificial Sequence
  Probable ubiquitin carboxyl-terminal hydrolase FAF-X (1855-1863)
SETAGSTKY

SEQ ID NO: 16123 - protein, 10 aa, Artificial Sequence
  Homocysteine-responsive endoplasmic reticulum-resident ubiquitin-like domain member 1 protein (3-12)
SETEPEPVTL

SEQ ID NO: 16124 - protein, 9 aa, Artificial Sequence
  DNA-dependent protein kinase catalytic subunit (1564-1572)
SETINTELL

SEQ ID NO: 16125 - protein, 10 aa, Artificial Sequence
  Adipocyte plasma membrane-associated protein (402-411)
SEVHEHDGHL

SEQ ID NO: 16126 - protein, 9 aa, Artificial Sequence
  Ubiquitin-like modifier-activating enzyme 1 (251-259)
SEVQGMVEL

SEQ ID NO: 16127 - protein, 11 aa, Artificial Sequence
  Zinc finger and BTB domain-containing protein 2 (491-501)
SEVTEPDHPVL

SEQ ID NO: 16128 - protein, 10 aa, Artificial Sequence
  60S ribosomal protein L28 (37-46)
SFRYNGLIHR

SEQ ID NO: 16129 - protein, 9 aa, Artificial Sequence
  Prelamin-A/C (424-432)
SGDPAEYNL

SEQ ID NO: 16130 - protein, 9 aa, Artificial Sequence
  Replication protein A 70 kDa DNA-binding subunit (149-157)
SGMGSTVSK

SEQ ID NO: 16131 - protein, 9 aa, Artificial Sequence
  Exocyst complex component 4 (448-456)
SHAISMSAY

SEQ ID NO: 16132 - protein, 9 aa, Artificial Sequence
  Unconventional myosin-Ib (546-554)
SHALIKSLF

SEQ ID NO: 16133 - protein, 9 aa, Artificial Sequence
  Transcription factor 4 (246-254)
SHIPQSSSY

SEQ ID NO: 16134 - protein, 9 aa, Artificial Sequence
  Dual specificity mitogen-activated protein kinase kinase 1 (86-94)
SHKPSGLVM

SEQ ID NO: 16135 - protein, 9 aa, Artificial Sequence
  Rho-related GTP-binding protein RhoE (218-226)
SHMPSRPEL

SEQ ID NO: 16136 - protein, 9 aa, Artificial Sequence
  Reticulon-3 (10-18)
SHSISSSSF

SEQ ID NO: 16137 - protein, 9 aa, Artificial Sequence
  Aminoacylase-1 (79-87)
SHTDVVPVF

SEQ ID NO: 16138 - protein, 9 aa, Artificial Sequence
  Sialin (259-267)
SHYEKEYIL

SEQ ID NO: 16139 - protein, 9 aa, Artificial Sequence
  Solute carrier family 35 member C2 (273-281)
SIAGIFKEV

SEQ ID NO: 16140 - protein, 9 aa, Artificial Sequence
  40S ribosomal protein S4, X isoform (72-80)
SIDKTGENF

SEQ ID NO: 16141 - protein, 11 aa, Artificial Sequence
  YTH domain-containing family protein 1 (434-444)
SIFDDFAHYEK

SEQ ID NO: 16142 - protein, 11 aa, Artificial Sequence
  YTH domain-containing family protein 2 (707-717)
SIFDDFSHYEK

SEQ ID NO: 16143 - protein, 9 aa, Artificial Sequence
  Transmembrane emp24 domain-containing protein 7 (192-200)
SIGQVFLLK

SEQ ID NO: 16144 - protein, 9 aa, Artificial Sequence
  Kit ligand (99-107)
SIIDKLVNI

SEQ ID NO: 16145 - protein, 9 aa, Artificial Sequence
  Heat shock protein HSP 90-alpha (763-771)
SIIETLRQK

SEQ ID NO: 16146 - protein, 12 aa, Artificial Sequence
  Poly(rC)-binding protein 2 (27-38)
SIIGKKGESVKK

SEQ ID NO: 16147 - protein, 9 aa, Artificial Sequence
  NADH dehydrogenase (ubiquinone) 1 alpha subcomplex subunit 13 (40-48)
SIMKWNRER

SEQ ID NO: 16148 - protein, 9 aa, Artificial Sequence
  Sterol regulatory element-binding protein 1 (338-346)
SINDKIIEL

SEQ ID NO: 16149 - protein, 10 aa, Artificial Sequence
  Ubiquitin-associated protein 2-like (325-334)
SIPQKPQTNK

SEQ ID NO: 16150 - protein, 11 aa, Artificial Sequence
  Alkyldihydroxyacetonephosphate synthase, peroxisomal (630-640)
SISDVGFGMLK

SEQ ID NO: 16151 - protein, 9 aa, Artificial Sequence
  Progressive ankylosis protein homolog (165-173)
SISDVIAQV

SEQ ID NO: 16152 - protein, 12 aa, Artificial Sequence
  Insulin-like growth factor 2 mRNA-binding protein 2 (181-192)
SIYNPERTITVK

SEQ ID NO: 16153 - protein, 11 aa, Artificial Sequence
  Fibronectin type III domain-containing protein 3B (555-565)
SIYRGPSHTYK

SEQ ID NO: 16154 - protein, 10 aa, Artificial Sequence
  Nuclear receptor coactivator 3 (336-345)
SLADGTIVTA

SEQ ID NO: 16155 - protein, 9 aa, Artificial Sequence
  Calmodulin-regulated spectrin-associated protein 2 (271-279)
SLADSLYNL

SEQ ID NO: 16156 - protein, 10 aa, Artificial Sequence
  ATPase family AAA domain-containing protein 2 (410-419)
SLADVDPMQL

SEQ ID NO: 16157 - protein, 9 aa, Artificial Sequence
  Wiskott-Aldrich syndrome protein family member 2 (67-75)
SLAERVDRL

SEQ ID NO: 16158 - protein, 9 aa, Artificial Sequence
  Histone H1x (66-74)
SLAKIYTEA

SEQ ID NO: 16159 - protein, 9 aa, Artificial Sequence
  Discoidin, CUB and LCCL domain-containing protein 2 (222-230)
SLANNVTSV

SEQ ID NO: 16160 - protein, 12 aa, Artificial Sequence
  Prohibitin (227-238)
SLATAGDGLIEL

SEQ ID NO: 16161 - protein, 9 aa, Artificial Sequence
  Arf-GAP with Rho-GAP domain, ANK repeat and PH domain-containing protein 3 (220-228)
SLDQPFLSK

SEQ ID NO: 16162 - protein, 9 aa, Artificial Sequence
  Transcription intermediary factor 1-beta (265-273)
SLDQPGGTL

SEQ ID NO: 16163 - protein, 9 aa, Artificial Sequence
  Dolichyl-diphosphooligosaccharide-proteinosyltransferase subunit 2 (40-48)
SLDRPFTNL

SEQ ID NO: 16164 - protein, 10 aa, Artificial Sequence
  Spatacsin (1958-1967)
SLDSQKFVTV

SEQ ID NO: 16165 - protein, 9 aa, Artificial Sequence
  Mothers against decapentaplegic homolog 6 (187-195)
SLDTLLEAV

SEQ ID NO: 16166 - protein, 10 aa, Artificial Sequence
  Activating transcription factor 7-interacting protein 2 (272-281)
SLDTNNNSHY

SEQ ID NO: 16167 - protein, 9 aa, Artificial Sequence
  Transcription factor E2-alpha (165-173)
SLDTQPKKV

SEQ ID NO: 16168 - protein, 10 aa, Artificial Sequence
  Transformation/transcription domain-associated protein (976-985)
SLEDNKHALY

SEQ ID NO: 16169 - protein, 10 aa, Artificial Sequence
  Probable E3 ubiquitin-protein ligase HERC6 (177-186)
SLEGIPLAQV

SEQ ID NO: 16170 - protein, 9 aa, Artificial Sequence
  Uncharacterized protein C17orf112 (97-105)
SLELDPPSL

(The sequence listing continues in the following parts.)

The invention claimed is:

1. A method of treating or preventing cancer, autoimmune diseases, or infectious diseases, wherein the method comprises administering, to a patient in need thereof, an effective amount of an artificial nucleic acid molecule comprising at least one coding region encoding:

(a) at least one antigenic peptide or protein; and (b) at least one additional amino acid sequence derived from at least one immune response activing signal transduction protein located in the external plasma membrane ($IRST_{epm}$), wherein said at least one additional amino acid sequence derived from at least one IRST$_{epm}$ comprises at least one transmembrane domain from CTLA4 (Cytotoxic T-lymphocyte protein 4) and localizes the antigenic peptide or protein to the plasma membrane.

2. The method of claim 1, wherein said at least one additional amino acid sequence further comprises at least one cytoplasmic domain of CTLA4.

3. The method of claim 2, wherein the at least one antigenic peptide or protein is from KRAS.

4. The method of claim 2, wherein the at least one antigenic peptide or protein is from a viral antigen.

5. The method of claim 1, wherein said at least one coding region further encodes at least one signal peptide.

6. The method of claim 5, wherein the at least one signal peptide comprises or consists of an amino acid sequence corresponding to any one of SEQ ID NOs: 1-156, 76948-76951, or a fragment, variant or derivative thereof, and is optionally encoded by a nucleic acid sequence according to any one of SEQ ID NOs: 209-364, 76952-76955, 625-780, 76960-76963, 833-988, 76964-76967, 417-572, 76956-76959, 1249-1404, 76972-76975, 1457-1612, 76976-76979, 1665-1820, 76980-76983, 1873-2028, 76984-76987, 2081-2236, 76988-76991, 2289-2444, 76992-76995, 2497-2652, 76996-76999, 2705-2860, 77000-77003, 1041-1196, or 76968-76971.

7. The method of claim 1, wherein said at least one antigenic peptide or protein is selected from or derived from tumor antigens, viral, bacterial, protozoal, fungal or allogenic antigens.

8. The method of claim 7, wherein said at least one antigenic peptide or protein comprises or consists of an amino acid sequence corresponding to any one of SEQ ID NOs: 3719-27945; 76420-76439, 76440-76474, and is optionally encoded by a nucleic acid sequence according to any one of SEQ ID NOs: 27946-52172; 76495-76514, 52173-76399; 76570-76589, 76515-76549, 76590-76624.

9. The method of claim 1, wherein said antigenic peptide or protein is from a tumor antigen is selected from BRAF, PIK3CA, KRAS, IDH1, TP53, NRAS, AKTI, SF3B1, CDKN2A, RPSAP58, EGFR, NY-ESO1, MUC-1, 5T4, Her2, MAGE-A3, LY6K, CEACAM6, CEA, MCAK, KK-LC1, Gastrin, VEGFR2, MMP-7, MPHOSPH1, MAGE-A4, MAGE-A1, MAGE-C1, PRAME, Survivin, MAGE-A9, MAGE-C2, FGFR2, WT1, PSA, PSMA, Prostate-specific antigen precursor, Kita-kyushu lung cancer antigen 1, Trophoblast glycoprotein, Cyclin-dependent kinase inhibitor 2A, Cyclin-dependent kinase inhibitor 2A, isoforms 1/2/3, multiple tumor suppressor 1/cyclin-dependent kinase 4 inhibitor p16, GTPase NRas or any combination thereof.

10. The method of claim 1, wherein said at least one IRST$_{epm}$ comprises or consists of an amino acid sequence corresponding to SEQ ID NO: 169, optionally encoded by a nucleic acid sequence corresponding to any one of SEQ ID NOs: 585, 793, 1001, 1209, 1417, 1625, 1833, 2041, 2249, 2457, 2665 or 2873.

11. The method of claim 1, further encoding in its at least one coding region at least one linker.

12. The method of claim 11, wherein said linker is a non-immunogenic linker, optionally comprising or consisting of an amino acid sequence according to any one of SEQ ID NOs: 2937, 76400-76418, 77018-77058 optionally encoded by a nucleic acid sequence according to any one of SEQ ID NOs: 2936, 76494, 76569, 76475-76493, 76550-76568, or 77059-77061.

13. The method of claim 1, wherein said at least one coding region further encodes at least one T helper epitope.

14. The method of claim 13, wherein said at least one helper epitope sequence comprises or consists of an amino acid sequence corresponding to any one of SEQ ID NOs: 3083-3294, optionally encoded by a nucleic acid sequence according to any one of SEQ ID NOs: 3295-3506, or 3507-3718.

15. The method of claim 1, wherein said artificial nucleic acid molecule is an RNA.

16. The method of claim 15, which comprises, preferably in 5' to 3' direction, the following elements:
   a) a 5'-CAP structure,
   b) optionally a 5'-UTR element,
   c) said at least one coding region sequence,
   d) optionally a 3'-UTR element,
   e) optionally a poly(A) tail,
   f) optionally a poly(C) tail, and
   g) optionally a histone stem-loop.

17. The method of claim 1, wherein the method is a method of treating or preventing cancer.

18. The method of claim 17, wherein the at least one antigenic peptide or protein is a KRAS epitope having a mutation selected from the group consisting of A146T; G12A; G12C; G12D; G12F; G12R; G12S; G12V; G13C; G13D; K117N; Q61H; Q61K; Q61L; and Q61R.

19. The method of claim 18, wherein the wherein the method is a method of treating or preventing cancer and wherein the artificial nucleic acid molecule is a mRNA.

20. The method of claim 19, wherein the patient has a pancreatic cancer.

21. The method of claim 1, wherein the method is a method of treating or preventing infectious diseases selected from the group consisting of viral, bacterial, fungal and protozoal infections.

* * * * *